United States Patent
Whitlock et al.

(10) Patent No.: US 11,225,640 B2
(45) Date of Patent: *Jan. 18, 2022

(54) AMMONIA OXIDIZING BACTERIA FOR TREATMENT OF PSORIASIS

(71) Applicant: AOBIOME LLC, Cambridge, MA (US)

(72) Inventors: David R. Whitlock, Cambridge, MA (US); Spiros Jamas, Cambridge, MA (US); Larry Weiss, San Francisco, CA (US)

(73) Assignee: AOBIOME LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/137,291

(22) Filed: Sep. 20, 2018

(65) Prior Publication Data

US 2019/0010446 A1 Jan. 10, 2019

Related U.S. Application Data

(63) Continuation of application No. 15/958,803, filed on Apr. 20, 2018, now Pat. No. 10,131,871, which is a continuation of application No. 15/649,323, filed on Jul. 13, 2017, now Pat. No. 10,017,731, which is a continuation of application No. 14/882,284, filed on Oct. 13, 2015, now Pat. No. 9,738,870, which is a continuation-in-part of application No. PCT/US2015/025909, filed on Apr. 15, 2015.

(60) Provisional application No. 62/189,105, filed on Jul. 6, 2015, provisional application No. 62/188,343, filed on Jul. 2, 2015, provisional application No. 62/053,588, filed on Sep. 22, 2014, provisional application No. 62/012,811, filed on Jun. 16, 2014, provisional application No. 62/002,084, filed on May 22, 2014.

(30) Foreign Application Priority Data

Apr. 15, 2014 (GR) .............................. 20140100217
Mar. 13, 2015 (GR) .............................. 20150100115

(51) Int. Cl.
| | | |
|---|---|---|
| A61K 9/00 | (2006.01) |
| A61K 48/00 | (2006.01) |
| A61K 35/74 | (2015.01) |
| A61K 8/99 | (2017.01) |
| A61K 35/744 | (2015.01) |
| A61K 35/745 | (2015.01) |
| A61K 35/747 | (2015.01) |
| C12R 1/01 | (2006.01) |
| C12N 1/20 | (2006.01) |
| C12N 1/00 | (2006.01) |
| C07K 14/195 | (2006.01) |
| A61L 15/36 | (2006.01) |
| A61Q 15/00 | (2006.01) |
| A61Q 19/00 | (2006.01) |
| C12Q 1/689 | (2018.01) |
| A61Q 17/04 | (2006.01) |
| C12Q 1/02 | (2006.01) |
| A61Q 19/02 | (2006.01) |
| A61Q 19/04 | (2006.01) |

(52) U.S. Cl.
CPC .................. *C12N 1/20* (2013.01); *A61K 8/99* (2013.01); *A61K 9/0014* (2013.01); *A61K 35/74* (2013.01); *A61K 35/744* (2013.01); *A61K 35/745* (2013.01); *A61K 35/747* (2013.01); *A61K 48/00* (2013.01); *A61L 15/36* (2013.01); *A61Q 15/00* (2013.01); *A61Q 17/04* (2013.01); *A61Q 19/00* (2013.01); *C07K 14/195* (2013.01); *C12N 1/00* (2013.01); *C12N 1/205* (2021.05); *C12Q 1/02* (2013.01); *C12Q 1/689* (2013.01); *A61Q 19/02* (2013.01); *A61Q 19/04* (2013.01); *C12R 2001/01* (2021.05)

(58) Field of Classification Search
CPC .. C12N 1/20; C12R 1/01; A01N 63/00; A61K 8/99; A61K 35/66; A61K 35/74; A61K 35/744; A61K 35/745; A61K 9/12; A61K 48/00

See application file for complete search history.

(56) References Cited

U.S. PATENT DOCUMENTS

| | | |
|---|---|---|
| 3,984,575 A | 10/1976 | Farr |
| 4,147,807 A | 4/1979 | Gryczka et al. |

(Continued)

FOREIGN PATENT DOCUMENTS

| | | |
|---|---|---|
| CN | 1997731 A | 7/2007 |
| CN | 102105132 A | 6/2011 |

(Continued)

OTHER PUBLICATIONS

Air Products 2004, MSDS, Version 1.4, Revision Date Apr. 4, 2004, pp. 1-6.

(Continued)

*Primary Examiner* — Ruth A Davis
(74) *Attorney, Agent, or Firm* — Lando & Anastasi, LLP

(57) ABSTRACT

A method for treating a skin disorder, e.g., acne, e.g. acne vulgaris, in a subject is provided. The method comprises administering, e.g., applying, e.g., topically administering, ammonia oxidizing bacteria, e.g., a preparation comprising ammonia oxidizing bacteria, to a surface of the subject. Preparations comprising ammonia oxidizing bacteria for treating such skin disorder, e.g., acne, e.g. acne vulgaris in a subject are also provided.

20 Claims, 4 Drawing Sheets

Specification includes a Sequence Listing.

(56) References Cited

U.S. PATENT DOCUMENTS

| | | |
|---|---|---|
| 4,335,107 A | 6/1982 | Snoeyenbos et al. |
| 4,689,226 A | 8/1987 | Nurmi et al. |
| 4,720,344 A | 1/1988 | Ganczarczyk et al. |
| 5,139,792 A | 8/1992 | Ware et al. |
| 5,176,911 A | 1/1993 | Tosi et al. |
| 5,278,192 A | 1/1994 | Fung et al. |
| 5,314,542 A | 5/1994 | Cassidy et al. |
| 5,322,686 A | 6/1994 | Grahn et al. |
| 5,380,758 A | 1/1995 | Stamler et al. |
| 5,385,940 A | 1/1995 | Moskowitz |
| 5,396,882 A | 3/1995 | Zapol |
| 5,427,797 A | 6/1995 | Frostell et al. |
| 5,451,400 A | 9/1995 | Stern et al. |
| 5,519,020 A | 5/1996 | Smith et al. |
| 5,534,253 A | 7/1996 | Casas et al. |
| 5,570,683 A | 11/1996 | Zapol |
| 5,574,068 A | 11/1996 | Stamler et al. |
| 5,595,753 A | 1/1997 | Hechtman |
| 5,604,127 A | 2/1997 | Nisbet et al. |
| 5,632,981 A | 5/1997 | Saavedra et al. |
| 5,645,839 A | 7/1997 | Chobanian et al. |
| 5,646,181 A | 7/1997 | Fung et al. |
| 5,648,101 A | 7/1997 | Tawashi |
| 5,648,393 A | 7/1997 | Stamler et al. |
| 5,650,447 A | 7/1997 | Keefer et al. |
| 5,665,077 A | 9/1997 | Rosen et al. |
| 5,693,676 A | 12/1997 | Gorfine |
| 5,713,349 A | 2/1998 | Keaney |
| 5,714,511 A | 2/1998 | Saavedra et al. |
| 5,721,278 A | 2/1998 | Garfield et al. |
| 5,725,492 A | 3/1998 | Igo et al. |
| 5,728,705 A | 3/1998 | Lawson et al. |
| 5,765,548 A | 6/1998 | Perry |
| 5,767,160 A | 6/1998 | Kaesemeyer |
| 5,789,447 A | 8/1998 | Wink, Jr. et al. |
| 5,800,385 A | 9/1998 | Demopulos et al. |
| 5,801,203 A | 9/1998 | Lipton |
| 5,807,546 A | 9/1998 | Stern et al. |
| 5,814,656 A | 9/1998 | Saavedra et al. |
| 5,814,666 A | 9/1998 | Green et al. |
| 5,821,112 A | 10/1998 | Botto et al. |
| 5,824,669 A | 10/1998 | Garvey et al. |
| 5,834,030 A | 11/1998 | Bolton |
| 5,839,433 A | 11/1998 | Higenbottam et al. |
| 5,849,180 A | 12/1998 | Sumino et al. |
| 5,849,192 A | 12/1998 | Jagush et al. |
| 5,858,017 A | 1/1999 | Demopulos et al. |
| 5,861,168 A | 1/1999 | Cooke et al. |
| 5,873,359 A | 2/1999 | Zapol et al. |
| 5,891,472 A | 4/1999 | Russell |
| 5,892,658 A | 4/1999 | Urda et al. |
| 5,900,433 A | 5/1999 | Igo et al. |
| 5,904,938 A | 5/1999 | Zapol et al. |
| 5,910,316 A | 6/1999 | Keefer et al. |
| 5,910,482 A | 6/1999 | Yallampalli et al. |
| 5,912,019 A | 6/1999 | Singh |
| 5,958,427 A | 9/1999 | Salzman et al. |
| 5,994,444 A | 11/1999 | Trescony et al. |
| 7,267,816 B2 | 9/2007 | Hovanec |
| 7,314,748 B1 | 1/2008 | Fredenburgh et al. |
| 9,738,870 B2 * | 8/2017 | Whitlock .......... A61K 9/0014 |
| 10,017,731 B2 * | 7/2018 | Whitlock .......... A61K 9/0014 |
| 10,131,871 B2 * | 11/2018 | Whitlock .......... A61K 9/0014 |
| 2004/0014188 A1 | 1/2004 | Whitlock |
| 2005/0036996 A1 | 2/2005 | Roussel et al. |
| 2005/0244382 A9 | 11/2005 | Whitlock |

FOREIGN PATENT DOCUMENTS

| | | |
|---|---|---|
| EP | 0761607 A1 | 3/1997 |
| EP | 0780419 A1 | 6/1997 |
| EP | 0987000 A1 | 3/2000 |
| FR | 2682296 A1 | 4/1993 |
| GB | 2020174 A | 11/1979 |
| JP | 59-135845 A | 8/1984 |
| JP | S63227515 A | 9/1988 |
| JP | 02-121665 A | 5/1990 |
| JP | 02-169092 A | 6/1990 |
| JP | 03-289957 A | 12/1991 |
| JP | 09-075984 A | 3/1997 |
| RU | 2613708 C2 | 3/2017 |
| WO | 09827991 A1 | 7/1998 |
| WO | 0213982 A1 | 2/2002 |
| WO | 03057380 A2 | 7/2003 |
| WO | 2005030147 A2 | 4/2005 |

OTHER PUBLICATIONS atcc.orglcommonlcatalog/wordSearch/results.cfm, total of 4 pages, (2006).
Bock et al., "Oxidation of Inorganic Nitrogen Compounds as Energy Source," In: The Prokaryotes. A Handbook on the Biology of Bacteria: Ecophysiology, Isolation, Identification, Applications. Edited by Balows et al. Springer-Verlag. Second Edition. 1992, vol. 1. Chapter 17, pp. 414-417.
Brochures for Ultra Bac from ABI, Inc., Cleveland, OH, undated.
Catalogue of Bacteria and Phages. 1989. American Type Culture Collection. p. 152, col. 2.
Head et al., 1993, The Phylogeny of Autotrophic Ammonia-Oxidizing Bacteria as Determined by Analysis of 16s Ribosomal RNA Gene Sequences. Journal of General Microbiology, vol. 139, pp. 1147-1153.
Ida et al., 2004, Identification of Genus *Nitrosovibrio*, Ammonia-Oxidizing Bacteria by Comparison of N-Terminal Amino Acid Sequences of Phosphoglycerate Kinase, Journal of Bioscience and Bioengineering, vol. 98, No. 5, pp. 380-383.
International Search Report and Written Opinion dated Oct. 14, 2015 for Application No. PCT/US2015/025909.
Norton et al., "Diversity of ammonia monooxygenase operon in autotrophic ammonia-oxidizing bacteria," Archives of Microbiology, vol. 177, No. 2, pp. 139-149 (Feb. 2002).
Stein et al., "Whole-genome analysis of the ammonia-oxidizing bacterium, *Nitrosomonas eutrophra* C91: implications for niche adaption," Environmental Microbiology, vol. 9, No. 12, pp. 2993-3007 (Dec. 2007).
Suwa et al., "Phylogenetic relationships of activated sludge isolates of ammonia oxidizers with different sensitivities to ammonium sulfate," Journal of General and Applied Microbiology, vol. 43, pp. 373-379 (Jan. 1, 1997).
MedicineNet, 1998, Definition of Vagina, p. 1 of 1. Last Editorial Review: Mar. 26, 1998: http://www.medicinenet.com/script/main/art.asp?articlekey=5951 Printed Nov. 27, 2009.
Skripkin U.K., "Skin and venereal diseases", Triada-X, pp. 462-463 (2000).
Dreno B. et al., "The role of topical dermocosmetics in acne vulgaris", J Eur Acad Dermatol Venereol, abstract (Jun. 30, 2016).
Haofeng Yang et al., "Isolation and identification of an ammonia oxidizing bacterium and its ammonia oxidation characteristics", Genomics and Applied Biology, vol. 32, No. 4, pp. 453-458 (2013).

* cited by examiner

AMMONIA OXIDIZING BACTERIA FOR TREATMENT OF PSORIASIS

CROSS-REFERENCE TO RELATED APPLICATIONS

This application is a continuation of U.S. patent application Ser. No. 15/958,803, filed Apr. 20, 2018, which is a continuation of U.S. patent application Ser. No. 15/649,323, filed Jul. 13, 2017 (now U.S. Pat. No. 10,017,731), which is a continuation of U.S. patent application Ser. No. 14/882,284, filed Oct. 13, 2015 (now U.S. Pat. No. 9,738,870), which claims priority to U.S. Provisional Application No. 62/188,343, filed Jul. 2, 2015, U.S. Provisional Application No. 62/189,105, filed Jul. 6, 2015, and is a continuation-in-part of International Patent Application No. PCT/US2015/025909, filed Apr. 15, 2015, which in turn claims priority to Greek Patent Application Number 20140100217, filed Apr. 15, 2014, U.S. Provisional Application No. 62/002,084, filed May 22, 2014, U.S. Provisional Application No. 62/012,811, filed Jun. 16, 2014, U.S. Provisional Application No. 62/053,588, filed Sep. 22, 2014, and Greek Patent Application Number 20150100115, filed Mar. 13, 2015, the content of each of which is incorporated herein by reference in its entirety for all purposes.

SEQUENCE LISTING

The instant application contains a Sequence Listing which has been submitted electronically in ASCII format and is hereby incorporated by reference in its entirety. Said ASCII copy, created on Jan. 25, 2016, is named N2060-700130_SL.txt and is 3,591,125 bytes in size.

BACKGROUND

Beneficial bacteria can be used to suppress the growth of pathogenic bacteria. Bacteria and other microorganisms are ubiquitous in the environment. The discovery of pathogenic bacteria and the germ theory of disease have had a tremendous effect on health and disease states. Bacteria are a normal part of the environment of all living things. In the gut, these bacteria are not pathogenic under normal conditions, and in fact improve health by rendering the normal intestinal contents less hospitable for disease causing organisms. Disease prevention is accomplished in a number of ways: nutrients are consumed, leaving less for pathogens; conditions are produced, such as pH and oxygen tension, which are not hospitable for pathogens; compounds are produced that are toxic to pathogens; pathogens are consumed as food by these microorganisms; less physical space remains available for pathogens; and specific binding sites are occupied leaving fewer binding sites available for pathogens. The presence of these desirable bacteria is seen as useful in preventing disease states.

There is a need in the art for improved beneficial bacteria that can suppress the growth of pathogenic bacteria, for example, with regard to the treatment of skin conditions, e.g., acne, e.g., acne vulgaris.

Acne is the most common skin disease and the top reported cause for dermatologist visitations, accounting for about one-fourth of U.S. dermatologists' patient volume. Traditionally thought of as a trivial, "normal" condition, acne has recently been medically redefined to be a chronic disease, one that can significantly impact an individual's quality of life with social, psychological and emotional impairments that are comparable to those reported by patients with epilepsy, asthma, diabetes or arthritis. In the United States alone, acne affects approximately 40 to 50 million people, 20-25% suffer from moderate-to-severe acne. U.S. sales of the Top 10 Branded acne therapeutics have a $3 billion run rate and are comprised of $1.5 billion in systemic retinoids, $700 million in oral antibiotics, $600 million in topic antibiotics and $240 million in topical retinoids. Globally, the prevalence of acne is approximately 80% among adolescents and 50% among young adults. Despite the significant spend on prescription and over the counter remedies, acne remains an area of significant unmet medical need as treatments are either marginally effective (topical antibiotics, topical retinoids, astringents) and/or associated with serious risks (oral retinoids). In addition to the need for a safe and effective product to prevent and treat inflammatory and non-inflammatory acne lesions, there is a substantial unmet need and commercial opportunity for a topical therapy that targets excess sebum production.

TABLE 1

| | Acne Severity | | | | |
| --- | --- | --- | --- | --- | --- |
| | Mild | | | | |
| | Comedonal | | Moderate | | Severe |
| | blackheads/white heads | Mixed and papular/pustular | Nodular | | Nodular/conglobate |
| First-line | Topical retinoid | Topical retinoid + topical antimicrobial | Oral antibiotic + topical retinoid +/− benzoyl peroxide | Oral antibiotic + topical retinoid +/− benzoyl peroxide | Oral isotretinoin[3] |
| Second-line/ Alternatives[1] | Alternative topical retinoid or azelaic acid or salicylic acid | Alternative topical retinoid; antimicrobial agent + alternative topical retinoid or azelaic acid | Alternative oral antibiotic + alternative topical retinoid +/− benzoyly peroxide | Oral isotretinoin or alternative oral antibiotic + alternative topical retinoid +/− benzoyl peroxide azelaic acid | High dose oral antibiotic + topical retinoid + benzoyl peroxide |

TABLE 1-continued

| | Acne Severity | | | | |
|---|---|---|---|---|---|
| | Mild | | | Moderate | Severe |
| | Comedonal | | | | |
| | blackheads/white heads | Mixed and papular/pustular | | Nodular | Nodular/conglobate |
| Alternatives for females[1,4] | See first-line options | See first-line options | Oral anti-androgen[5] + topical retinoid/ azelaic acid +/− topical antimicrobial | Oral anti-androgen[5] + topical retinoid/ azelaic acid +/− topical antimicrobial | High dose oral anti-androgen + topical retinoid +/− alternative topical antimicrobial |
| Maintenance therapy: | | Topical retinoid | | Topical Retinoid +/− benzoyl peroxide | |

Source: Global Data; adapted from AcneAcademy, 2010.
[1] consider physical removal of comedones;
2 - with small nodules (<.5 cm);
[3] second course in case of relapse;
[4] for pregnancy; options are limited;
[5] for further information refer to Gollnick et al., 2003.

An ideal target product may have one or more of the following properties: self-administered (e.g., once daily, e.g., twice daily); odorless, colorless and invisible; not associated with increased sensitivity to sunlight; safe, non-toxic if ingested/inhaled and well tolerated on the skin, adjacent mucous membranes and eyes; suitable for both treatment and maintenance therapy without the risk of fostering antibiotic resistance; and acts locally to (in order of priority): reduce the frequency of lesions (antibiotic, anti-inflammatory); reduce the duration of lesions (improved healing); reduce the inflammation of lesions (anti-inflammatory); potentially prevent or reduce aberrant pigmentation and scarring (improved healing); speed the healing of damaged skin (improved healing); reduce the production of excess sebum; and decrease the presence of pathogenic bacteria (antibiotic).

SUMMARY

The present disclosure provides for a method of treating a skin disorder, e.g., acne, e.g. acne vulgaris, of a subject. The method comprises administering, e.g., applying, e.g., topically administering, ammonia oxidizing bacteria, e.g., a preparation comprising ammonia oxidizing bacteria, to a surface of the subject.

In some embodiments, an amount and a frequency of administration, e.g., application, is sufficient to reduce the amount or concentration of pathogenic bacteria, e.g., *Propionibacterium acnes*, on the surface of the subject. In some instances the amount is a therapeutically effective dose of ammonia oxidizing bacteria. In some instances, the skin disorder is acne, e.g., acne vulgaris.

In some embodiments, administering provides for treatment of inflammatory lesions, e.g., papules, pustules, cysts/nodules. In some embodiments, administering provides for treatment of non-inflammatory lesions, e.g., open comedones, closed comedones. In some embodiments, administering provides for treatment or improvement of post-inflammatory hyperpigmentation/post inflammatory erythema (PIH/PIE) lesions. In some embodiments, administering provides for treatment or improvement of one or more of erythema, edema, scaling, stinging, burning, and itching. In some embodiments, administering provides for treatment or improvement of one or more oily appearance, pore appearance, radiance, blotchiness, skin tone evenness, visual smoothness, and tactile smoothness. In some embodiments, administering provides for treatment or improvement in sebumeter measurements.

In some embodiments, administering comprises pre-treating the subject with ammonia oxidizing bacteria. In some embodiments, topically administering comprises topically administering prior to occurrence of the skin disorder. In some embodiments, topically administering comprises topically administering to the subject an effective dose of ammonia oxidizing bacteria. In some instances, the effective dose is about $0.1 \times 10^9$, $0.2 \times 10^9$, $0.3 \times 10^9$, $0.4 \times 10^9$, $0.5 \times 10^9$, $0.6 \times 10^9$, $0.7 \times 10^9$, $0.8 \times 10^9$, $0.9 \times 10^9$, $1.0 \times 10^9$, $1.2 \times 10^9$, $1.4 \times 10^9$, $1.5 \times 10^9$, $1.6 \times 10^9$, $1.8 \times 10^9$, $2.0 \times 10^9$, $2.2 \times 10^9$, $2.4 \times 10^9$, $2.6 \times 10^9$, $2.8 \times 10^9$, $3.0 \times 10^9$, $3.2 \times 10^9$, $3.4 \times 10^9$, $3.6 \times 10^9$, $3.8 \times 10^9$, $4.0 \times 10^9$, $4.2 \times 10^9$, $4.4 \times 10^9$, $4.6 \times 10^9$, $4.8 \times 10^9$, $5.0 \times 10^9$, $5.5 \times 10^9$, $6.0 \times 10^9$, $6.5 \times 10^9$, $7.0 \times 10^9$, $7.5 \times 10^9$, $8.0 \times 10^9$, $8.5 \times 10^9$, $9.0 \times 10^9$, $9.5 \times 10^9$, $10.0 \times 10^9$, $12 \times 10^9$, $14 \times 10^9$, $16 \times 10^9$, $18 \times 10^9$, $20 \times 10^9$, $25 \times 10^9$, $30 \times 10^9$, $40 \times 10^9$, $50 \times 10^9$ CFU.

In some embodiments, the skin disorder is at a target site of the subject and comprises one or more undesirable bacteria, e.g., pathogenic bacteria. In some instances, the target sight comprises *Propionibacterium acnes*.

In some embodiments, the method further comprises determining whether the subject is in need of treating the skin disorder, e.g., determining whether the subject it in need of treating acne, e.g., acne vulgaris. In some embodiments, the method further comprises selecting the subject in need of treating the skin disorder.

In some embodiments, the ammonia oxidizing bacteria, e.g., preparation comprising ammonia oxidizing bacteria may be in a form that may be capable of being aerosolized, sprayed or misted, i.e., in the form of a mist. In some embodiments, the ammonia oxidizing bacteria, e.g., preparation may be applied as an aerosol or mist, e.g., in an aqueous medium. In some embodiments, the ammonia oxidizing bacteria, e.g., preparation of ammonia oxidizing bacteria may be ammonia oxidizing bacteria in a buffer solution, e.g., aqueous buffer solution. In some instances, the buffer solution, e.g., aqueous buffer solution, comprises disodium phosphate and magnesium chloride, for example, 50 mM $Na_2HPO_4$ and 2 mM $MgCl_2$ in water. In some instances the buffer solution e.g., aqueous buffer solution, consists essentially of disodium phosphate and magnesium chloride, for example, 50 mM $Na_2HPO_4$ and 2 mM $MgCl_2$ in water. In some instances, the buffer solution, e.g., aqueous buffer solution, consists of disodium phosphate and magnesium chloride, for example, 50 mM $Na_2HPO_4$ and 2 mM $MgCl_2$ in water.

In some embodiments, the method further comprises selecting the subject on the basis of the subject being in need of a reduction of the amount or concentration of pathogenic bacteria, e.g., *Propionibacterium acnes*, on the surface of the subject. In some embodiments, the ammonia oxidizing bacteria is self-administered.

In some embodiments, the ammonia oxidizing bacteria applied to any one or more of the face, neck, and scalp of the subject.

In some embodiments, the preparation comprises at least one of ammonia, ammonium salts, and urea. In some instances, the preparation comprises a controlled release material, e.g., slow release material. In some instances, the preparation of ammonia oxidizing bacteria, further comprises an excipient, e.g., one of a pharmaceutically acceptable excipient or a cosmetically acceptable excipient. In some instances, the excipient, e.g., one of the pharmaceutically acceptable excipient and the cosmetically acceptable excipient, is a surfactant. In some instances, the preparation is substantially free of other organisms. In some instances, the preparation is disposed in a powder, cosmetic, cream, stick, aerosol, e.g., mist, salve, wipe, or bandage. In some instances, the preparation is provided as a powder, cosmetic, cream, stick, aerosol, e.g., mist, salve, wipe, or bandage. In some instances, the preparation comprises a moisturizing agent, deodorizing agent, cent, colorant, insect repellant, cleansing agent, or UV-blocking agent. In some instances the excipient, e.g., the pharmaceutically acceptable excipient or the cosmetically acceptable excipient, comprises an anti-adherent, binder, coat, disintegrant, filler, flavor, color, lubricant, glidant, sorbent preservative, or sweetener.

In some instances, the preparation comprising ammonia oxidizing bacteria comprises about $10^8$ to about $10^{14}$ CFU/L. In some instances, the preparation comprising ammonia oxidizing bacteria comprises about $10^8$ to about $10^{14}$ CFU/mL. In some instances, the preparation comprises between about $1 \times 10^9$ CFU/L to about $10 \times 10^9$ CFU/L. In some instances, the preparation comprises between about $1 \times 10^9$ CFU/mL to about $10 \times 10^9$ CFU/mL.

In some embodiments, the preparation comprising ammonia oxidizing bacteria comprises between about 50 milligrams (mg) and about 1000 mg of ammonia oxidizing bacteria. In some instances, the mass ratio of ammonia oxidizing bacteria to the excipient, e.g., the pharmaceutically acceptable excipient or the cosmetically acceptable excipient is in a range of about 0.1 grams to about 1 gram per liter.

In some embodiments, the ammonia oxidizing bacteria is selected from the group consisting of *Nitrosomonas, Nitrosococcus, Nitrosospira, Nitrosocystis, Nitrosolobus, Nitrosovibrio*, and combinations thereof. In some instances, the ammonia oxidizing bacteria is *Nitrosomonas eutropha* (*N. eutropha*). In some instances, the ammonia oxidizing bacteria is *N. eutropha* D23, having ATCC accession number PTA-121157.

In some embodiments, the preparation comprises an organism selected from the group consisting of *Lactobacillus, Streptococcus, Bifidobacter*, and combinations thereof.

In some embodiments, the method is provided to deliver a cosmetic product. In some embodiments, the method is provided to deliver a therapeutic product.

In some embodiments, the preparation is provided in a container, the preparation and the container having a weight of less than about 50, 100, 200, 300, 400, 500, 600, 700, 800, 900, 1000, 1500, or 2000 grams.

In some embodiments, the preparation is applied about 1, 2, 3, 4, 5, 6, 7, 8, 9, 10, 11, 12, 13, 14, 15, 16, 17, 18, 19, 20, 21, 22, 23, or 24 times per day. In some instances, the preparation is applied one time per day. In some instances, the preparation is applied two times per day.

In some embodiments, the preparation is applied for about 1-3, 3-5, 5-7, 7-9, 5-10, 10-14, 12-18, 12-21, 21-28, 28-35, 35-42, 42-49, 49-56, 46-63, 63-70, 70-77, 77-84, or 84-91 days. In some instances, the preparation is applied for about 7 days. In some instances, the preparation is applied for about 14 days. In some instances, the preparation is applied for about 21 days. In some instances, the preparation is applied for about 28 days.

In some embodiments, the method further comprises obtaining a sample from the surface of the skin. In some instances, the method further comprises isolating DNA of bacteria in the sample. In some instances, the method further comprises sequencing DNA of bacteria in the sample. In some instances, the bacteria is *Propionibacterium acnes*.

In some embodiments, administering the ammonia oxidizing bacteria provides for a decrease in *Propionibacterium acnes*. In some instances, the *Propionibacterium acnes* decreases, e.g., a concentration of *Propionibacterium acnes* decreases, after about 1, 2, 3, 4, 5, 6, 7, 8, 9, 10, 11, 12, 13, 14, 15, 16, 17, 18, 19, 20, 21, 22, 23, 24, 25, 26, 27, or 28 days.

In some embodiments, the method further comprises administering, e.g., self-administering, one or more of a shampoo, a conditioner, and a cleanser, e.g., a facial cleanser. In certain instances, any one or more of shampoo, conditioner, and facial cleanser is applied 1 time per day. In certain instances, the shampoo used was Lot 293178. In certain instances, the cleanser used was Lot 293162. In certain instances, at least one of a shampoo, conditioner, and soap was used subsequent to discontinuing of administration of the ammonia oxidizing bacteria. In certain instances, at least one of the shampoo, conditioner, and soap was used subsequent to discontinuation of the preparation of ammonia oxidizing bacteria.

In some embodiments, the subject was evaluated prior to beginning treatment, e.g., administering the ammonia oxidizing bacteria. In some embodiments, the subject was evaluated 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 days; or 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52 weeks; or 2.3 years, 4, or 5 years after beginning treatment, e.g., administering the ammonia oxidizing bacteria.

In some embodiments, administering ammonia oxidizing bacteria, e.g., the preparation of ammonia oxidizing bacteria, provides for one or more of the following: reduces inflammation of lesions, reduces the frequency of lesions, and decreases the presence of pathogenic bacteria, e.g., *Propionibacterium acnes*. In some instances, administering the preparation provides for reduction of inflammation of lesions. In some instances, administering the preparation provides for reduction of inflammation of lesions in adults. In some instances, administering the preparation provides for reducing in the frequency of lesions. In some instances, administering the preparation provides for decreasing the presence of pathogenic bacteria, e.g., *Propionibacterium acnes*. In some instances, administering the preparation provides for an improvement in the subject's emotional assessment of their disease as measured by Skindex16 Quality-of-Life Survey. In some instances, administering the preparation provides for an improvement in one or more of the following: skin condition hurting in the subject, persistence/reoccurrence of skin condition in the subject, and appearance of skin condition in the subject. In some instances, administering the preparation provides for an improvement (decrease) in one or more of the following, according to clinical grading: grading scores for visual and tactile smoothness, and blotchiness.

In some embodiments, the subject is female. In other embodiments, the subject is male. In some instances, the subject is one of the following ethnicity/race: Asian, black or African American, Hispanic or Latino, white, or multiracial. In some instances, the subject is characterized as having at least one of the following skin types: normal, oily, and combination skin. In some instances, the subject is characterized as having one of the following Fitzpatrick skin types: I, II, III, IV, V. In some instances, the acne is characterized as adolescent acne. In some instances, the acne is characterized as adult acne. In some instances, the age of the subject is between about 12-15, 16-18, 19-28, or greater than 28.

In some embodiments, an acne treatment selected from the group consisting of: a topical retinoid, azaelaic acid, salicylic acid, a topical antimicrobial, an oral antibiotic, benzoyl peroxide, an oral anti-androgen, an oral isotretinoin, and combinations thereof is administered to the subject. In some embodiments, the acne treatment is administered for a period of time prior to commencing administration of the ammonia oxidizing bacteria. In some embodiments, the acne treatment is continued throughout a time period for administration of the ammonia oxidizing bacteria. In some embodiments, the acne treatment is administered for a period of time prior to commencing administration of ammonia oxidizing bacteria and is ceased prior to commencement of administration of the ammonia oxidizing bacteria. In some embodiments, the acne treatment is ceased during the administration of the ammonia oxidizing bacteria. In some embodiments, the acne treatment is continued throughout administration of the ammonia oxidizing bacteria. In some embodiments, the acne treatment is commenced subsequent to ceasing administration of ammonia oxidizing bacteria.

In some embodiments, administration occurs 30, 60, 90, 120, 150, 180 minutes before the subject cleanses or showers.

In some embodiments, a preparation comprising ammonia oxidizing bacteria, as recited above, or in any portion of this disclosure, for the treatment of a skin condition, e.g., acne, e.g., acne vulgaris is provided.

The disclosure contemplates all combinations of any one or more of the foregoing aspects and/or embodiments, as well as combinations with any one or more of the embodiments set forth in the detailed description and examples.

DETAILED DESCRIPTION

Figure 1:
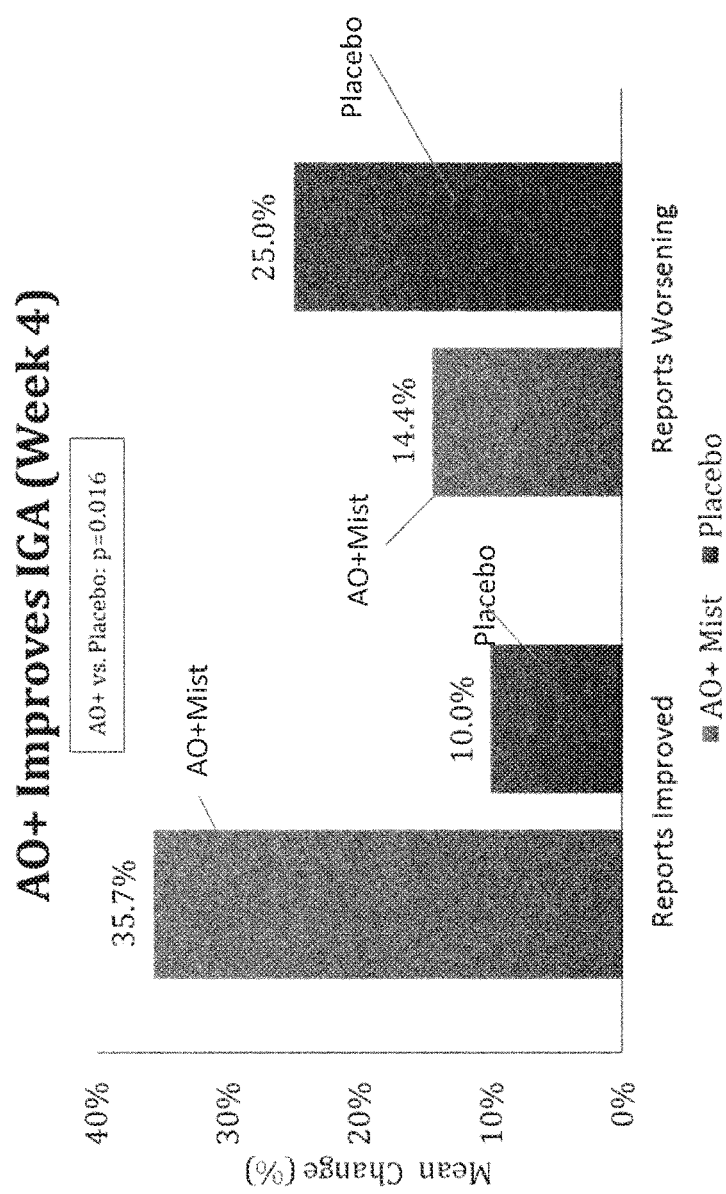
FIG. 1 shows the improvement of IGA using ammonia oxidizing bacteria (AO+Mist) at Week 4. Mean change (%) is plotted versus report of improvement and report of worsening in AO+Mist and Placebo.

The present disclosure provides for methods of treating skin conditions, e.g., acne, e.g., acne vulgaris. The methods comprise administering to a subject ammonia oxidizing bacteria, for example, a preparation comprising ammonia oxidizing bacteria.

Preparations, compositions, and formulations, e.g., including non-natural products, natural products, and fortified natural products, comprising, consisting essentially of, or consisting of ammonia oxidizing bacteria are contemplated for use in treatment of a skin condition, e.g., acne, e.g., acne vulgaris. Compositions for use in the treatment of a skin condition, e.g, acne vulgaris, e.g., acne in a subject are contemplated comprising ammonia oxidizing bacteria, e.g., a preparation comprising ammonia oxidizing bacteria.

Ammonia-oxidizing bacteria (AOB) of the genus *Nitrosomonas* are Gram-negative obligate autotrophic bacteria with a unique capacity to generate nitrite and nitric oxide exclusively from ammonia as an energy source. They are widely present both in soil and water environments and are essential components of environmental nitrification processes. Due to the roles of nitrite and nitric oxide on human skin as important components of several physiological functions, such as vasodilation, skin inflammation and wound healing, these bacteria may have beneficial properties for both healthy and immunopathological skin conditions. These bacteria are safe for use in humans because they are slow-growing, cannot grow on organic carbon sources, may be sensitive to soaps and antibiotics, and have never been associated with any disease or infection in animals or humans.

Ammonia oxidizing bacteria are ubiquitous Gram-negative obligate chemolithoautotrophic bacteria with a unique capacity to generate energy exclusively from the conversion of ammonia to nitrite.

In some embodiments, ammonia oxidizing bacteria catalyze the following reactions.

At a neutral pH, ammonia generated from ammonium around neutral pH conditions is the substrate of the initial reaction. The conversion of ammonia to nitrite takes place in two steps catalyzed respectively by ammonia monooxygenase (Amo) and hydroxylamine oxidoreductase (Hao), as follows:

$$NH_3 + 2H^+ + 2e^- + O_2 \rightarrow NH_2OH + H_2O \tag{A}$$

$$NH_2OH + H_2O \rightarrow NO_2^- + 4e^- + 5H^+ \tag{B}$$

In some instances, reaction B is reported as follows, to indicate nitrous acid ($HNO_2$) formation at low pH:

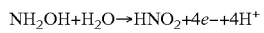

$$NH_2OH + H_2O \rightarrow HNO_2 + 4e^- + 4H^+$$

In certain embodiments, $NH_4^+$ and $NH_3$ may be used interchangeably throughout the disclosure.

The present disclosure provides for ammonia oxidizing bacteria, e.g., preparations comprising ammonia oxidizing bacteria that may:

Reduces inflammation of lesions (e.g., in an adult)
Reduce the frequency of lesions; and
Decrease the presence of pathogenic bacteria The ammonia oxidizing bacteria, e.g., preparations comprising ammonia oxidizing bacteria may also:

Reduce the duration of lesions
Prevent or reduce aberrant pigmentation and scarring
Shorten healing period of damaged skin; and
Reduce production of excess sebum (e.g., oily secretion of sebaceous glands).

The present disclosure provides for preparations comprising ammonia oxidizing bacteria for use in the treatment of a skin condition, e.g., acne, e.g., acne vulgaris, wherein the preparation may be one or more of the following: self-administered (e.g., 1-2 times daily), odorless, colorless, invisible, not associated with increased sensitivity to sunlight, safe, non-toxic, well tolerated on the skin (e.g., adjacent mucous membranes and eyes), suitable for children under 12, and suitable for both treatment and maintenance therapy without the risk of fostering antibiotic resistance.

Ammonia oxidizing bacteria, e.g., *N. eutropha*, for example *N. eutropha* referred to as "D23", also known as "B244" or "AOB D23-100" may have several of the above-described properties.

1. Definitions

An ammonia oxidizing bacterium refers to a bacterium capable of oxidizing ammonia or ammonium to nitrite at a rate, e.g., a substantial rate, e.g., a pre-determined rate. The rate, e.g., a pre-determined rate, may refer to the conversion of ammonium ions ($NH_4^+$) (e.g., at about 200 mM) to nitrite ($NO_2^-$) at a rate of at least 50, 75, 125, or 150 micromoles $NO_2^-$ per minute, e.g., about 100-150, 75-175, 75-125, 100-125, 125-150, or 125-175 micromoles/minute, e.g., about 125 micromoles $NO_2^-$ per minute. In embodiments, the rate, e.g., a pre-determined rate, may refer to the conversion of ammonium ions ($NH_4^+$) (e.g., at about 200 mM) to nitrite ($NO_2^-$) at a rate of at least 50, 75, 125, or 150 nanomoles $NO_2^-$ per minute per ml, e.g., about 100-150, 75-175, 75-125, 100-125, 125-150, or 125-175 nanomoles/minute/ml, e.g., about 125 nanomoles $NO_2^-$ per minute per ml for a continuous culture, for example having an OD of about 0.5.

Examples of ammonia oxidizing bacteria include *Nitrosomonas eutropha* strains, e.g., D23 and C91, and other bacteria in the genera *Nitrosomonas, Nitrosococcus, Nitrosospira, Nitrosocystis, Nitrosolobus*, and *Nitrosovibrio*. D23 *Nitrosomonas eutropha* strain refers to the strain, designated AOB D23-100, deposited with the American Tissue Culture Collection (ATCC) (10801 University Blvd., Manassas, Va., USA) on Apr. 8, 2014 having accession number PTA-121157. The nucleic acid sequence(s), e.g., genome sequence, of accession number PTA-121157 are hereby incorporated by reference in their entireties. In certain embodiments, the *N. eutropha* is a strain described in PCT Application No. PCT/US2015/025909, filed Apr. 15, 2015, herein incorporated by reference in its entirety. "AOB D23-100" may also be referred to as D23 or B244 throughout this disclosure.

Each and every nucleic acid sequence and amino acid sequence disclosed in PCT Application No. PCT/US2015/025909, filed Apr. 15, 2015, is herein incorporated by reference in its entirety. Any ammonia oxidizing bacteria disclosed in PCT Application No. PCT/US2015/025909, filed Apr. 15, 2015, is herein incorporated by reference in its entirety.

Optimized *Nitrosomonas eutropha* (*N. eutropha*), as that term is used herein, refers to an *N. eutropha* having an optimized growth rate; an optimized $NH_4^+$ oxidation rate; or optimized resistance to $NH_4^+$. In an embodiment it differs from naturally occurring *N. eutropha* by at least one nucleotide, e.g., a nucleotide in a gene selected from ammonia monooxygenase, hydroxylamine oxidoreductase, cytochrome c554, and cytochrome $c_M$552. The difference can arise, e.g., through selection of spontaneously arising mutation, induced mutation, or directed genetic engineering, of the *N. eutropha*. In an embodiment it differs from a naturally occurring *N. eutropha* in that it has a constellation of alleles, not present together in nature. These differences may provide for one or more of a treatment or prevention of a skin disorder, a treatment or prevention of a disease or condition associated with low nitrite levels, a treatment or prevention of body odor, a treatment to supply nitric oxide to a subject, and a treatment to inhibit microbial growth.

As used herein, "axenic" refers to a composition comprising an organism that is substantially free of other organisms. For example, an axenic culture of ammonia oxidizing bacteria is a culture that is substantially free of organisms other than ammonia oxidizing bacteria. For example, an axenic culture of *N. eutropha* is a culture that is substantially free of organisms other than *N. eutropha*. In some embodiments, "substantially free" denotes undetectable by a method used to detect other organisms, e.g., plating the culture and examining colony morphology, or PCR for a conserved gene such as 16S RNA. An axenic composition may comprise elements that are not organisms, e.g., it may comprise nutrients or excipients. Any embodiment, preparation, composition, or formulation of ammonia oxidizing bacteria discussed herein may comprise, consist essentially of, or consist of optionally axenic ammonia oxidizing bacteria.

Throughout this disclosure, formulation may refer to a composition or preparation.

As used herein, an "autotroph", e.g., an autotrophic bacterium, is any organism capable of self-nourishment by using inorganic materials as a source of nutrients and using photosynthesis or chemosynthesis as a source of energy. Autotrophic bacteria may synthesize organic compounds from carbon dioxide and ATP derived from other sources, oxidation of ammonia to nitrite, oxidation of hydrogen sulfide, and oxidation of $Fe^{2+}$ to $Fe^{3+}$ Autotrophic bacteria of the present disclosure are incapable of causing infection.

Administered "in combination," as used herein, means that two (or more) different treatments are delivered to the subject during the course of the subject's affliction with the disorder, e.g., the two or more treatments are delivered after the subject has been diagnosed with the disorder and before the disorder has been cured or eliminated. In some embodiments, the delivery of one treatment is still occurring when the delivery of the second begins, so that there is overlap. This is sometimes referred to herein as "simultaneous" or "concomitant" or "concurrent delivery". In other embodiments, the delivery of one treatment ends before the delivery of the other treatment begins. This is sometimes referred to herein as "successive" or "sequential delivery." In embodiments of either case, the treatment is more effective because of combined administration. For example, the second treatment is a more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive (i.e., synergistic). The delivery can be such that an effect of the first treatment delivered is still detectable when the second is delivered. In some embodiments, one or more treatment may be delivered prior to diagnosis of the patient with the disorder.

Complete *N. europaea* medium refers to the *N. europaea* growth medium described in Ensign et al., "In vitro activation of ammonia monooxygenase from *Nitrosomonas europaea* by copper." J Bacteriol. 1993 April; 175(7):1971-80.

To "culture" refers to a process of placing an amount of a desired bacterium under conditions that promote its growth, i.e., promoting cell division. The conditions can involve a specified culture medium, a set temperature range, and/or an agitation rate. Bacteria can be cultured in a liquid culture or on plates, e.g., agar plates.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

The terms "nucleic acid," "nucleic acid sequence," "nucleotide sequence," or "polynucleotide sequence," and "polynucleotide" are used interchangeably. They refer to a polymeric form of nucleotides of any length, e.g., deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a nonnatural arrangement.

As used herein, the term "optimized growth rate" refers to one or more of: a doubling time of less than about 4, 5, 6, 7, 8, 9, or 10 hours when cultured under batch conditions as described herein in Example 2; a doubling time of less than about 16, 18, 20, 22, 24, or 26 hours, when grown under chemostat conditions as described herein in Example 2; or growing from an OD600 of about 0.15 to at least about 0.3, 0.4, 0.5, 0.6, 0.7, or 0.8 over about 1 or 2 days. In an embodiment, optimized growth rate is one having a doubling time that it is at least 10, 20, 30, 40, or 50% shorter than that of a naturally occurring *N. eutropha*.

As used herein, "optimized $NH_4^+$ oxidation rate" refers to a rate of at least about 50, 75, 125, or 150 micromoles per minute of converting $NH_3$ or $NH_4^+$ into $NO_2$. For instance, the rate may be at least about 50, 75, 125, or 150 micromoles per minute of converting $NH_4^+$ (e.g., at about 200 mM) to $NO_2^-$. In an embodiment, an optimized $NH_4^+$ oxidation rate is one in which $NH_3$ or $NH_4^+$ is converted into $NO_2^-$, at least 10, 20, 30, 40, or 50% more rapidly than is seen with a naturally occurring *N. eutropha*.

Percent (%) amino acid sequence identity, with respect to the amino acid sequences here (e.g., proteins expressed by *N. eutropha* D23) is defined as the percentage of amino acid residues in a candidate sequence that are identical with the amino acid residues in the reference sequence, which may be a naturally-occurring *N. eutropha* sequence or an *N. eutropha* D23 sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the means of those skilled in the art, for instance, using publicly available computer software such as BLAST, ALIGN or Megalign (DNASTAR) software. Those skilled in the art can determine appropriate parameters for measuring alignment, including any algorithms needed to achieve maximal alignment over the full length of the sequences being compared. For instance, the WU-BLAST-2 software may be used to determine amino acid sequence identity (Altschul et al, Methods in Enzymology 266, 460-480 (1996); http://blast.wustl/edu/blast/README.html). WU-BLAST-2 uses several search parameters, most of which are set to the default values. The adjustable parameters are set with the following values: overlap span=1, overlap fraction=0.125, world threshold (T)=I 1. HSP score (S) and HSP S2 parameters are dynamic values and are established by the program itself, depending upon the composition of the particular sequence, however, the minimum values may be adjusted as appropriate.

Amino acid substitutions can be the result of replacing one amino acid with another amino acid having similar structural and/or chemical properties, such as the replacement of a leucine with a serine, i.e., conservative amino acid replacements. Typical but not limiting conservative substitutions are the replacements, for one another, among the aliphatic amino acids Ala, Val, Leu and Ile; interchange of Ser and Thr containing hydroxy residues, interchange of the acidic residues Asp and Glu, interchange between the amide-containing residues Asn and Gln, interchange of the basic residues Lys and Arg, interchange of the aromatic residues Phe and Tyr, and interchange of the small-sized amino acids Ala, Ser, Thr, Met and Gly. Additional conservative substitutions include the replacement of an amino acid by another of similar spatial or steric configuration, for example the interchange of Asn for Asp, or Gln for Glu. Amino acid substitutions can also be the result of replacing one amino acid with another amino acid having dis-similar structural and/or chemical properties, i.e., non-conservative amino acid replacements. Insertions or deletions may optionally be in the range of 1 to 5 amino acids. The variation allowed may be determined by systematically making insertions, deletions or substitutions of amino acids in the sequence and testing the resulting variants for activity in the in vivo or in vitro assays for, e.g., metabolizing urea or ammonia.

Percent (%) sequence identity with respect to the nucleic acid sequences here (e.g., the N. eutropha D23 genome and portions thereof) is defined as the percentage of nucleotides in a candidate sequence that are identical with the nucleotides in the reference sequence, which may be a naturally-occurring N. eutropha sequence or an N. eutropha D23 sequence, after aligning the sequences and introducing gaps, if necessary, to achieve the maximum percent sequence identity. Alignment for purposes of determining percent nucleotide sequence identity can be achieved in various ways that are within the means of those skilled in the art, for instance, using publicly available computer software such as BLAST. Those skilled in the art can determine appropriate parameters for measuring alignment, including any algorithms needed to achieve maximal alignment over the full length of the sequences being compared.

The terms "polypeptide", "peptide" and "protein" (if single chain) are used interchangeably herein to refer to amino acid polymers. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

As used herein, "optimized resistance to $NH_4^+$" refers to an ability to grow in conditions of greater than 50, 75, 100, 125, 150, 175, 200, 225, 250, 275, or 300 mM $NH_3$ or $NH_4^+$ for at least about 24 or 48 hours. In an embodiment, an optimized resistance to $NH_4^+$ refers to the ability to grow at least 10, 20, 30, 40, or 50% more rapidly, or at least 10, 20, 30, 40, or 50% longer, in the presence of a selected concentration of $NH_3$ or $NH_4^+$ than can a naturally occurring N. eutropha.

As used herein with respect to a comparison between nucleic acid or protein sequences, "similar" means having homology. A similar gene or protein may comprise, e.g., substitutions (such as conservative or non-conservative substitutions), insertions (e.g., of at least 1, 2, 3, 4, 5, 10, 15, 20, 25, 30 amino acids, and for example up to 2, 3, 4, 5, 10, 15, 20, 25, 30, or 50 amino acids, or any positive combination thereof, or the number of nucleotides necessary to encode said amino acids), or deletions (e.g., of at least 1, 2, 3, 4, 5, 10, 15, 20, 25, 30 amino acids, and for example up to 2, 3, 4, 5, 10, 15, 20, 25, 30, or 50 amino acids, or any positive combination thereof, or the number of nucleotides necessary to encode said amino acids), or any combination thereof. Each of substitutions, insertions, and deletions may be positioned at the N-terminus, C-terminus, or a central region of the protein or gene. In embodiments, a conservative substitution is one that does not alter the charge and/or polarity and/or approximate size and/or geometry at the substituted position.

As used herein, a "subject" may include an animal, a mammal, a human, a non-human animal, a livestock animal, or a companion animal. The term "subject" is intended to include human and non-human animals, for example, vertebrates, large animals, and primates. In certain embodiments, the subject is a mammalian subject, and in particular embodiments, the subject is a human subject. Although applications with humans are clearly foreseen, veterinary applications, for example, with non-human animals, are also envisaged herein. The term "non-human animals" of the disclosure includes all vertebrates, for example, non-mammals (such as birds, for example, chickens; amphibians; reptiles) and mammals, such as non-human primates, domesticated, and agriculturally useful animals, for example, sheep, dog, cat, cow, pig, rat, among others.

As used herein, "transgenic" means comprising one or more exogenous portions of DNA. The exogenous DNA is derived from another organism, e.g., another bacterium, a bacteriophage, an animal, or a plant.

As used herein, "treatment of a disease or condition" refers to reducing the severity or frequency of at least one symptom of that disease or condition, compared to a similar but untreated patient. Treatment can also refer to halting, slowing, or reversing the progression of a disease or condition, compared to a similar but untreated patient. Treatment may comprise addressing the root cause of the disease and/or one or more symptoms.

As used herein a "therapeutically effective amount" refers to a dose sufficient to prevent advancement, or to cause regression of a disease or condition, or which is capable of relieving a symptom of a disease or condition, or which is capable of achieving a desired result. A therapeutically effective dose can be measured, for example, as a number of bacteria or number of viable bacteria (e.g., in CFUs) or a mass of bacteria (e.g., in milligrams, grams, or kilograms), or a volume of bacteria (e.g., in $mm^3$).

As used herein, the term "viability" refers to the autotrophic bacteria's, e.g., ammonia oxidizing bacteria's, ability to oxidize ammonia, ammonium, or urea to nitrite at a pre-determined rate. In some embodiments, the rate refers to the conversion of ammonium ions ($NH_4^+$) (e.g., at about 200 mM) to nitrite ($NO_2^-$) at a rate of at least 50, 75, 125, or 150 micromoles $NO_2^-$ per minute, e.g., about 100-150, 75-175, 75-125, 100-125, 125-150, or 125-175 micromoles/minute, e.g., about 125 micromoles $NO_2^-$ per minute.

"Growth media" or "AOB media," as referred to herein comprises the following components of Table 2 or Table 3:

TABLE 2

|  | Weight/Volume (in ~1.5 L) | Final Concentration (in ~1.5 L) |
|---|---|---|
| $(NH_4)_2SO_4$ (MW 132.14) | 4.95 g | 50 mM $NH_4^+$ |
| $KH_2PO_4$ (MW 136.1) | 0.616 g | 3.0 mM |
| 1M $MgSO_4$ | 1.137 ml | 0.76 mM |
| 1M $CaCl_2$ | 0.3 ml | 0.2 mM |
| 30 mM $FeCl_3$/50 mM EDTA | 0.5 ml | 10 μM/16.7 μM |
| 50 mM $CuSO_4$ | 30 μl | 1.0 μM |
| Add 1400 ml $ddH_2O$ to flask. Autoclave. Store at room temperature. After autoclaving add: | | |
| Phosphate Buffer | 100 ml | 32 mM $KH_2PO_4$/ 2.7 mM $NaH_2PO_4 \cdot H_2O$ |
| 5% $Na_2CO_3$ | 12 ml | 0.04% |

TABLE 3

|  | Batch medium Weight/Volume (1 L) (Final concentration) | Feeding solution Weight/Volume (1 L) (Final concentration) |
|---|---|---|
| $(NH_4)_2SO_4$ (MW 132.14) | 3.3 g (50 mM $NH_4^+$) | 13.2 g (200 mM $NH_4^+$) |
| $KH_2PO_4$ (MW 136.1) | 1.23 g (9.0 mM) | 0.41 g (3.0 mM) |
| 1M $MgSO_4$ | 0.758 ml (0.76 mM) | 0.758 ml (0.76 mM) |
| 1M $CaCl_2$ | 0.2 ml (0.2 mM) | 0.2 ml (0.2 mM) |

TABLE 3-continued

| | Batch medium Weight/Volume (1 L) (Final concentration) | Feeding solution Weight/Volume (1 L) (Final concentration) |
|---|---|---|
| 30 mM FeCl$_3$/ 50 mM EDTA | 0.333 ml (10 μM/16.7 μM) | 0.333 ml (10 μM/16.7 μM) |
| 50 mM CuSO$_4$ | 20 μl (1.0 μM) | 20 μl (1.0 μM) |
| ddH$_2$O | 1000 ml | 1000 ml |

Autoclave each solution and store at room temperature.

In some embodiments, the states most relevant to the present disclosure are the state of growth, e.g., maximal growth, characterized by a pH of at least about 7.6, ammonia, trace minerals, oxygen and carbon dioxide. Another state may be characterized by a pH of about 7.4 or less and characterized by an absence of carbon dioxide. Under low carbon dioxide conditions, ammonia oxidizing bacteria, e.g., *N. eutropha*, continues to oxidize ammonia into nitrite and generates ATP, but lacking carbon dioxide, e.g., lacking sufficient carbon dioxide, to fix and generate protein, it instead generates polyphosphate, which it uses as an energy storage medium. This may allow the ammonia oxidizing bacteria to remain in a "storage state" for a period of time, e.g., a pre-determined period of time, for example, at least 1, 2, 3, 4, 5, 6, 7, days, 1, 2, 3, 4 weeks, 1, 2, 3, 4, 5, 6, 7, 8, 9, 10, 11, 12 months, 1, 2, 3, 4, or 5 years. In some embodiments, the ammonia oxidizing bacteria may remain in a storage state for at least about 6 months to about 1 year.

As used herein, "growth state" refers to autotrophic bacteria, e.g., ammonia oxidizing bacteria, in a state or in an environment, e.g., a media, e.g., a culture media, e.g., a growth media, that may have a pH of at least about 7.6. Levels of at least one of ammonia, ammonium ions, and urea may be between about 1 micromolar and 1000 millimolar. Levels of trace materials are between about 0.01 micromolar iron and 200 micromolar iron. Levels of oxygen are between about 5% and 100% oxygen saturation (e.g., of media). Levels of carbon dioxide are between about 20 ppm and 10% saturation (e.g., of media). In certain aspects, levels of at least one of ammonia, ammonium ions, and urea may be between about 10 micromolar and 100 millimolar. Levels of trace materials are between about 0.1 micromolar iron and 20 micromolar iron. Levels of oxygen are between about 5% and 100% oxygen saturation. Levels of carbon dioxide are between about 200 ppm and 5% saturation (e.g., of media).

As used herein, "polyphosphate loading state" refers to autotrophic bacteria, e.g., ammonia oxidizing bacteria, in a state or in an environment, e.g., a media, e.g., a culture media, e.g., a growth media, that may have a pH of about 7.4, or less. Levels of at least one of ammonia, ammonium ions, and urea are between about 1 micromolar and 2000 millimolar. Levels of trace materials are between 0.01 micromolar iron and 200 micromolar iron. Levels of oxygen are between about 0% and 100% O2 saturation (e.g., of media). Levels of carbon dioxide are between/less than about zero and 400 ppm, and phosphate levels greater than about 1 micromolar. In certain aspects, levels of at least one of ammonia, ammonium ions, and urea are between about 10 micromolar and 200 millimolar. Levels of trace materials are between 0.1 micromolar iron and 20 micromolar iron. Levels of oxygen are between about 5% and 100% O2 saturation (e.g., of media). Levels of carbon dioxide are between/less than about zero and 200 ppm, and phosphate levels greater than about 10 micromolar.

The polyphosphate loading state may be induced for a period of time, e.g., a pre-determined period of time. The pre-determined period of time may the time period that allows sufficient polyphosphate accumulation in the ammonia oxidizing bacteria. This pre-determined period of time is the period of time suitable to provide for sufficient polyphosphate loading to allow for the ammonia oxidizing bacteria to be stored for an extended period of time. The pre-determined period of time may be at least partially based on a period of time of about 0.2-10 times, 0.3-5 times, 0.5-3 times, 0.5-1.5 times, or 0.5 to 1 times the doubling time for the ammonia oxidizing bacteria. The pre-determined period of time may be at least partially based on a period of time of about one doubling time for the ammonia oxidizing bacteria. In some embodiments, the pre-determined period of time is between about 8 hours and 12 hours. In some embodiments, the pre-determined period of time is about 10 hours. In some embodiments, the pre-determined period of time is about 24 hours.

A purpose of the polyphosphate loading state may be to provide AOB with sufficient ammonia, ammonium ions, and/or urea, and O$_2$ such that ATP can be produced, but to deny them CO$_2$ and carbonate such that they are unable to use that ATP to fix CO$_2$ and instead use that ATP to generate polyphosphate which may be stored by the bacteria.

As used herein, the term "storage state" refers to autotrophic bacteria, e.g., ammonia oxidizing bacteria, in a state or in an environment, e.g., a media, e.g., a culture media, e.g., a growth media, having a pH of about 7.4 or less (in some embodiments, the pH may be 7.6 or less). Levels of at least one of ammonia, ammonium ions, and urea are between about 1 and 1000 micromolar. Levels of trace materials are between about 0.1 and 100 micromolar. Levels of oxygen are between about 0 and 100% saturation (e.g., of media). Levels of carbon dioxide are between about 0 and 800 ppm. In certain aspects, levels of at least one of ammonia, ammonium ions, and urea are between about 10 and 100 micromolar. Levels of trace materials are between about 1 and 10 micromolar. Levels of oxygen are between about 0 and 100% saturation (e.g., of media). Levels of carbon dioxide are between about 0 and 400 ppm.

AOB are produced according to some embodiments of the present disclosure by generating AOB biomass during a growth state, then exposing the AOB to a polyphosphate loading state and then removing the media and resuspending the AOB in a buffer, e.g., a storage buffer (i.e., the storage state).

The ammonia oxidizing bacteria may remain in a "storage state" for a period of time, e.g., a pre-determined period of time, for example, at least 1, 2, 3, 4, 5, 6, 7, days, 1, 2, 3, 4 weeks, 1, 2, 3, 4, 5, 6, 7, 8, 9, 10, 11, 12 months, 1, 2, 3, 4, or 5 years. In some embodiments, the ammonia oxidizing bacteria may remain in a storage state for at least about 6 months to about 1 year. Upon revival, the viability of the ammonia oxidizing bacteria is at least about 50%, 60%, 70%, 80%, 90%, or 100% of the viability as of the ammonia oxidizing bacteria prior to storage e.g., in a growth state). In some embodiments, the preparation of ammonia oxidizing bacteria may be prepared, such that no more than 10%, 20%, 30%, 40%, 50%, 60%, or 70% of the ability to oxidize NH$_4^+$ is lost upon storage at selected conditions.

The time that it takes to revive the ammonia oxidizing bacteria from a storage state (or a polyphosphate loading state) may be a pre-determined period of time. For example, the pre-determined period of time may be less than about 75 hours, or less than about 72 hours. The pre-determined period of time may at least partially based on a period time of about 0.2-10 times, 0.3-5 times, 0.5-3 times, 0.5-1.5 times, or 0.5 to 1 times the doubling time for the ammonia oxidizing bacteria. The pre-determined period of time may be at least partially based on a period of time of about one doubling time for the ammonia oxidizing bacteria. The pre-determined period of time may be between about 8 hours and 12 hours. The pre-determined period of time may be about 10 hours. The pre-determined time may be less than about 75 hours, 72 hours, 70 hours, 68 hours, 65 hours, 60 hours, 55 hours, 50 hours, 45 hours, 40 hours, 35 hours, 30 hours, 25 hours, 20 hours, 15 hours, 10 hours, 5 hours, 4 hours, 3, hours, 2 hours, or 1 hour. The pre-determined period of time may be between about 5 minutes and 5 hours. The pre-determined period of time may be about 5-10 minutes, 10-15 minutes, 15-20 minutes, 20-25 minutes, 25-30 minutes, 30-45 minutes, 45-60 minutes, 60 minutes-1.5 hours, 1.5 hours-2 hours, 2 hours-2.5 hours, 2.5 hours-3 hours, 3 hours-3.5 hours, 3.5 hours-4 hours, 4 hours-4.5 hours, 4.5 hours-5 hours. In some embodiments, the pre-determined period of time may be about 2 hours. The pre-determined period of time, e.g., may be the time it may take to achieve revival of the ammonia oxidizing bacteria, e.g., achieve viability of the ammonia oxidizing bacteria as compared to the viability of the bacteria prior to storage (e.g., in a growth state), e.g., at least about 10%, 20%, 30%, 40%, 50%, 60%, 70%, 80%, 90%, 95%, 97%, 98%, 99%, or 100% viability.

"Activation," as used herein, is used relative to autotrophic bacteria, e.g., ammonia oxidizing bacteria. Activation refers to any action that may place the ammonia oxidizing bacteria in a potentially more active state, e.g., a growth state. Activation may relate to stimulation of autotrophic bacteria, e.g., ammonia oxidizing bacteria, to assist in some way in the conversion of at least one of ammonia, ammonium ions, and urea into nitrite, nitric oxide, or nitric oxide precursors. Activation may relate to helping establish a bacterial colony, e.g., to allow for the autotrophic bacteria, e.g., ammonia oxidizing bacteria, to compete with other existing bacteria. Activation may relate to providing an environment that may favor sustainability and/or growth of autotrophic bacteria, e.g., ammonia oxidizing bacteria. Activation may relate to accelerating availability of the autotrophic bacteria, e.g., ammonia oxidizing bacteria to an environment or a surface. "Activation" may provide for ammonia oxidizing bacteria to be in an "activated" or "growth state." "Activation" may take place with the use of an activator. The ammonia oxidizing bacteria may come into contact with the activator to provide an ammonia oxidizing bacteria in an "activated" or "growth" state. This may occur within or outside of a container, delivery device, or delivery system, e.g., within a first chamber, a second chamber, a mixing chamber, a third or additional chamber, or combinations thereof. The activator may be at least one of ammonia, ammonium ions, or urea. The activator may be an ammonium salt, e.g., ammonium chloride or ammonium sulfate. The concentration of the activator, e.g., ammonium salt, e.g., ammonium chloride or ammonium sulfate may be in a range of about 10 micromolar to about 100 millimolar. In certain aspects the concentration of the activator, e.g., ammonium salt, e.g., ammonium chloride or ammonium sulfate may be in a range of about 0.5 mM to about 50 mM. The activator may be in a solution, suspension, a powder, e.g., crystalline form, a media, a buffer, or disposed in or provide as a suitable carrier for maintaining the activator. The ammonia oxidizing bacteria may be in any suitable form for maintaining the AOB in a desired state, e.g., a storage state, e.g., an aqueous suspension, gel, or powder form. The at least one of ammonia, ammonium ions, or urea may be in a medium or a buffer to promote growth of ammonia oxidizing bacteria, e.g., an AOB media or a growth media. A time-release, or controlled release urea may be used as an activator.

"Actuation," as used herein, means that some action is being taken, e.g., a process is being started or something is being put into motion. In some embodiments, actuation may refer to the breaking of a barrier of a container, or the initiation of movement of one or more contents of a container, e.g., delivery of one or more contents of the container to outside of the container, e.g., to a surface or an environment.

A "barrier," as used herein, may mean any structure or configuration that may serve to obstruct passage or to maintain separation, e.g., between a first chamber and a second chamber of a container. The barrier may be in the form of a valve, e.g., a check valve, filtering material, film, wax, lipid, polymer, or controlled release material, e.g., slow release material. The barrier may be a material that upon actuation of a container, it may allow passage of contents from a first chamber into a second chamber, passage of contents from a second chamber into a first chamber, or both. The barrier may be disrupted upon actuation, e.g., through piercing, puncturing, stabbing, perforating, penetrating, splitting, opening or tearing the barrier. The barrier may be in a form of a valve, e.g., a check valve, a flexible or inflexible material that may not degrade upon contact with one or more contents of the container, or a flexible or inflexible material that may degrade upon contact with one or more contents of the container, a filter material. The barrier may be made of any material suitable for its purpose, e.g., a material that may serve to obstruct passage or to maintain separation, e.g., a polymeric material or metal material.

"Microbiome" refers to a population, e.g, one or more microorganisms that live on a surface of a subject, e.g., in the gut, mouth, skin, and/or elsewhere in a subject. The population may have one or more beneficial functions and/or benefits, relevant to supporting the life of a subject.

"Biome-friendly" refers to something, e.g, a product, e.g., a cosmetic product, e.g., a finished cosmetic product that may allow for minimal disruption of a microbiome of a subject. For example, biome-friendly refers to a product that may be applied to a subject that may allow the microbiome at the point of application to be maintained, minimally disrupted, and/or able to return to the microbiome after a period of time after application of the product. In embodiments, biome-friendly may refer to ammonia oxidizing bacteria-friendly, in that the product may allow for minimal disruption of the ammonia oxidizing bacteria of a subject.

In embodiments, "biome-friendly" may be referred to as "biome-compatible."

A "natural product" is or may comprise a product that may be at least partially derived from nature. It may be anything or comprise anything produced by a living organism, and may include organisms themselves. Natural products may include or comprise an entire organism, and part of an organism (e.g., a leaf of a plant), an extract from an organism, an organic compound from an organism, a purified organic compound from an organism. Natural products may be or comprise organic substances found and cells, including primary metabolites (amino acids, carbohydrates, and nucleic acids) and secondary metabolites (organic compounds found in a limited range of species, e.g., polyketides, fatty acids, terpenoids, steroids, phenylpropanoids, alkaloids, specialized amino acids and peptides, specialized carbohydrates). Natural products may be or comprise polymeric organic materials such as cellulose, lignin, and proteins.

Natural products may be or comprise products for commercial purposes, and may refer to cosmetics, dietary supplements, and foods produced from natural sources. Natural products may have pharmacological or biological activity that may be of therapeutic benefit, e.g., in treating disease or conditions. Natural products may be included in traditional medicines, treatments for cosmetological purposes, and spa treatments. A natural product referred to herein may comprise any one or more of the components described as a natural product to be incorporated into a preparation or formulation comprising one or more other components, e.g., excipients. The preparation or formulation referred to as a natural product may comprise a natural product defined herein and one or more additional components or ingredients. Any of the compositions, preparations, or formulations discussed throughout this disclosure may be or comprise one or more natural products.

In some embodiments, the natural product or the fortified natural product may comprise at least one of mud, water, food-derived products, plant-derived products, extracts, and oils. The natural product or the fortified natural product may be used in a spa treatment.

In some embodiments, the natural product or the fortified natural product may be incorporated into at least one of a powder, cream, lotion, wrap, scrub, eye mask, facial mask, body mask, aerosol, e.g., mist, spray, salve, wipe, stick, bandage, or soak.

In some embodiments, the natural product or fortified natural product may be provided as, or may be disposed in at least one of a baby product, e.g., a baby shampoo, a baby lotion, a baby oil, a baby powder, a baby cream; a bath preparation, e.g., a bath oil, a tablet, a salt, a bubble bath, a bath capsule; an eye makeup preparation, e.g., an eyebrow pencil, an eyeliner, an eye shadow, an eye lotion, an eye makeup remover, a mascara; a fragrance preparation, e.g., a colognes, a toilet water, a perfume, a powder (dusting and talcum), a sachet; hair preparations, e.g., hair conditioners, hair sprays, hair straighteners, permanent waves, rinses, shampoos, tonics, dressings, hair grooming aids, wave sets; hair coloring preparations, e.g., hair dyes and colors, hair tints, coloring hair rinses, coloring hair shampoos, hair lighteners with color, hair bleaches; makeup preparations, e.g., face powders, foundations, leg and body paints, lipstick, makeup bases, rouges, makeup fixatives; manicuring preparations, e.g., basecoats and undercoats, cuticle softeners, nail creams and lotions, nail extenders, nail polish and enamel, nail polish and enamel removers; oral hygiene products, e.g., dentrifices, mouthwashes and breath fresheners; bath soaps and detergents, deodorants, douches, feminine hygiene deodorants; shaving preparations, e.g., aftershave lotions, beard softeners, talcum, preshave lotions, shaving cream, shaving soap; skin care preparations, e.g., cleansing, depilatories, face and neck, body and hand, foot powders and sprays, moisturizing, night preparations, paste masks, skin fresheners; and suntan preparations, e.g., gels, creams, and liquids, and indoor tanning preparations.

As used herein, "presence" or "level" may refer to a qualitative or quantitative amount of a component, e.g., any one or more of an ammonia oxidizing bacteria, ammonia, ammonium ions, urea, nitrite, or nitric oxide. The presence or level may include a zero value or a lack of presence of a component.

As used herein, the term "surfactant", includes compounds that may lower the surface tension, or interfacial tension, between two liquids or between a liquid and a solid. Surfactants may act as detergents, wetting agents, emulsifiers, foaming agents, and dispersants. Surfactants may include one or more of the following, alone, or in combination with those listed, or other surfactants or surfactant-like compounds: cocamidopropyl betaine (ColaTeric COAB), polyethylene sorbitol ester (e.g., Tween 80), ethoxylated lauryl alcohol (RhodaSurf 6 NAT), sodium laureth sulfate/lauryl glucoside/cocamidopropyl betaine (Plantapon 611 L UP), sodium laureth sulfate (e.g., Rhoda-Pex ESB 70 NAT), alkyl polyglucoside (e.g., Plantaren 2000 N UP), sodium laureth sulfate (Plantaren 200), Dr. Bronner's Castile soap, Dr. Bronner's baby soap, Lauramine oxide (ColaLux Lo), sodium dodecyl sulfate (SDS), polysulfonate alkyl polyglucoside (PolySufanate 160 P), sodium lauryl sulfate (Stepanol-WA Extra K). and combinations thereof. Dr. Bronner's Castile soap and baby soap comprises water, organic coconut oil, potassium hydroxide, organic olive oil, organic fair deal hemp oil, organic jojoba oil, citric acid, and tocopherol.

Surfactants may include Sodium Laurylglucosides Hydroxypropylsulfonate (Suga®nate 160NC), lauramidopropyl betaine (Cola®Teric LMB); Cocamidopropyl hydroxysultaine (Cola®Teric CBS); disodium cocoamphodiacetate (Cola®Teric CDCX-LV); sodium laurylglucosides hydroxypropyl phosphate (Suga®Fax D12).

Surfactants may include sodium lauroyl methyl isethionate (Iselux® LQ-CLR-SB); sodium methyl cocoyl taurate (Pureact WS Conc.); Aqua (and) Sodium Lauroyl Methyl Isethionate (and) Cocamidopropyl Betaine (and) Sodium Cocoyl Isethionate (and) Sodium Methyl Oleoyl Taurate (Iselux®SFS-SB).

Other surfactants are contemplated by this disclosure.

2. Ammonia Oxidizing Bacteria (AOBs), *N. eutropha* Strain D23 and Other Ammonia Oxidizing Bacteria Autotrophic ammonia oxidizing bacteria, which may be referred to herein as AOBs or AOB, are obligate autotrophic bacteria as noted by Alan B. Hooper and A. Krummel at al. Alan B. Hooper, Biochemical Basis of Obligate Autotrophy in *Nitrosomonas europaea*, Journal of Bacteriology, February 1969, p. 776-779. Antje Krummel et al., Effect of Organic Matter on Growth and Cell Yield of Ammonia-Oxidizing Bacteria, Arch Microbiol (1982) 133: 50-54. These bacteria derive all metabolic energy only from the oxidation of ammonia to nitrite with nitric oxide (NO) as an intermediate product in their respiration chain and derive virtually all carbon by fixing carbon dioxide. They are incapable of utilizing carbon sources other than a few simple molecules.

Ammonia oxidizing bacteria (AOB) are widely found in the environment, and in the presence of ammonia, oxygen and trace metals will fix carbon dioxide and proliferate. AOB may be slow growing and toxic levels of ammonia may kill fish and other organisms before AOB can proliferate and reduce ammonia to non-toxic levels. Slow growth of AOB also may delay the health benefits of the NO and nitrite the AOB produce when applied to the skin.

Supplementing the aquarium, skin, or process with sufficient viable AOB grown and stored for that purpose is desired. AOB do not form spores, so storage in the dry state with high viability is difficult, and storage in the wet state leaves them metabolically active.

Decay of nitrifying capacity during storage of AOB for wastewater treatment has been studied, as for example (Munz G, Lubello C, Oleszkiewicz J A. Modeling the decay of ammonium oxidizing bacteria. Water Res. 2011 January; 45(2): 557-64. Oi: 10.1016/j.watres.0.2010.09.022.)

Growth, prolonged storage, and restoration of activity of *Nitrosomonas* is discussed by Cassidy et al. (U.S. Pat. No. 5,314,542) where they disclose growing *Nitrosomonas*, removing toxic waste products, storing in sterile water of appropriate salinity for periods of time up to one year, and then reviving by adding buffer ($CaCO_3$) and 200 ppm, of ammonium, which reviving takes 72 hours.

As obligate autotrophs, AOB synthesize protein via the fixing of $CO_2$ using the energy and reducing equivalents generated by the oxidation of ammonia to nitrite. Growth requires ammonia, oxygen, minerals and carbon dioxide.

*Nitrosomonas* may exist in several metabolic states, according to "Polyphosphate and Orthophosphate Content of *Nitrosomonas europaea* as a Function of Growth" by K. R. Terry and A. B. Hooper, Journal of Bacteriology, July 1970, p. 199-206, Vol. 103, No. I.

The AOBs contemplated in this disclosure may comprise mutations relative to wild-type AOBs. These mutations may, e.g., occur spontaneously, be introduced by random mutagenesis, or be introduced by targeted mutagenesis. For instance, the AOBs may lack one or more genes or regulatory DNA sequences that wild-type AOBs typically comprise. The AOBs may also comprise point mutations, substitutions, insertions, deletions, and/or rearrangements relative to the sequenced strain or a wild-type strain. The AOBs may be a purified preparation of optimized AOBs.

In certain embodiments, the AOBs are transgenic. For instance, it may comprise one or more genes or regulatory DNA sequences that wild-type ammonia oxidizing bacteria lacks. More particularly, the ammonia oxidizing bacteria may comprise, for instance, a reporter gene, a selective marker, a gene encoding an enzyme, or a promoter (including an inducible or repressible promoter). In some embodiments the additional gene or regulatory DNA sequence is integrated into the bacterial chromosome; in some embodiments the additional gene or regulatory DNA sequence is situated on a plasmid.

In some embodiments, the AOBs differ by at least one nucleotide from naturally occurring bacteria. For instance, the AOBs may differ from naturally occurring bacteria in a gene or protein that is part of a relevant pathway, e.g., an ammonia metabolism pathway, a urea metabolism pathway, or a pathway for producing nitric oxide or nitric oxide precursors. More particularly, the AOBs may comprise a mutation that elevates activity of the pathway, e.g., by increasing levels or activity of an element of that pathway.

The above-mentioned mutations can be introduced using any suitable technique. Numerous methods are known for introducing mutations into a given position. For instance, one could use site-directed mutagenesis, oligonucleotide-directed mutagenesis, or site-specific mutagenesis. Non-limiting examples of specific mutagenesis protocols are described in, e.g., Mutagenesis, pp. 13.1-13.105 (Sambrook and Russell, eds., Molecular Cloning A Laboratory Manual, Vol. 3, 3.sup.rd ed. 2001). In addition, non-limiting examples of well-characterized mutagenesis protocols available from commercial vendors include, without limitation, Altered Sites® II in vitro Mutagenesis Systems (Promega Corp., Madison, Wis.); Erase-a-Base® System (Promega, Madison, Wis.); GeneTailor™ Site-Directed Mutagenesis System (Invitrogen, Inc., Carlsbad, Calif.); QuikChange® II Site-Directed Mutagenesis Kits (Stratagene, La Jolla, Calif.); and Transformer™ Site-Directed Mutagenesis Kit (BD-Clontech, Mountain View, Calif.).

In certain embodiments of the disclosure, the ammonia oxidizing bacteria may be axenic. The preparation (formulation or composition) of ammonia oxidizing bacteria may comprise, consist essentially of, or consist of axenic ammonia oxidizing bacteria.

The ammonia oxidizing bacteria of this disclosure may be from a genus selected from the group consisting of *Nitrosomonas, Nitrosococcus, Nitrosospria, Nitrosocystis, Nitrosolobus, Nitrosovibrio*, and combinations thereof.

This disclosure provides, inter alia, *N. eutropha* strain D23, a unique, e.g., optimized strain of ammonia oxidizing bacteria that can increase production of nitric oxide and nitric oxide precursors on the surface of a subject, e.g., a human subject. This disclosure also provides methods of using the bacteria and articles comprising the bacteria.

In embodiments, the ammonia oxidizing bacteria, e.g., *N. eutropha* is non-naturally occurring. For instance, it may have accumulated desirable mutations during a period of selection. In other embodiments, desirable mutations may be introduced by an experimenter. In some embodiments, the *N. eutropha* may be a purified preparation, and may be an optimized *N. eutropha*.

In preferred embodiments, the *N. eutropha* strain is autotrophic and so incapable of causing infection. A preferred strain utilizes urea as well as ammonia, so that hydrolysis of the urea in sweat would not be necessary prior to absorption and utilization by the bacteria. Also, in order to grow at low pH, the bacteria may either absorb $NH_4^+$ ions or urea. The selected strain should also be capable of living on the external skin of a subject, e.g., a human, and be tolerant of conditions there.

Although this disclosure refers to *N. eutropha* strain D23 in detail, the preparations, methods, compositions, treatments, wearable articles, and articles of clothing may be used with one or more of: one or more other strains of *N. eutropha*, one or more other species of *Nitrosomonas*, and one or more other ammonia oxidizing bacteria.

In certain embodiments, the *N. eutropha* is the strain deposited with the American Tissue Culture Collection (ATCC) on Apr. 8, 2014, designated AOB D23-100 (25 vials) under accession number PTA-121157. D23 *Nitrosomonas eutropha* strain refers to the strain, designated AOB D23-100, deposited with the American Tissue Culture Collection (ATCC) (10801 University Blvd., Manassas, Va., USA) on Apr. 8, 2014 having accession number PTA-121157. The nucleic acid sequence(s), e.g., genome sequence, of accession number PTA-121157 are hereby incorporated by reference in their entireties. In certain embodiments, the *N. eutropha* is a strain described in PCT Application No. PCT/US2015/025909, filed Apr. 15, 2015, herein incorporated by reference in its entirety.

In certain embodiments, a bacterium with the above-mentioned sequence characteristics has one or more of (1) an optimized growth rate as measured by doubling time, (2) an optimized growth rate as measured by OD600, (3) an optimized $NH_4^+$ oxidation rate, (4) an optimized resistance to $NH_4^+$, and (4) an optimized resistance to $NO_2^-$. Particular sub-combinations of these properties are specified in the following paragraph.

In some embodiments, the ammonia oxidizing bacteria, e.g., the *N. eutropha* described herein has one or more of: (1) an optimized growth rate as measured by doubling time, (2) an optimized growth rate as measured by OD600, (3) an optimized $NH_4^+$ oxidation rate, (4) an optimized resistance to, $NH_4^+$, and (4) an optimized resistance to, $NO_2^-$. For instance, the bacterium may have properties (1) and (2); (2) and (3); (3) and (4); or (4) and (5) from the list at the beginning of this paragraph. As another example, the bacterium may have properties (1), (2), and (3); (1), (2), and (4); (1), (2), and (5); (1), (3), and (4); (1), (3), and (5); (1), (4), and (5); (2), (3), and (4); (2), (3), and (5), or (3), (4), and (5) from the list at the beginning of this paragraph. As a further example, the bacterium may have properties (1), (2), (3), and (4); (1), (2), (3), and (5); (1), (2), (4), and (5); (1), (3), (4), and (5); or (2), (3), (4), and (5) from the list at the beginning of this paragraph. In some embodiments, the bacterium has properties (1), (2), (3), (4), and (5) from the list at the beginning of this paragraph.

This disclosure also provides an axenic composition of ammonia oxidizing bacteria, e.g., *N. eutropha* having one or more of: (1) an optimized growth rate as measured by doubling time, (2) an optimized growth rate as measured by OD600, (3) an optimized $NH_4^+$ oxidation rate, (4) an optimized resistance to, $NH_4^+$, and (4) an optimized resistance to, $NO_2^-$. For instance, the bacterium composition may have properties (1) and (2); (2) and (3); (3) and (4); or (4) and (5) from the list at the beginning of this paragraph. As another example, the bacterium composition may have properties (1), (2), and (3); (1), (2), and (4); (1), (2), and (5); (1), (3), and (4); (1), (3), and (5); (1), (4), and (5); (2), (3), and (4); (2), (3), and (5), or (3), (4), and (5) from the list at the beginning of this paragraph. As a further example, the bacterium composition may have properties (1), (2), (3), and (4); (1), (2), (3), and (5); (1), (2), (4), and (5); (1), (3), (4), and (5); or (2), (3), (4), and (5) from the list at the beginning of this paragraph. In some embodiments, the bacterium composition has properties (1), (2), (3), (4), and (5) from the list at the beginning of this paragraph.

*N. eutropha* strain D23, as deposited in the form of 25 vials on Apr. 8, 2014, in the ATCC patent depository, designated AOB D23-100, under accession number PTA-121157, comprises a circular genome having SEQ ID NO: 1 or its complement. Accordingly, in some embodiments, an *N. eutropha* strain described herein comprises a nucleic acid sequence, e.g., a genome, that is similar to SEQ ID NO: 1, or its complement, of PCT Application No. PCT/US2015/025909, filed Apr. 15, 2015.

In certain embodiments, the *N. eutropha* strain comprises a nucleic acid sequence, e.g., a genome, that hybridizes to SEQ ID NO: 1, of PCT Application No. PCT/US2015/025909, filed Apr. 15, 2015, or to the genome of the D23 strain deposited in the form of 25 vials with the ATCC patent depository on Apr. 8, 2014, designated AOB D23-100, under accession number PTA-121157, or their complements, under low stringency, medium stringency, high stringency, or very high stringency, or other hybridization condition described herein.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; 4) very high stringency hybridization conditions are 0.5M sodium phosphate, 7% SDS at 65° C., followed by one or more washes at 0.2×SSC, 1% SDS at 65° C. Very high stringency conditions (4) are suitable conditions and the ones that should be used unless otherwise specified.

The D23 strain is not believed to be a product of nature, but rather has acquired certain mutations and characteristics during an extended period of culture and selection in the laboratory. For instance, D23 has an ability to grow in conditions of greater than about 200 or 250 mM $NH_4^+$ for more than 24 hours.

In some embodiments, the *N. eutropha* disclosed herein differ from naturally occurring bacteria in the abundance of siderophores. For instance, the *N. eutropha* may have elevated or reduced levels of siderophores compared to *N. eutropha* C91. Generally, siderophores are secreted iron-chelating compounds that help bacteria scavenge iron from their environment. Some siderophores are peptides, and others are small organic molecules.

The AOBs, for example, *N. eutropha* contemplated in this disclosure may comprise mutations relative to wild-type *N. eutropha* and/or the *N. eutropha* sequences disclosed herein. These mutations may, e.g., occur spontaneously, be introduced by random mutagenesis, or be introduced by targeted mutagenesis. For instance, the ammonia oxidizing bacteria, e.g., *N. eutropha* may lack one or more genes or regulatory DNA sequences that wild-type *N. eutropha* typically comprises. The ammonia oxidizing bacteria, e.g., *N. eutropha* may also comprise point mutations, substitutions, insertions, deletions, and/or rearrangements relative to the sequenced strain or a wild-type strain. The ammonia oxidizing bacteria, e.g., *N. eutropha* may be a purified preparation of optimized ammonia oxidizing bacteria, e.g., *N. eutropha*.

In certain embodiments, the ammonia oxidizing bacteria, e.g., *N. eutropha* is transgenic. For instance, it may comprise one or more genes or regulatory DNA sequences that wild-type *N. eutropha* D23 lacks. More particularly, the ammonia oxidizing bacteria, e.g., *N. eutropha* may comprise, for instance, a reporter gene, a selective marker, a gene encoding an enzyme, or a promoter (including an inducible or repressible promoter). In some embodiments the additional gene or regulatory DNA sequence is integrated into the bacterial chromosome; in some embodiments the additional gene or regulatory DNA sequence is situated on a plasmid, for instance a plasmid related to a plasmid found in *N. eutropha* N91.

In some preferred embodiments, the ammonia oxidizing bacteria, e.g., *N. eutropha* differs by at least one nucleotide from naturally occurring bacteria. For instance, the ammonia oxidizing bacteria, e.g., *N. eutropha* may differ from naturally occurring bacteria in a gene or protein that is part of a relevant pathway, e.g., an ammonia metabolism pathway, a urea metabolism pathway, or a pathway for producing nitric oxide or nitric oxide precursors. More particularly, the ammonia oxidizing bacteria, e.g., *N. eutropha* may comprise a mutation that elevates activity of the pathway, e.g., by increasing levels or activity of an element of that pathway.

The above-mentioned mutations can be introduced using any suitable technique. Numerous methods are known for introducing mutations into a given position. For instance, one could use site-directed mutagenesis, oligonucleotide-directed mutagenesis, or site-specific mutagenesis. Non-limiting examples of specific mutagenesis protocols are described in, e.g., Mutagenesis, pp. 13.1-13.105 (Sambrook and Russell, eds., Molecular Cloning A Laboratory Manual, Vol. 3, 3.sup.rd ed. 2001). In addition, non-limiting examples of well-characterized mutagenesis protocols available from commercial vendors include, without limitation, Altered Sites® II in vitro Mutagenesis Systems (Promega Corp., Madison, Wis.); Erase-a-Base® System (Promega, Madison, Wis.); GeneTailor™ Site-Directed Mutagenesis System (Invitrogen, Inc., Carlsbad, Calif.); QuikChange® II Site-Directed Mutagenesis Kits (Stratagene, La Jolla, Calif.); and Transformer™ Site-Directed Mutagenesis Kit (BD-Clontech, Mountain View, Calif.).

In some embodiments, the preparation of ammonia oxidizing bacteria may comprise a concentration or amount of ammonia oxidizing bacteria in order to at least partially treat a condition or disease. The preparation of ammonia oxidizing bacteria may comprise a concentration or amount of ammonia oxidizing bacteria in order to alter, e.g., reduce or increase, an amount, concentration or proportion of a bacterium, or genus of bacteria, on a surface, e.g., a skin surface. The bacteria may be non-pathogenic or pathogenic, or potentially pathogenic.

In some embodiments, the preparation of ammonia oxidizing bacteria may comprise between about $10^8$ to about $10^{14}$ CFU/L. The preparation may comprise at least $10^8$, $10^9$, $10^{10}$, $10^{11}$, $2 \times 10^{11}$, $5 \times 10^{11}$, $10^{12}$, $2 \times 10^{12}$, $5 \times 10^{12}$, $10^{13}$, $2 \times 10^{13}$, $5 \times 10^{13}$, or $10^{14}$; or about $10^8$-$10^9$, $10^9$-$10^{10}$, $10^{10}$-$10^{11}$, $10^{11}$-$10^{12}$, $10^{12}$-$10^{13}$, or $10^{13}$-$10^{14}$ CFU/L.

In certain aspects, the preparation may comprise between about $1 \times 10^9$ CFU/L to about $10 \times 10^9$ CFU/L. In certain aspects, the preparation may comprise between about $1 \times 10^9$ CFU to about $10 \times 10^9$ CFU. In certain aspects, the preparation may comprise about $1 \times 10^9$ CFU/mL to $10 \times 10^9$ CFU/mL. In certain aspects, the preparation may comprise about $1 \times 10^9$ CFU/mL.

In some embodiments, the preparation of ammonia oxidizing bacteria may comprise between about 0.1 milligrams (mg) and about 1000 mg of ammonia oxidizing bacteria. In certain aspects, the preparation may comprise between about 50 mg and about 1000 mg of ammonia oxidizing bacteria. The preparation may comprise between about 0.1-0.5 mg, 0.2-0.7 mg, 0.5-1.0 mg, 0.5-2 mg, 0.5-5 mg, 2.5-5 mg, 2.5-7.0 mg, 5.0-10 mg, 7.5-15 mg, 10-15 mg, 15-20 mg, 15-25 mg, 20-30 mg, 25-50 mg, 25-75 mg, 50-75 mg, 50-100 mg, 75-100 mg, 100-200 mg, 200-300 mg, 300-400 mg, 400-500 mg, 500-600 mg, 600-700 mg, 700-800 mg, 800-900 mg, 900-1000 mg, 100-250 mg, 250-500 mg, 100-500 mg, 500-750 mg, 750-1000 mg, or 500-1000 mg.

In some embodiments, the preparation of ammonia oxidizing bacteria may comprise a mass ratio of ammonia oxidizing bacteria to an excipient, e.g., a pharmaceutically acceptable excipient or a cosmetically acceptable excipient in a range of about 0.1 grams per liter to about 1 gram per liter. The preparation may comprise a mass ratio of ammonia oxidizing bacteria to an excipient in a range of about 0.1-0.2, 0.2-0.3, 0.1-0.5, 0.2-0.7, 0.5-1.0, or 0.7-1.0 grams per liter.

In some embodiments, the preparation of ammonia oxidizing bacteria may comprise an ammonia oxidizing bacteria having a dose as described herein, in combination with ammonia, for example, an ammonia concentration of between about 0.01 mM to about 100 mM. For example, the ammonia concentration may be about 0.01, 0.05, 0.1, 0.2, 0.4, 0.5, 0.6, 0.8, 1.0, 1.2, 1.4, 1.6, 1.8, 2.0, 2.2, 2.4, 2.5, 2.6, 2.8, 3.0, 3.2, 3.4, 3.6, 3.8, 4.0, 4.2, 4.4, 4.5, 4.6, 4.8, 5.0, 5.2, 5.4, 5.6, 5.8, 6.0, 6.2, 6.4, 6.6, 6.8, 7.0, 7.2, 7.4, 7.6, 7.8, 8.0, 8.2, 8.4, 8.6, 8.8, 10.0, 15.0, 20.0, 25.0, 30.0, 35.0, 40.0, 45.0, 50.0, 55.0, 60.0, 65.0, 70.0, 75.0, 80.0, 85.0, 90.0, 95.0, 100.0 mM. In some embodiments, the preparation of ammonia oxidizing bacteria may comprise, consist essentially of, or consist of ammonia oxidizing bacteria in an aqueous buffer solution comprising, consisting essentially of, or consisting of disodium phosphate and magnesium chloride, for example, 50 mM $Na_2HPO_4$ and 2 mM $MgCl_2$. In certain aspects, the preparation may comprise about $1 \times 10^9$ CFU/mL, 50 mM $Na_2HPO_4$, and 2 mM $MgCl_2$, in water.

In some embodiments, the preparation of ammonia oxidizing bacteria may comprise components that provide for pre-activation of the ammonia oxidizing bacteria. For example, pre-activation may involve having a preparation having ammonia oxidizing bacteria and ammonia.

In some embodiments, the preparation of ammonia oxidizing bacteria may be in a form that provides for activation upon delivery to a subject, e.g., coactivation. This would provide for delivery of ammonia oxidizing bacteria to an utilizing ammonia present on the subject prior to or simultaneously with delivery of the ammonia oxidizing bacteria. For example, the ammonia may be derived from the subject's own source of ammonia, or be applied, prior to or at the same time as the ammonia oxidizing bacteria. The ammonia may be provided in a separate container, or may be naturally derived from the subject.

The preparation may comprise a volume of between about 0.1 and about 100 fluid ounces, about 0.2 and about 50 fluid ounces, about 0.5 and about 25 fluid ounces, about 1.0 and about 10 fluid ounces, about 2.0 and about 7 fluid ounces, about 3 and about 5 fluid ounces. In some embodiments, the preparation may comprise a volume of about 3.4 fluid ounces.

The preparation may be provided in a container constructed to contain between about 0.1 and about 100 fluid ounces, about 0.2 and about 50 fluid ounces, about 0.5 and about 25 fluid ounces, about 1.0 and about 10 fluid ounces, about 2.0 and about 7 fluid ounces, about 3 and about 5 fluid ounces. In some embodiments, the preparation is a container constructed to contain about 3.4 fluid ounces. The container may be a one-chamber container, or any other container disclosed herein.

In some embodiments, the preparation of ammonia oxidizing bacteria may be in a growth state. A growth state may be provided by exposing ammonia oxidizing bacteria to an environment that may promote growth. The growth state may be a state, e.g., ammonia oxidizing bacteria in an environment that allows immediate availability of ammonia oxidizing bacteria to convert ammonium ions ($NH_4^+$) to nitrite ($NO_2^-$). The growth state may comprise providing ammonia oxidizing bacteria in an environment having a pH of greater than about 7.6. The growth state may also comprise providing ammonia oxidizing bacteria in an environment having ammonia, ammonium salts, and/or urea, trace minerals and sufficient oxygen and carbon dioxide, as described above in Section 1.

In some embodiments, the preparation of ammonia oxidizing bacteria may be in a polyphosphate loading state, wherein the state or the environment, e.g., a media, e.g., a culture media, e.g., a growth media, may have a pH of less than about 7.4. Levels of at least one of ammonia, ammonium ions, and urea may be between about 10 micromolar and 200 millimolar. Levels of trace materials may be between 0.1 micromolar iron and 20 micromolar iron. Levels of oxygen may be between about 5% and 100% oxygen saturation. Levels of carbon dioxide may be between/less than about zero and 200 ppm, and phosphate levels greater than about 10 micromolar. The purpose of the polyphosphate loading state is to provide AOB with ammonia and oxygen such that ATP can be produced, but to deny them carbon dioxide and carbonate such that they are unable to use that ATP to fix carbon dioxide and instead use that ATP to generate polyphosphate which may be stored.

In some embodiments, the preparation of ammonia oxidizing bacteria may be in a storage state. A storage state may be defined as ammonia oxidizing bacteria in an environment in which they may be stored to be later revived. The storage state may be a state, e.g., ammonia oxidizing bacteria in an environment that allows availability of ammonia oxidizing bacteria after being revived, e.g., after being place in an environment promoting a growth state for a pre-determined period of time.

The storage state may comprise providing ammonia oxidizing bacteria in an environment having a pH of less than about 7.4. The storage state may also comprise providing ammonia oxidizing bacteria in an environment having ammonia, ammonia salts, and/or urea, trace minerals, oxygen, and low concentrations of carbon dioxide, as described above in Section 1.

Storage may also be accomplished by storing at 4° C. for up to several months. The storage buffer in some embodiments may comprise 50 mM $Na_2HPO_4$-2 mM $MgCl_2$ (pH 7.6).

In some embodiments, ammonia oxidizing bacteria may be cyropreserved. A 1.25 ml of ammonia oxidizing bacteria mid-log culture may be added to a 2 ml cryotube and 0.75 ml of sterile 80% glycerol. Tubes may be shaken gently, and incubate at room temperature for 15 min to enable uptake of the cryoprotective agents by the cells. The tubes may be directly stored in a −80° C. freezer for freezing and storage.

For resuscitation of cultures, frozen stocks may be thawed on ice for 10-20 minutes, and then centrifuged at 8,000×g for 3 minutes at 4° C. The pellet may be washed by suspending it in 2 ml AOB medium followed by another centrifugation at 8,000×g for 3 minutes at 4° C. to reduce potential toxicity of the cryoprotective agents. The pellet may be resuspended in 2 ml of AOB medium, inoculated into 50 ml of AOB medium containing 50 mM $NH_4^+$, and incubated in dark at 30° C. by shaking at 200 rpm.

In some embodiments, the preparation of ammonia oxidizing bacteria may comprise ammonia oxidizing bacteria in a storage state and/or ammonia oxidizing bacteria in a polyphosphate loading state and/or ammonia oxidizing bacteria in a growth state.

Without wishing to be bound by theory, by maintaining ammonia oxidizing bacteria under conditions or in an environment of low carbon dioxide, with sufficient oxygen and ammonia, they may accumulate polyphosphate for a pre-determined period, e.g., for a period of about one doubling time, e.g., for about 8-12 hours, e.g., for about 10 hours. The ammonia oxidizing bacteria may accumulate sufficient polyphosphate to extend their storage viability, storage time, and accelerate their revival. This may occur with or without the addition of buffer and ammonia.

The presence of sufficient stored polyphosphate may allow the ammonia oxidizing bacteria the ATP resources to maintain metabolic activity even in the absence of ammonia and oxygen, and to survive insults that would otherwise be fatal.

The process of oxidation of ammonia to generate ATP has two steps. The first step is the oxidation of ammonia to hydroxylamine by ammonia monoxoygenase (Amo), followed by the conversion of hydroxylamine to nitrite by hydroxylamine oxidoreductase (Hao). Electrons from the second step (conversion of hydroxylamine to nitrite) are used to power the first step (oxidation of ammonia to hydroxylamine).

If an ammonia oxidizing bacteria does not have hydroxylamine to generate electrons for Amo, then hydroxylamine is not available for Hao. For example, acetylene irreversibly inhibits the enzyme crucial for the first step in the oxidation of ammonia to nitrite, the oxidation of ammonia to hydroxylamine. Once AOB are exposed to acetylene, Amo is irreversibly inhibited and new enzyme must be synthesized before hydroxylamine can be generated. In a normal consortium biofilm habitat, AOB may share and receive hydroxylamine form other AOB (even different strains with different susceptibilities to inhibitors) and so the biofilm tends to be more resistant to inhibitors such as acetylene than an individual organism. AOB can use stored polyphosphate to synthesize new Amo, even in the absence of hydroxylamine.

Any embodiment, preparation, composition, or formulation of ammonia oxidizing bacteria discussed herein may comprise, consist essentially of, or consist of optionally axenic ammonia oxidizing bacteria.

3. Compositions Comprising Ammonia Oxidizing Bacteria; Compositions Comprising *N. eutropha*, e.g., D23 *N. eutropha*

The present disclosure provides, inter alia, compositions comprising ammonia oxidizing bacteria, e.g., a preparation of ammonia oxidizing bacteria, or a purified preparation of ammonia oxidizing bacteria e.g., a natural product, or a fortified natural product.

The compositions disclosed herein throughout this disclosure may be provided to be used in treatment of a skin condition, e.g., acne, e.g., acne vulgaris.

The compositions comprising ammonia oxidizing bacteria, e.g., a preparation of ammonia oxidizing bacteria, or a purified preparation of ammonia oxidizing bacteria may be provided in a cosmetic product or a therapeutic product. The preparation may comprise, inter alia, at least one of ammonia, ammonium salts, and urea. The ammonia oxidizing bacteria may be any ammonia oxidizing bacteria, or combination of ammonia oxidizing bacteria, as disclosed herein.

The present disclosure provides, inter alia, compositions comprising *N. eutropha*, e.g., a purified preparation of an optimized *N. eutropha*. In some embodiments, the *N. eutropha* in the compositions has at least one property selected from an optimized growth rate, an optimized $NH_4^+$ oxidation rate, and an optimized resistance to $NH_4^+$.

In some aspects, the present disclosure provides compositions with a defined number of species. For instance, this disclosure provides a composition having *N. eutropha* and one other type of organism, and no other types of organism. In other examples, the composition has *N. eutropha* and 2, 3, 4, 5, 6, 7, 8, 9, or 10 other types of organism, and no other types of organism. The other type of organism in this composition may be, for instance, a bacterium, such as an ammonia-oxidizing bacterium. Suitable ammonia-oxidizing bacteria for this purpose include those in the genera *Nitrosomonas, Nitrosococcus, Nitrosospira, Nitrosocystis, Nitrosolobus,* or *Nitrosovibrio*.

In some embodiments, the composition comprising ammonia oxidizing bacteria, e.g., *N. eutropha* provides conditions that support ammonia oxidizing bacteria, e.g., *N. eutropha* viability. For instance, the composition may promote ammonia oxidizing bacteria, e.g., *N. eutropha* growth and metabolism or may promote a dormant state (e.g., freezing) from which viable ammonia oxidizing bacteria, e.g., *N. eutropha* can be recovered. When the composition promotes growth or metabolism, it may contain water and/or nutrients that ammonia oxidizing bacteria, e.g., *N. eutropha* consumes, e.g., as ammonium, ammonia, urea, oxygen, carbon dioxide, or trace minerals.

In some embodiments, one or more other organisms besides ammonia oxidizing bacteria may be included in the preparation of ammonia oxidizing bacteria. For example, an organism of the genus selected from the group consisting of *Lactobacillus, Streptococcus, Bifidobacter*, and combinations thereof, may be provided in the preparation of ammonia oxidizing bacteria. In some embodiments, the preparation may be substantially free of other organisms.

Preparations of ammonia oxidizing bacteria may comprise between about between about $10^8$ to about $10^{14}$ CFU/L. The preparation may comprise at least about $10^8$, $10^9$, $10^{10}$, $10^{11}$, $2\times10^{11}$, $5\times10^{11}$, $10^{12}$, $2\times10^{12}$, $5\times10^{12}$, $10^{13}$, $2\times10^{13}$, $5\times10^{13}$, or $10^{14}$; or about $10^8$-$10^9$, $10^9$-$10^{10}$, $10^{10}$-$10^{11}$, $10^{11}$-$10^{12}$, $10^{12}$-$10^{13}$, or $10^{13}$-$10^{14}$ CFU/L. Other preparations may comprise about $2\times10^9$, $4\times10^9$, or $8\times10^9$ CFU/L.

Preparations of ammonia oxidizing bacteria may comprise between about between about $10^8$ to about $10^{14}$ CFU/ml. The preparation may comprise at least about $10^8$, $10^9$, $10^{10}$, $10^{11}$, $2\times10^{11}$, $5\times10^{11}$, $10^{12}$, $2\times10^{12}$, $5\times10^{12}$, $10^{13}$, $2\times10^{13}$, $5\times10^{13}$, or $10^{14}$; or about $10^8$-$10^9$, $10^9$-$10^{10}$, $10^{10}$-$10^{11}$, $10^{11}$-$10^{12}$, $10^{12}$-$10^{13}$, or $10^{13}$-$10^{14}$ CFU/ml. Other preparations may comprise about $2\times10^9$, $4\times10^9$, or $8\times10^9$ CFU/mL.

In some embodiments, the preparation may comprise between about $1\times10^9$ to about $10\times10^9$ CFU/L. In some embodiments, the preparation may comprise about $3\times10^{10}$ CFU, e.g., $3\times10^{10}$ CFU per day. In some embodiments, the preparation may comprise about $1\times10^9$ to about $10\times10^9$ CFU, e.g., about $1\times10^9$ to about $10\times10^9$ CFU per day.

In some embodiments, the preparation of ammonia oxidizing bacteria may comprise between about 0.1 milligrams (mg) and about 1000 mg of ammonia oxidizing bacteria. In certain aspects, the preparation may comprise between about 50 mg and about 1000 mg of ammonia oxidizing bacteria. The preparation may comprise between about 0.1-0.5 mg, 0.2-0.7 mg, 0.5-1.0 mg, 0.5-2 mg, 0.5-5 mg, 2.5-5 mg, 2.5-7.0 mg, 5.0-10 mg, 7.5-15 mg, 10-15 mg, 15-20 mg, 15-25 mg, 20-30 mg, 25-50 mg, 25-75 mg, 50-75 mg, 50-100 mg, 75-100 mg, 100-200 mg, 200-300 mg, 300-400 mg, 400-500 mg, 500-600 mg, 600-700 mg, 700-800 mg, 800-900 mg, 900-1000 mg, 100-250 mg, 250-500 mg, 100-500 mg, 500-750 mg, 750-1000 mg, or 500-1000 mg.

In some embodiments, the preparation of ammonia oxidizing bacteria may comprise a mass ratio of ammonia oxidizing bacteria to an excipient, e.g., a pharmaceutically acceptable excipient or a cosmetically acceptable excipient in a range of about 0.1 grams per liter to about 1 gram per liter. The preparation may comprise a mass ratio of ammonia oxidizing bacteria to an excipient in a range of about 0.1-0.2, 0.2-0.3, 0.1-0.5, 0.2-0.7, 0.5-1.0, or 0.7-1.0 grams per liter.

In some embodiments, the preparation of ammonia oxidizing bacteria may be ammonia oxidizing bacteria in an aqueous buffer solution comprising, consisting essentially of, or consisting of disodium phosphate and magnesium chloride, for example, 50 mM $Na_2HPO_4$ and 2 mM $MgCl_2$. The ammonia oxidizing bacteria may be of any concentration disclosed herein, for example $1\times10^9$ CFU/ml. The preparation may be provided in a buffer at a pre-determined volume of, for example, between about 0.1 and about 100 fluid ounces, about 0.2 and about 50 fluid ounces, about 0.5 and about 25 fluid ounces, about 1.0 and about 10 fluid ounces, about 2.0 and about 7 fluid ounces, about 3 and about 5 fluid ounces. In some embodiments, the preparation may be provided in a container. The preparation may be provided in a container constructed to contain about 3.4 fluid ounces, or any other volume disclosed herein. The preparation may be in a form that may be capable of being aerosolized, sprayed or misted, i.e., in the form of a mist, e.g., in an AO+Mist product.

Advantageously, a formulation may have a pH that promotes AOB, e.g., *N. eutropha* viability, e.g., metabolic activity. Urea would hydrolyze to ammonia and would raise the pH to 7 to 8. AOB are very active at this pH range and would lower the pH to about 6 where the $NH_3$ converts to ammonium and is unavailable. Lower pH levels, e.g. about pH 4, are also acceptable.

The ammonia oxidizing bacteria, e.g., *N. eutropha* may be combined with one or more pharmaceutically or cosmetically acceptable excipients. In some embodiments, "pharmaceutically acceptable excipient" refers to a pharmaceutically-acceptable material, composition, or vehicle, such as a liquid or solid filler, diluent, solvent, or encapsulating material. In some embodiments, each excipient is "pharmaceutically acceptable" in the sense of being compatible with the other ingredients of a pharmaceutical formulation, and suitable for use in contact with the tissue or organ of humans and animals without excessive toxicity, irritation, allergic response, immunogenicity, or other problems or complications, commensurate with a reasonable benefit/risk ratio. See, Remington: The Science and Practice of Pharmacy, 21st ed.; Lippincott Williams & Wilkins: Philadelphia, Pa., 2005; Handbook of Pharmaceutical Excipients, 6th ed.; Rowe et al., Eds.; The Pharmaceutical Press and the American Pharmaceutical Association: 2009; Handbook of Pharmaceutical Additives, 3rd ed.; Ash and Ash Eds.; Gower Publishing Company: 2007; Pharmaceutical Preformulation and Formulation, 2nd ed.; Gibson Ed.; CRC Press LLC: Boca Raton, Fla., 2009.

In some embodiments, a cosmetically acceptable excipient refers to a cosmetically acceptable material, composition, or vehicle, such as a liquid or solid filler, diluent, solvent, or encapsulating material. In some embodiments, each excipient is cosmetically acceptable in the sense of being compatible with the other ingredients of a cosmetic formulation, and suitable for use in contact with the tissue or organ of humans and animals without excessive toxicity, irritation, allergic response, immunogenicity, or other problems or complications, commensurate with a reasonable benefit/risk ratio.

While it is possible for the active ingredient, e.g., ammonia oxidizing bacteria, e.g., *N. eutropha*, to be administered alone, in many embodiments it present in a pharmaceutical formulation or composition. Accordingly, this disclosure provides a pharmaceutical formulation (preparation or composition) or a cosmetic formulation (preparation or composition) comprising ammonia oxidizing bacteria and a pharmaceutically acceptable excipient or a cosmetically acceptable excipient. Pharmaceutical compositions and cosmetic compositions may take the form of a formulation as described below.

The pharmaceutical and cosmetic formulations (e.g., preparations or compositions) described herein may include those suitable for oral (e.g., by way of, or for the purposes of depositing in the gastrointestinal tract), parenteral (including subcutaneous, intradermal, intramuscular, intravenous, and intraarticular), inhalation (including fine particle dusts or mists which may be generated by means of various types of metered doses, pressurized aerosols, nebulizers or insufflators, and including intranasally (nasal) or via the lungs (pulmonary)), rectal and topical (including dermal, transdermal, transmucosal, buccal, sublingual, and intraocular) administration, although the most suitable route may depend upon, for example, the condition and disorder of the recipient.

The formulations (e.g., preparations or compositions) may conveniently be presented in unit dosage form and may be prepared by any of the methods known in the art of pharmacy or cosmetology. Typically, methods include the step of bringing the active ingredient (e.g., ammonia oxidizing bacteria, e.g., *N. eutropha*) into association with a pharmaceutical or a comestic carrier which constitutes one or more accessory ingredients. In general, the formulations are prepared by uniformly and intimately bringing into association the active ingredient with liquid carriers or finely divided solid carriers or both and then, if necessary, shaping the product into the desired formulation.

Formulations may be presented as discrete units such as capsules, cachets or tablets, each containing a predetermined amount of, e.g., *N. eutropha*; as a powder or granules; as a solution or a suspension in an aqueous liquid or a non-aqueous liquid; or as an oil-in-water liquid emulsion or a water-in-oil liquid emulsion. The active ingredient may also be presented as a bolus, electuary or paste. Various pharmaceutically acceptable carriers and their formulation are described in standard formulation treatises, e.g., Remington's Pharmaceutical Sciences by E. W. Martin. See also Wang, Y. J. and Hanson, M. A., Journal of Parenteral Science and Technology, Technical Report No. 10, Supp. 42:2 S, 1988.

The ammonia oxidizing bacteria, e.g., *N. eutropha* compositions can, for example, be administered in a form suitable for immediate release or extended release. Suitable examples of sustained-release systems include suitable polymeric materials, for example semi-permeable polymer matrices in the form of shaped articles, e.g., films, or microcapsules; suitable hydrophobic materials, for example as an emulsion in an acceptable oil; or ion exchange resins. Sustained-release systems may be administered orally; rectally; parenterally; intracisternally; intravaginally; intraperitoneally; topically, for example as a powder, ointment, gel, drop or transdermal patch; bucally; or as a spray.

Preparations for administration can be suitably formulated to give controlled release of ammonia oxidizing bacteria, e.g., *N. eutropha*. For example, the pharmaceutical compositions may be in the form of particles comprising one or more of biodegradable polymers, polysaccharide jellifying and/or bioadhesive polymers, or amphiphilic polymers. These compositions exhibit certain biocompatibility features which allow a controlled release of an active substance. See U.S. Pat. No. 5,700,486.

Exemplary compositions include suspensions which can contain, for example, microcrystalline cellulose for imparting bulk, alginic acid or sodium alginate as a suspending agent, methylcellulose as a viscosity enhancer, dicalcium phosphate, starch, magnesium stearate and/or lactose and/or other excipients, binders, extenders, disintegrants, diluents and lubricants, mannitol, lactose, sucrose and/or cyclodextrins. Also included in such formulations may be high molecular weight excipients such as celluloses (avicel) or polyethylene glycols (PEG). Such formulations can also include an excipient to aid mucosal adhesion such as hydroxy propyl cellulose (HPC), hydroxy propyl methyl cellulose (HPMC), sodium carboxy methyl cellulose (SCMC), maleic anhydride copolymer (e.g., Gantrez), and agents to control release such as polyacrylic copolymer (e.g. Carbopol 934). Lubricants, glidants, flavors, coloring agents and stabilizers may also be added for ease of fabrication and use. The surfactant may be a zwitterionic surfactant, a non-ionic surfactant, or an anionic surfactant.

Excipients, such as surfactants that may be used with embodiments of the present disclosure may include one or more of cocamidopropyl betaine (ColaTeric COAB), polyethylene sorbitol ester (e.g., Tween 80), ethoxylated lauryl alcohol (RhodaSurf 6 NAT), sodium laureth sulfate/lauryl glucoside/cocamidopropyl betaine (Plantapon 611 L UP), sodium laureth sulfate (e.g., RhodaPex ESB 70 NAT), alkyl polyglucoside (e.g., Plantaren 2000 N UP), sodium laureth sulfate (Plantaren 200), Dr. Bronner's Castile soap, Dr. Bronner's Castile baby soap, Lauramine oxide (ColaLux Lo), sodium dodecyl sulfate (SDS), polysulfonate alkyl polyglucoside (PolySufanate 160 P), sodium lauryl sulfate (Stepanol-WA Extra K). and combinations thereof. Dr. Bronner's Castile soap and Dr. Bronner's baby soap comprises water, organic coconut oil, potassium hydroxide, organic olive oil, organic fair deal hemp oil, organic jojoba oil, citric acid, and tocopherol.

In some embodiments, surfactants may be used with ammonia oxidizing bacteria in amounts that allow nitrite production to occur. In some embodiments, the preparation may have less than about 0.0001% to about 10% of surfactant. In some embodiments, the preparation may have between about 0.1% and about 10% surfactant. In some embodiments, the concentration of surfactant used may be between about 0.0001% and about 10%. In some embodiments, the preparation may be substantially free of surfactant.

In some embodiments, the formulation, e.g., preparation, may include other components that may enhance effectiveness of ammonia oxidizing bacteria, maintain or enhance viability of ammonia oxidizing bacteria, or enhance a treatment or indication.

In some embodiments, a chelator may be included in the preparation. A chelator may be a compound that may bind with another compound, e.g., a metal. The chelator may provide assistance in removing an unwanted compound from an environment, or may act in a protective manner to reduce or eliminate contact of a particular compound with an environment, e.g., ammonia oxidizing bacteria, e.g. a preparation of ammonia oxidizing bacteria, e.g., an excipient. In some embodiments, the preparation may be substantially free of chelator.

Formulations may also contain anti-oxidants, buffers, bacteriostats that prevent the growth of undesired bacteria, solutes, and aqueous and non-aqueous sterile suspensions which may include suspending agents and thickening agents. The formulations may be presented in unit-dose or multi-dose containers, for example sealed ampoules and vials, and may be stored in a freeze-dried (lyophilised) condition requiring only the addition of a sterile liquid carrier, for example saline or water-for-injection, immediately prior to use. Extemporaneous solutions and suspensions may be prepared from powders, granules and tablets of the kind previously described. Exemplary compositions include solutions or suspensions which can contain, for example, suitable non-toxic, pharmaceutically acceptable diluents or solvents, such as mannitol, 1,3-butanediol, water, Ringer's solution, an isotonic sodium chloride solution, or other suitable dispersing or wetting and suspending agents, including synthetic mono- or diglycerides, and fatty acids, including oleic acid, or Cremaphor. An aqueous carrier may be, for example, an isotonic buffer solution at a pH of from about 3.0 to about 8.0, a pH of from about 3.5 to about 7.4, for example from 3.5 to 6.0, for example from 3.5 to about 5.0. Useful buffers include sodium citrate-citric acid and sodium phosphate-phosphoric acid, and sodium acetate/acetic acid buffers. The composition in some embodiments does not include oxidizing agents.

Excipients that can be included are, for instance, proteins, such as human serum albumin or plasma preparations. If desired, the pharmaceutical composition may also contain minor amounts of non-toxic auxiliary substances, such as wetting or emulsifying agents, preservatives, and pH buffering agents and the like, for example sodium acetate or sorbitan monolaurate. In some embodiments, excipients, e.g., a pharmaceutically acceptable excipient or a cosmetically acceptable excipient, may comprise an anti-adherent, binder, coat, disintegrant, filler, flavor, color, lubricant, glidant, sorbent, preservative, or sweetener. In some embodiments, the preparation may be substantially free of excipients.

In some embodiments, the preparation may be substantially free of one or more of the compounds or substances listed in the disclosure.

Exemplary compositions for aerosol administration include solutions in saline, which can contain, for example, benzyl alcohol or other suitable preservatives, absorption promoters to enhance bioavailability, and/or other solubilizing or dispersing agents. Conveniently in compositions for aerosol administration the ammonia oxidizing bacteria, e.g., N. eutropha is delivered in the form of an aerosol spray presentation from a pump. In other embodiments, compositions for aerosol administration of the ammonia oxidizing bacteria, e.g., N. eutropha is delivered in the form of an aerosol spray presentation from a pressurized pack or a nebulizer, with the use of a suitable propellant, e.g., dichlorodifluoro-methane, trichlorofluoromethane, dichlorotetrafluoroethane, carbon dioxide or other suitable gas. In the case of a pressurized aerosol the dosage unit can be determined by providing a valve to deliver a metered amount. Capsules and cartridges of e.g., gelatin can be formulated to contain a powder mix of the N. eutropha and a suitable powder base, for example lactose or starch. In certain embodiments, N. eutropha is administered as an aerosol from a metered dose valve, through an aerosol adapter also known as an actuator. Optionally, a stabilizer is also included, and/or porous particles for deep lung delivery are included (e.g., see U.S. Pat. No. 6,447,743). The composition or preparation may be in a form that may be capable of being aerosolized, sprayed or misted, i.e., in the form of a mist. The preparation of ammonia oxidizing bacteria may be ammonia oxidizing bacteria in an aqueous buffer solution comprising, consisting essentially of, or consisting of disodium phosphate and magnesium chloride, for example, 50 mM Na$_2$HPO$_4$ and 2 mM MgCl$_2$, and which may be referred to as AO+Mist throughout this disclosure. The AO+Mist preparation includes ammonia oxidizing bacteria at a concentration of 1×10$^9$ CFU/mL in an aqueous buffer solution of 50 mM Na$_2$HPO$_4$ and 2 mM MgCl$_2$.

Formulations may be presented with carriers such as cocoa butter, synthetic glyceride esters or polyethylene glycol. Such carriers are typically solid at ordinary temperatures, but liquefy and/or dissolve at body temperature to release the ammonia oxidizing bacteria, e.g., N. eutropha.

Exemplary compositions for topical administration include a topical carrier such as Plastibase (mineral oil gelled with polyethylene). In some aspects, the composition and/or excipient may be in the form of one or more of a liquid, a solid, or a gel. For example, liquid suspensions may include, but are not limited to, water, saline, phosphate-buffered saline, an ammonia oxidizing storage buffer, or an aqueous buffer solution comprising, for example, Na$_2$HPO$_4$ and MgCl$_2$, e.g., 50 mM Na$_2$HPO$_4$ and 2 mM MgCl$_2$.

Gel formulations may include, but are not limited to agar, silica, polyacrylic acid (for example Carbopol®), carboxymethyl cellulose, starch, guar gum, alginate or chitosan.

In some embodiments, the formulation may be supplemented with an ammonia source including, but not limited to ammonium chloride or ammonium sulfate.

In some embodiments, an ammonia oxidizing bacteria composition, e.g., N. eutropha composition is formulated to improve NO penetration into the skin. A gel-forming material such as KY jelly or various hair gels would present a diffusion barrier to NO loss to ambient air, and so improve the skin's absorption of NO. The NO level in the skin will generally not greatly exceed 20 nM/L because that level activates GC and would cause local vasodilatation and oxidative destruction of excess NO.

It should be understood that in addition to the ingredients particularly mentioned above, the formulations as described herein may include other agents conventional in the art having regard to the type of formulation in question.

The formulation, e.g., preparation, e.g., composition may be provided in a container, delivery system, or delivery device, having a weight, including or not including the contents of the container, that may be less than about 50, 100, 200, 300, 400, 500, 600, 700, 800, 900, 1000, 1500, or 2000 grams.

Suitable unit dosage formulations are those containing an effective dose, as herein before recited, or an appropriate fraction thereof, of ammonia oxidizing bacteria, e.g., N. eutropha.

A therapeutically effective amount of ammonia oxidizing bacteria, e.g., N. eutropha may be administered as a single pulse dose, as a bolus dose, or as pulse doses administered over time. Thus, in pulse doses, a bolus administration of ammonia oxidizing bacteria, e.g., N. eutropha is provided, followed by a time period wherein ammonia oxidizing bacteria, e.g., N. eutropha is administered to the subject, followed by a second bolus administration. In specific, non-limiting examples, pulse doses are administered during the course of a day, during the course of a week, or during the course of a month.

A therapeutically effective amount of ammonia oxidizing bacteria, e.g., N. eutropha may be administered in the form of an aerosol or mist as a single spray or pump, or multiple sprays or pumps. In a single administration, one or more sprays or pumps may be actuated. A therapeutically effective amount may be the result of a single administration, or multiple administrations, during the course of one or more days, during the course of one or more weeks, during the course of one or more months, or longer.

A therapeutically effective amount may be an amount sufficient to improve any one or more of acne counts, PIH/PIE Lesion Grading, SkinDex16 data, modified Griffiths' 10-point scale, Tolerability Evaluations, Sebumeter Measurements, and Investigator's Global Acne (IGA) scale, at 1, 2, 3, 4, 5, 6, 7, 8, 9, 10, 11, 12, 13, 14, 15, 16, 17, 18, 19, 20, 22, 24, 26, 28, 30, 32, 34, 36, 38, 40, 42, 44, 46, 48, 50, 52 weeks.

In some embodiments, a preparation of ammonia oxidizing bacteria, e.g., a formulation, e.g., a composition, may be applied for a pre-determined number of days. This may be based, for example, at least in part, on the severity of the condition or disease, the response to the treatment, the dosage applied and the frequency of the dose. For example, the preparation may be applied for about 1-3, 3-5, 5-7, 7-9, 5-10, 10-14, 12-18, 12-21, 21-28, 28-35, 35-42, 42-49, 49-56, 46-63, 63-70, 70-77, 77-84, 84-91 days, for about 1 month, for about 2 months, for about 3 months. In some embodiments, the ammonia oxidizing bacteria is administered for an indefinite period of time, e.g., greater than one year, greater than 5 years, greater than 10 years, greater than 15 years, greater than 30 years, greater than 50 years, greater than 75 years. In certain aspects, the preparation may be applied for about 16 days. In certain aspects, the preparation may be applied for about 4 weeks.

In some embodiments, a preparation of ammonia oxidizing bacteria, e.g., a formulation, e.g., a composition, may be applied a pre-determined number of times per day. This may be based, for example, at least in part, on the severity of the condition or disease, the response to the treatment, the dosage applied and the frequency of the dose. For example, the preparation may be applied 1, 2, 3, 4, 5, 6, 7, 8, 9, 10, 11, 12, 13, 14, 15, 16, 17, 18, 19, 20, 21, 22, 23, 24 times per day.

In some embodiments, the preparation may be applied one time per day. In other embodiments, the preparation may be applied two times per day. In some embodiments, the preparation may be applied a first pre-determined amount for a certain number of days, and a second pre-determined amount for a certain subsequent number of days. In some embodiments, the preparation may be applied for about 16 days. In certain aspects, the preparation may be applied for about 4 weeks.

Consumer Products

Ammonia oxidizing bacteria, e.g., *N. eutropha* may be associated with a variety of consumer products, and examples of such products are set out below and be comprised of formulations, compositions, or preparations disclosed throughout this disclosure. In some embodiments, the ammonia oxidizing bacteria, e.g., *N. eutropha* associated with a product is admixed with the product, for example, spread evenly throughout the product, and in some embodiments, ammonia oxidizing bacteria, e.g., the *N. eutropha* associated with a product is layered on the product.

In some embodiments, ammonia oxidizing bacteria, e.g., *N. eutropha* is associated with a powder. Powders are typically small particulate solids that are not attached to each other and that can flow freely when tilted. Exemplary powders for consumer use include talcum powder and some cosmetics (e.g., powder foundation).

In some embodiments, the ammonia oxidizing bacteria is associated with a cosmetic. The cosmetic may be a substance for topical application intended to alter a person's appearance, e.g., a liquid foundation, a powder foundation, blush, or lipstick, and may be referred to as a preparation. The cosmetic may be any substance recited in the Food and Drug Administration regulations, e.g., under 21 C.F.R. § 720.4.

The preparation, e.g., the cosmetic, may be at least one of a baby product, e.g., a baby shampoo, a baby lotion, a baby oil, a baby powder, a baby cream; a bath preparation, e.g., a bath oil, a tablet, a salt, a bubble bath, a bath capsule; an eye makeup preparation, e.g., an eyebrow pencil, an eyeliner, an eye shadow, an eye lotion, an eye makeup remover, a mascara; a fragrance preparation, e.g., a colognes, a toilet water, a perfume, a powder (dusting and talcum), a sachet; hair preparations, e.g., hair conditioners, hair sprays, hair straighteners, permanent waves, rinses, shampoos, tonics, dressings, hair grooming aids, wave sets; hair coloring preparations, e.g., hair dyes and colors, hair tints, coloring hair rinses, coloring hair shampoos, hair lighteners with color, hair bleaches; makeup preparations, e.g., face powders, foundations, leg and body paints, lipstick, makeup bases, rouges, makeup fixatives; manicuring preparations, e.g., basecoats and undercoats, cuticle softeners, nail creams and lotions, nail extenders, nail polish and enamel, nail polish and enamel removers; oral hygiene products, e.g., dentrifices, mouthwashes and breath fresheners; bath soaps and detergents, deodorants, douches, feminine hygiene deodorants; shaving preparations, e.g., aftershave lotions, beard softeners, talcum, preshave lotions, shaving cream, shaving soap; skin care preparations, e.g., cleansing, depilatories, face and neck, body and hand, foot powders and sprays, moisturizing, night preparations, paste masks, skin fresheners; and suntan preparations, e.g., gels, creams, and liquids, and indoor tanning preparations.

In some embodiments, the formulations, compositions, or preparations described herein, may comprise, be provided as, or disposed in at least one of a baby product, e.g., a baby shampoo, a baby lotion, a baby oil, a baby powder, a baby cream; a bath preparation, e.g., a bath oil, a tablet, a salt, a bubble bath, a bath capsule; a powder (dusting and talcum), a sachet; hair preparations, e.g., hair conditioners, rinses, shampoos, tonics, face powders, cuticle softeners, nail creams and lotions, oral hygiene products, mouthwashes, bath soaps, douches, feminine hygiene deodorants; shaving preparations, e.g., aftershave lotions, skin care preparations, e.g., cleansing, face and neck, body and hand, foot powders and sprays, moisturizing, night preparations, paste masks, skin fresheners; and suntan preparations, e.g., gels, creams, and liquids.

In some embodiments, ammonia oxidizing bacteria, e.g., *N. eutropha* is associated with a cosmetic. The cosmetic may be a substance for topical application intended to alter a person's appearance, e.g., a liquid foundation, a powder foundation, blush, or lipstick. Other components may be added to these cosmetic preparations as selected by one skilled in the art of cosmetic formulation such as, for example, water, mineral oil, coloring agent, perfume, aloe, glycerin, sodium chloride, sodium bicarbonate, pH buffers, UV blocking agents, silicone oil, natural oils, vitamin E, herbal concentrates, lactic acid, citric acid, talc, clay, calcium carbonate, magnesium carbonate, zinc oxide, starch, urea, and erythorbic acid, or any other excipient known by one of skill in the art, including those disclosed herein.

In some embodiments, the preparation may be disposed in, or provided as, a powder, cosmetic, cream, stick, aerosol, e.g., mist, salve, wipe, or bandage.

In some embodiments, ammonia oxidizing bacteria, e.g., *N. eutropha* is associated with a cream. The cream may be a fluid comprising a thickening agent, and generally has a consistency that allows it to be spread evenly on the skin. Exemplary creams include moisturizing lotion, face cream, and body lotion.

In some embodiments, ammonia oxidizing bacteria, e.g., the *N. eutropha* is associated with a stick. A stick is typically a solid that, when placed in contact with a surface, transfers some of the stick contents to the surface. Exemplary sticks include deodorant stick, lipstick, lip balm in stick form, and sunscreen applicator sticks.

In some embodiments, ammonia oxidizing bacteria, e.g., the *N. eutropha* is associated with an aerosol. An aerosol is typically a colloid of fine solid particles or fine liquid droplets, in a gas such as air. Aerosols may be created by placing the *N. eutropha* (and optionally carriers) in a vessel under pressure, and then opening a valve to release the contents. The container may be designed to only exert levels of pressure that are compatible with *N. eutropha* viability. For instance, the high pressure may be exerted for only a short time, and/or the pressure may be low enough not to impair viability. Examples of consumer uses of aerosols include for sunscreen, deodorant, perfume, hairspray, and insect repellant. The aerosol may be referred to as a mist.

In some embodiments, ammonia oxidizing bacteria, e.g., the *N. eutropha* is associated with a salve. A salve may be a topically applied agent with a liquid or cream-like consistency, intended to protect the skin or promote healing. Examples of salves include burn ointments and skin moisturizers.

In some embodiments, ammonia oxidizing bacteria, e.g., the *N. eutropha* is associated with a wipe. A wipe may be a flexible material suitable for topically applying a liquid or cream onto skin. The wipe may be, e.g., paper-based or cloth based. Exemplary wipes include tissues and wet wipes.

The compositions comprising ammonia oxidizing bacteria, e.g., *N. eutropha* may also comprise one or more of a moisturizing agent, deodorizing agent, scent, colorant, insect repellant, cleansing agent, or UV-blocking agent.

For instance, the moisturizing agent may be an agent that reduces or prevents skin dryness. Exemplary moisturizing agents include humectants (e.g., urea, glycerin, alpha hydroxy acids and dimethicone) and emollients (e.g., lanolin, mineral oil and petrolatum). Moisturizing agents may be included, e.g., in ammonia oxidizing bacteria, e.g., *N. eutropha*-containing creams, balms, lotions, or sunscreen.

A deodorizing agent may be an agent that reduces unwanted odors. A deodorizing agent may work by directly neutralizing odors, preventing perspiration, or preventing the growth of odor-producing bacteria. Exemplary deodorizing agents include aluminum salts (e.g., aluminum chloride or aluminum chlorohydrate), cyclomethicone, talc, baking soda, essential oils, mineral salts, hops, and witch hazel. Deodorizing agents are typically present in spray or stick deodorants, and can also be found in some soaps and clothing.

An insect repellant may be an agent that can be applied to surfaces (e.g., skin) that discourage insects and other arthropods from lighting on the surface. Insect repellants include DEET (N,N-diethyl-m-toluamide), p-menthane-3,8-diol (PMD), icaridin, nepetalactone, citronella oil, neem oil, bog myrtle, dimethyl carbate, Tricyclodecenyl allyl ether, and IR3535 (3-[N-Butyl-N-acety]-aminopropionic acid, ethyl ester).

A cleansing agent may be an agent that removes dirt or unwanted bacteria from a surface like skin. Exemplary cleansing agents include bar soaps, liquid soaps, and shampoos.

A UV-blocking agent may be an agent that can be applied to a surface to reduce the amount of ultraviolet light the surface receives. A UV-blocking agent may block UV-A and/or UV-B rays. A UV blocking agent can function by absorbing, reflecting, or scattering UV. Exemplary UV-blocking agents include absorbers, e.g., homosalate, octisalate (also called octyl salicylate), octinoxate (also called octyl methoxycinnamate or OMC), octocrylene, oxybenzone, and avobenzone, and reflectors (e.g., titanium dioxide and zinc oxide). UV-blocking agents are typically present in sunscreens, and can also be found in skin creams and some cosmetics.

In some embodiments, ammonia oxidizing bacteria, e.g., *N. eutropha* is associated with a conditioner. Conditioner generally refers to a substance with cream-like consistency that can be applied to hair to improve its appearance, strength, or manageability.

In some embodiments, ammonia oxidizing bacteria, e.g., *N. eutropha* is associated with cloth. Cloth generally refers to a flexible material suitable to be made into clothing, e.g., having enough material strength to withstand everyday motion by a wearer. Cloth can be fibrous, woven, or knit; it can be made of a naturally occurring material or a synthetic material. Exemplary cloth materials include cotton, flax, wool, ramie, silk, denim, leather, nylon, polyester, and spandex, and blends thereof.

In some embodiments, ammonia oxidizing bacteria, e.g., *N. eutropha* is associated with yarn. Yarn generally refers to a long, thin spun flexible material that is suitable for knitting or weaving. Yarn can be made of, e.g., wool, cotton, polyester, and blends thereof.

In some embodiments, ammonia oxidizing bacteria, e.g., *N. eutropha* is associated with thread. Thread generally refers to a long, thin spun flexible material that is suitable for sewing. Thread generally has a thinner diameter than yarn. Thread can be made of, e.g., cotton, polyester, nylon, silk, and blends thereof.

Articles of clothing such as, for example, shoes, shoe inserts, pajamas, sneakers, belts, hats, shirts, underwear, athletic garments, helmets, towels, gloves, socks, bandages, and the like, may also be treated with ammonia oxidizing bacteria, e.g., *N. eutropha*. Bedding, including sheets, pillows, pillow cases, and blankets may also be treated with ammonia oxidizing bacteria, e.g., *N. eutropha*. In some embodiments, areas of skin that cannot be washed for a period of time may also be contacted with ammonia oxidizing bacteria, e.g., *N. eutropha*. For example, skin enclosed in orthopedic casts which immobilize injured limbs during the healing process, and areas in proximity to injuries that must be kept dry for proper healing such as stitched wounds may benefit from contact with the ammonia oxidizing bacteria, e.g., *N. eutropha*.

In some aspects, the present disclosure provides a wearable article comprising an *N. eutropha* strain as described herein. A wearable article may be a light article that can be closely associated with a user's body, in a way that does not impede ambulation. Examples of wearable articles include a wristwatch, wristband, headband, hair elastic, hair nets, shower caps, hats, hairpieces, and jewelry. The wearable article comprising an ammonia oxidizing bacteria, e.g., *N. eutropha* strain described herein may provide, e.g., at a concentration that provides one or more of a treatment or prevention of a skin disorder, a treatment or prevention of a disease or condition associated with low nitrite levels, a treatment or prevention of body odor, a treatment to supply nitric oxide to a subject, or a treatment to inhibit microbial growth.

In some embodiments, the ammonia oxidizing bacteria, e.g., *N. eutropha* is associated with a product intended to contact the hair, for example, a brush, comb, shampoo, conditioner, headband, hair elastic, hair nets, shower caps, hats, and hairpieces. Nitric oxide formed on the hair, away from the skin surface, may be captured in a hat, scarf or face mask and directed into inhaled air.

Articles contacting the surface of a human subject, such as a diaper, may be associated with ammonia oxidizing bacteria, e.g., *N. eutropha*. Because diapers are designed to hold and contain urine and feces produced by incontinent individuals, the urea in urine and feces can be hydrolyzed by skin and fecal bacteria to form free ammonia which is irritating and may cause diaper rash. Incorporation of bacteria that metabolize urea into nitrite or nitrate, such as ammonia oxidizing bacteria, e.g., *N. eutropha*, may avoid the release of free ammonia and may release nitrite and ultimately NO which may aid in the maintenance of healthy skin for both children and incontinent adults. The release of nitric oxide in diapers may also have antimicrobial effects on disease causing organisms present in human feces. This effect may continue even after disposable diapers are disposed of as waste and may reduce the incidence of transmission of disease through contact with soiled disposable diapers.

In some embodiments, the product comprising ammonia oxidizing bacteria, e.g., *N. eutropha* is packaged. The packaging may serve to compact the product or protect it from damage, dirt, or degradation. The packaging may comprise, e.g., plastic, paper, cardboard, or wood. In some embodiments the packaging is impermeable to bacteria. In some embodiments the packaging is permeable to oxygen and/or carbon dioxide.

4. Methods of Treatment with Ammonia Oxidizing Bacteria, e.g., *N. eutropha*

The present disclosure provides various methods of treating diseases and conditions using ammonia oxidizing bacteria, e.g., *N. eutropha*. The ammonia oxidizing bacteria, e.g., *N. eutropha* that may be used to treat diseases and conditions include all the ammonia oxidizing bacteria, e.g., *N. eutropha* compositions described in this application, e.g. a purified preparation of optimized ammonia oxidizing bacteria, e.g., *N. eutropha*, for instance strain D23.

The ammonia oxidizing bacteria administered to treat a skin condition, e.g., acne, e.g., acne vulgaris may be selected from the group consisting of *Nitrosomonas, Nitrosococcus, Nitrosospira, Nitrosocystis, Nitrosolobus, Nitrosovibrio*, and combinations thereof. In certain aspects, the ammonia oxidizing bacteria may be *Nitrosomonas eutropha* (*N. eutropha*). In certain aspects, the ammonia oxidizing bacteria is *N. eutropha* D23, having ATCC accession number PTA-121157.

The methods may be provided to administer, or deliver, a therapeutic product, or a cosmetic product.

The ammonia oxidizing bacteria, e.g., *N. eutropha* may be used to treat skin conditions such as acne, rosacea, eczema, or psoriasis.

In certain embodiments, the disclosure provides uses for treating a skin condition or disease (e.g., inhibiting microbial growth on a subject's skin), ammonia oxidizing bacteria, e.g., an optionally axenic composition of *N. eutropha* having one or more of: (1) an optimized growth rate, (2) an optimized $NH_4^+$ oxidation rate, (3) an optimized resistance to $NH_3$, (4) an optimized resistance to, $NH_4^+$, and (5) an optimized resistance to, $NO_2$. For instance, the axenic *N. eutropha* composition may have properties (1) and (2); (2) and (3); (3) and (4); or (4) and (5) from the list at the beginning of this paragraph. As another example, the axenic *N. eutropha* composition may have properties (1), (2), and (3); (1), (2), and (4); (1), (2), and (5); (1), (3), and (4); (1), (3), and (5); (1), (4), and (5); (2), (3), and (4); (2), (3), and (5), or (3), (4), and (5) from the list at the beginning of this paragraph. As a further example, the optionally axenic *N. eutropha* composition may have properties (1), (2), (3), and (4); (1), (2), (3), and (5); (1), (2), (4), and (5); (1), (3), (4), and (5); or (2), (3), (4), and (5) from the list at the beginning of this paragraph. In some embodiments, the axenic *N. eutropha* composition has properties (1), (2), (3), (4), and (5) from the list at the beginning of this paragraph.

The ammonia oxidizing bacteria may be used to treat a skin condition, e.g., acne, e.g., acne vulgaris.

In some embodiments, ammonia oxidizing bacteria, e.g., *N. eutropha*, e.g., optionally axenic *N. eutropha* (e.g., strain D23) are used to treat a subject. Subjects may include an animal, a mammal, a human, a non-human animal, a livestock animal, or a companion animal.

The subject may be female or male. The subject may be one of the following ethnicity/race: Asian, black or African American, Hispanic or Latino, white, or multi-racial. The subject may be characterized as having at least one of the following skin types: normal, oily, and combination skin. The subject may be characterized as having one of the following Fitzpatrick skin types: I, II, III, IV, V. The acne type of the subject may be one of adolescent acne or adult acne. The age of the subject may be between about 12-15, 16-18, 19-28, or greater than 28.

Adult acne refers acne of a subject that is age 19, or older. Adolescent acne refers to acne of a subject that is less than 19 years old.

In some embodiments, methods of treating a skin disorder, e.g., acne, e.g. acne vulgaris, of a subject are provided comprising administering, e.g., applying, e.g., topically administering, ammonia oxidizing bacteria, e.g., a preparation comprising ammonia oxidizing bacteria, to a surface of the subject.

An amount and/or a frequency of administration, e.g., application, may be sufficient to reduce the amount or concentration of pathogenic bacteria, e.g., *Propionibacterium acnes*, on the surface of the subject. The amount may be a therapeutically effective dose of ammonia oxidizing bacteria.

Administration, e.g., administering, may provide for treatment of inflammatory lesions. The inflammatory lesions may be in the form of any one or more of papules, pustules, and cysts/nodules.

Papules and pustules may be described as pimples caused by irritated pores. Papules are small bumps that appear on the skin and typically have a rough texture and are hard when touched. Papules may occur when the wall of a hair follicle breaks and caves in. Pustules are similar to papules except that yellowish, liquid pus may fill them. White blood cells rise to the surface of the skin of papules to form pustules.

Blocked pores may get more irritated and larger, and penetrate deeper into the skin to provide nodules and cysts. Cysts typically form below the skin surface, and a build up of white blood cells, oils and fluids begin to build up causing the appearance of cysts, or pus filled regions. Nodules are hard and may form when the bottom of a follicle will break off, which may cause the follicle to collapse. This may produce a large, sore bump on the surface of the skin called a nodule. Nodules may extend into deep layers of the skin.

Administration, e.g., administering, may provide for treatment of non-inflammatory lesions. The non-inflammatory lesions may be comedones, e.g., open comedones and/or closed comedones.

Closed comedones, or whiteheads, are small plugged follicles, the contents of which are not exposed to the skin. Open comedones or blackheads are small follicles with dilated openings to the skin allowing oxidation of the debris within the follicle leading to the black color.

Administration, e.g., administering, may provide for treatment or improvement of post-inflammatory hyperpigmentation/post inflammatory erythema (PIH/PIE) lesions. Hyperpigmentation is characterized by a darkening of an area of skin caused by the overproduction of a pigment in the skin, e.g., melanin. Post-inflammatory refers to localized skin erythema following any type of skin inflammation, e.g., acne-related skin inflammation, including erythema that may result in a scar.

Administration, e.g., administering, may provide for treatment or improvement of one or more of erythema, edema, scaling, stinging, burning, and itching. Erythema may refer to superficial reddening of the skin, typically in patches, as a result of injury or irritation, causing dilatation of the blood capillaries. Edema may refer to a condition characterized by an excess of watery fluid collecting in the cavities or tissues of a subject, e.g., swelling.

Administration, e.g., administering, may provide for treatment or improvement of one or more of oily appearance, pore appearance, radiance, blotchiness, skin tone evenness, visual smoothness, and tactile smoothness.

Administration, e.g., administering, may provide for treatment or improvement in sebumeter measurements. Sebum is an oily secretion of sebaceous glands. Sebum may be found on any area of a body of a subject, for example, Administration may provide for one or more of the following: reduces inflammation of lesions, reduces the frequency of lesions, and decreases the presence of pathogenic bacteria, e.g., *Propionibacterium acnes*.

Administration may provide for the decrease of the presence of pathogenic bacteria, e.g., *Propionibacterium acnes*. Administration may provide for an improvement in the subject's emotional assessment of their disease as measured by Skindex16 Quality of Life Survey. Administration may provide for an improvement in one or more of the following: skin condition hurting in the subject, persistence/reoccurrence of skin condition in the subject, and appearance of skin condition in the subject. Administration may provide for an improvement (decrease) in one or more of the following, according to clinical grading: grading scores for visual and tactile smoothness, and blotchiness.

Administration, e.g., administering of the ammonia oxidizing bacteria, e.g. preparation of ammonia oxidizing bacteria may comprise pre-treating the subject with ammonia oxidizing bacteria. For example, pre-treating may involve administration of the ammonia oxidizing bacteria prior to an acne or acne related outbreak, for example prior to emergence of an acne-related symptom or condition. Administration may comprise topically administering prior to occurrence of the skin disorder, e.g., acne, e.g., acne vulgaris.

Administration, e.g, topically administering may comprise topically administering to the subject an effective dose of ammonia oxidizing bacteria. The effective does may be any one or more of about $0.1\times10^9$, $0.2\times10^9$, $0.3\times10^9$, $0.4\times10^9$, $0.5\times10^9$, $0.6\times10^9$, $0.7\times10^9$, $0.8\times10^9$, $0.9\times10^9$, $1.0\times10^9$, $1.2\times10^9$, $1.4\times10^9$, $1.5\times10^9$, $1.6\times10^9$, $1.8\times10^9$, $2.0\times10^9$, $2.2\times10^9$, $2.4\times10^9$, $2.6\times10^9$, $2.8\times10^9$, $3.0\times10^9$, $3.2\times10^9$, $3.4\times10^9$, $3.6\times10^9$, $3.8\times10^9$, $4.0\times10^9$, $4.2\times10^9$, $4.4\times10^9$, $4.6\times10^9$, $4.8\times10^9$, $5.0\times10^9$, $5.5\times10^9$, $6.0\times10^9$, $6.5\times10^9$, $7.0\times10^9$, $7.5\times10^9$, $8.0\times10^9$, $8.5\times10^9$, $9.0\times10^9$, $9.5\times10^9$, $10.0\times10^9$, $12\times10^9$, $14\times10^9$, $16\times10^9$, $18\times10^9$, $20\times10^9$, $25\times10^9$, $30\times10^9$, $40\times10^9$, $50\times10^9$ CFU.

The effective dose may also comprise an ammonia oxidizing bacteria having a dose as described herein, in combination with ammonia, for example, an ammonia concentration of between about 0.01 mM to about 100 mM. For example, the ammonia concentration may be about 0.01, 0.05, 0.1, 0.2, 0.4, 0.5, 0.6, 0.8, 1.0, 1.2, 1.4, 1.6, 1.8, 2.0, 2.2, 2.4, 2.5, 2.6, 2.8, 3.0, 3.2, 3.4, 3.6, 3.8, 4.0, 4.2, 4.4, 4.5, 4.6, 4.8, 5.0, 5.2, 5.4, 5.6, 5.8, 6.0, 6.2, 6.4, 6.6, 6.8, 7.0, 7.2, 7.4, 7.6, 7.8, 8.0, 8.2, 8.4, 8.6, 8.8, 10.0, 15.0, 20.0, 25.0, 30.0, 35.0, 40.0, 45.0, 50.0, 55.0, 60.0, 65.0, 70.0, 75.0, 80.0, 85.0, 90.0, 95.0, 100.0 mM.

The skin disorder, e.g., acne, e.g., acne vulgaris may be present at a target site of the subject, which may comprise one or more undesirable bacteria, e.g., pathogenic bacteria. The target site may comprise *Propionibacterium acnes*.

The method of treating may further comprise determining whether the subject is in need of treating the skin disorder. This may involve determining whether the subject is in need of treating acne, e.g., acne vulgaris. The method may further comprise selecting the subject in need of treating the skin disorder.

In certain embodiments, the method may comprise selecting the subject on the basis of the subject being in need of a reduction of the amount or concentration of pathogenic bacteria, e.g., *Propionibacterium acnes*, on the surface of the subject.

Administration may comprise self-administration of the ammonia oxidizing bacteria by the subject. Administration may comprise administration of the ammonia oxidizing bacteria by one who is not the subject. The ammonia oxidizing bacteria may be administered, e.g., applied to any part of the body of the subject, for example, head, shoulder, arm, leg, underarm, torso, feet, knee, ankle, or buttocks. In certain aspects, the ammonia oxidizing bacteria may be applied to any one or more of the face, neck, and scalp of the subject.

In some embodiments, administration may comprise administering, e.g., applying the ammonia oxidizing bacteria, e.g., the preparation of ammonia oxidizing bacteria, a suitable number of times to provide an effective treatment of acne as described by improvement in any one or more of the measurement techniques described herein. For example, administration may occur about 1, 2, 3, 4, 5, 6, 7, 8, 9, 10, 11, 12, 13, 14, 15, 16, 17, 18, 19, 20, 21, 22, 23, or 24 times per day. Administration may comprise administering, e.g., applying the ammonia oxidizing bacteria, e.g., the preparation of ammonia oxidizing bacteria, one time per day. Administration may comprise administering, e.g., applying the ammonia oxidizing bacteria, e.g., the preparation of ammonia oxidizing bacteria, two times per day.

In some embodiments, administration of the preparation may comprise administering, e.g., applying the ammonia oxidizing bacteria, e.g., the preparation of ammonia oxidizing bacteria, for a suitable time period to provide an effective treatment of acne as described by improvement in any one or more of the measurement techniques described herein. Administration of the preparation may comprise administering, e.g., applying the ammonia oxidizing bacteria, e.g., the preparation of ammonia oxidizing bacteria for about 1-3, 3-5, 5-7, 7-9, 5-10, 10-14, 12-18, 12-21, 21-28, 28-35, 35-42, 42-49, 49-56, 46-63, 63-70, 70-77, 77-84, or 84-91 days. The preparation, for example, may be applied for about 7 days. The preparation, for example, may be applied for about 14 days. The preparation, for example, may be applied for about 21 days. The preparation, for example, may be applied for about 28 days.

The ammonia oxidizing bacteria, e.g., preparation of ammonia oxidizing bacteria, may be in a form, e.g., medium, that may be capable of being aerosolized, sprayed or misted, i.e., in the form of a mist. The ammonia oxidizing bacteria, e.g., preparation of ammonia oxidizing bacteria, may be administered, e.g., applied, e.g., topically applied, as an aerosol or mist. The aerosol or mist may comprise an aqueous medium. The preparation of ammonia oxidizing bacteria may be in a preparation that maintains or promotes viability of the ammonia oxidizing bacteria. The preparation may be in a buffer solution, e.g., an aqueous buffer solution. The buffer solution, e.g., aqueous buffer solution. The aqueous buffer may comprises disodium phosphate and magnesium chloride. The aqueous buffer may comprise 50 mM Na$_2$HPO$_4$ and 2 mM MgCl$_2$ in water. The concentration of ammonia oxidizing bacteria may be any concentration of AOBs disclosed herein. In certain aspects, the aqueous buffer may comprise 50 mM Na$_2$HPO$_4$ and 2 mM MgCl$_2$ in water, and further comprise ammonia oxidizing bacteria, e.g., D23 *N. eutropha* at a concentration of 1×10$^9$ CFU/mL.

The aqueous buffer solution, prior to addition of the ammonia oxidizing bacteria, may comprise, consist essentially of or consist of disodium phosphate and magnesium chloride, for example, 50 mM Na$_2$HPO$_4$ and 2 mM MgCl$_2$ in water.

In some embodiments, the preparation may comprise at least one of ammonia, ammonium salts, and urea. The preparation may comprise a controlled release material. For example, the controlled release material may be a slow release material. The preparation of ammonia oxidizing bacteria may comprise an excipient. The excipient may be a pharmaceutically acceptable excipient or a cosmetically acceptable excipient, as disclosed throughout this disclosure. The excipient may be a surfactant, for example, a surfactant that is disclosed throughout this disclosure. In some embodiments, the excipient, e.g., the pharmaceutically acceptable excipient or the cosmetically acceptable excipient, comprises an anti-adherent, binder, coat, disintegrant, filler, flavor, color, lubricant, glidant, sorbent preservative, or sweetener.

The preparation may be substantially free of other organisms. The preparation may comprise a second organism, e.g., an organism selected from the group consisting of *Lactobacillus, Streptococcus, Bifidobacter*, and combinations thereof.

In some embodiments, the preparation for treatment of a skin condition, e.g., acne, e.g., acne vulgaris, may be disposed in or provided as a powder, cosmetic, cream, stick, aerosol, e.g., mist, salve, wipe, or bandage. In some embodiments, the preparation for treatment of a skin condition, e.g., acne, e.g., acne vulgaris may comprise a moisturizing agent, deodorizing agent, cent, colorant, insect repellant, cleansing agent, or UV-blocking agent.

In some embodiments, the preparation for treatment of a skin condition, e.g., acne, e.g., acne vulgaris, may comprise ammonia oxidizing bacteria having a concentration of about 10$^8$ to about 10$^{14}$ CFU/mL of ammonia oxidizing bacteria. In certain aspects, the preparation may comprise between about 1×10$^9$ CFU/mL to about 10×10$^9$ CFU/mL ammonia oxidizing bacteria. In some embodiments, the preparation may comprise ammonia oxidizing bacteria comprises between about 50 milligrams (mg) and about 1000 mg of ammonia oxidizing bacteria. In some embodiments, the mass ratio of ammonia oxidizing bacteria to the excipient, e.g., the pharmaceutically acceptable excipient or the cosmetically acceptable excipient is in a range of about 0.1 grams to about 1 gram per liter.

The preparation of ammonia oxidizing bacteria that may be used to treat acne may be provided in a container, the preparation and the container having a weight of less than about 50, 100, 200, 300, 400, 500, 600, 700, 800, 900, 1000, 1500, or 2000 grams.

The method may further comprise obtaining a sample from the surface of the skin. The sample may be taken any time prior to administration of the ammonia oxidizing bacteria, or any time subsequent to administration of the ammonia oxidizing bacteria. For example, the sample may be taken about 1 minute, 5 minutes, 10, 15, 20, 25, 30, 45, 60, 90, 120 minutes prior to administration, or 3 hours, 4, 5, 6, 7, 8, 12, 18, 24 hours prior to administration, or 1 week, 2, 3, 4, 5, 6, 7, 8, 9, 10, 11, 12 weeks prior to administration.

Alternatively, or in addition to, the sample may be taken about 1 minute, 5 minutes, 10, 15, 20, 25, 30, 45, 60, 90, 120 minutes subsequent to administration, or 3 hours, 4, 5, 6, 7, 8, 12, 18, 24 hours subsequent to administration, or 1 week, 2, 3, 4, 5, 6, 7, 8, 9, 10, 11, 12 weeks subsequent to administration.

The method may further comprise isolating DNA of bacteria in the sample. The bacteria may be *Propionibacterium acnes*. The administration of ammonia oxidizing bacteria provides for a decrease in *Propionibacterium acnes*. The decrease in *Propionibacterium acnes* may occur after about 1, 2, 3, 4, 5, 6, 7, 8, 9, 10, 11, 12, 13, 14, 15, 16, 17, 18, 19, 20, 21, 22, 23, 24, 25, 26, 27, 28, 35, 42, 49, 56, 63, 70, 77, 84, 91, 98, 105, or more days.

Use of cosmetic products, e.g., microbiome-compatible cosmetic products, e.g., shampoos, conditioners, and cleansers as described herein may be used in conjunction with the treatment of a skin condition, e.g., acne, e.g., acne vulgaris. These cosmetic products may be used in conjunction with administration of the ammonia oxidizing bacteria. For example, throughout the treatment period of time of administering the ammonia oxidizing bacteria to a subject, the cosmetic products may be used. The cosmetic products may be used for a period of time prior to commencement of treatment of the skin condition through administration of ammonia oxidizing bacteria to a subject. The cosmetic products may be used for a period of time subsequent to commencement of treatment of the skin condition through administration of ammonia oxidizing bacteria to a subject. The cosmetic products may be used for a period of time subsequent to discontinuation of treatment of the skin condition through administration of ammonia oxidizing bacteria to a subject.

In some embodiments, the subject may apply one or more cosmetic product, and wait a period of time before administration of the ammonia oxidizing bacteria. In other embodiments, the subject may administer the ammonia oxidizing bacteria, and wait a period of time before applying one or more cosmetic products.

The period of time the subject may wait may be about 1 minute, 5 minutes, 10, 15, 20, 25, 30, 45, 60, 90, 120 minutes, or 3 hours, 4, 5, 6, 7, 8, 12, 18, 24 hours after applying one or more cosmetic product and prior to administration of ammonia oxidizing bacteria.

The period of time the subject may wait may be about 1 minute, 5 minutes, 10, 15, 20, 25, 30, 45, 60, 90, 120 minutes, or 3 hours, 4, 5, 6, 7, 8, 12, 18, 24 hours after administering the ammonia oxidizing bacteria and prior to applying one or more cosmetic products.

The subject may be evaluated prior to beginning treatment, e.g., administering ammonia oxidizing bacteria. The subject may be evaluated subsequent to beginning treatment, e.g, subsequent to a first administration, e.g., application of ammonia oxidizing bacteria.

The subject may be evaluated 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 days; or 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52 weeks; or 2.3 years, 4, or 5 years prior to beginning treatment, e.g., administering the ammonia oxidizing bacteria.

The subject may be evaluated 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42 days; or 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52 weeks; or 2.3 years, 4, or 5 years subsequent to beginning treatment, e.g., a first administration, e.g, application of ammonia oxidizing bacteria.

Administration may occur at a time period before or after the subject cleanses, baths, or showers. For example, administration may occur at a time period that is 30, 60, 90, 120, 150, 180 minutes before or after the subject cleanses, baths, or showers.

In some embodiments, ammonia oxidizing bacteria, e.g., N. eutropha, e.g., optionally axenic N. eutropha described herein (e.g., the N. eutropha described throughout the disclosure, e.g., strain D23) are used to inhibit the growth of other organisms. For instance, N. eutropha D23 is well-adapted for long-term colonization of human skin, and in some embodiments it out-competes other bacteria that are undesirable on the skin. Undesirable skin bacteria include, e.g., those that can infect wounds, raise the risk or severity of a disease, or produce odors. Certain undesirable skin bacteria include S. aureus, P. aeruginosa, S. pyogenes, and A. baumannii. The N. eutropha described herein may out-compete other organisms by, e.g., consuming scarce nutrients, or generating byproducts that are harmful to other organisms, e.g., changing the pH of the skin to a level that is not conducive to the undesirable organism's growth.

Accordingly, the present disclosure provides, inter alia, a method of inhibiting microbial growth on a subject's skin, comprising topically administering to a human in need thereof an effective dose of ammonia oxidizing bacteria, e.g., N. eutropha, e.g., optionally axenic N. eutropha described herein as described herein (e.g., strain D23). Similarly, the present disclosure provides ammonia oxidizing bacteria, e.g., N. eutropha, e.g., optionally axenic N. eutropha described herein for use in inhibiting microbial growth on a subject's skin. Likewise, the present disclosure provides a use of ammonia oxidizing bacteria, e.g., N. eutropha, e.g., optionally axenic N. eutropha described herein in the manufacture of a medicament for inhibiting microbial growth on a subject's skin.

Accordingly, the present disclosure provides, inter alia, a method of treating a skin condition, e.g., acne, e.g., acne vulgaris, comprising topically administering to a human in need thereof an effective dose of ammonia oxidizing bacteria, e.g., N. eutropha, e.g., optionally axenic N. eutropha as described herein (e.g., strain D23). Similarly, the present disclosure provides ammonia oxidizing bacteria, e.g., N. eutropha, e.g., optionally axenic N. eutropha described herein (e.g., strain D23) for use in treating a skin condition, e.g., acne, e.g., acne vulgaris, on subject's skin. Likewise, the present disclosure provides a use of ammonia oxidizing bacteria, e.g., N. eutropha, e.g., optionally axenic N. eutropha described herein in the manufacture of a medicament for treating a skin condition, e.g., acne, e.g., acne vulgaris, on a subject's skin.

The present disclosure also provides a method of supplying nitric oxide to a subject, comprising positioning an effective dose of ammonia oxidizing bacteria, e.g., N. eutropha, e.g., optionally axenic N. eutropha described herein (e.g., strain D23) in close proximity to the subject. Similarly, the present disclosure provides ammonia oxidizing bacteria, e.g., N. eutropha, e.g., optionally axenic N. eutropha described herein (e.g., strain D23) for use in supplying nitric oxide to a subject. Likewise, the present disclosure provides a use of ammonia oxidizing bacteria, e.g., N. eutropha, e.g., optionally axenic N. eutropha described herein (e.g., strain D23) in the manufacture of a medicament or composition suitable for position in close proximity to a subject.

The present disclosure also provides a method of reducing body odor, comprising topically administering to a subject in need thereof an effective dose of ammonia oxidizing bacteria, e.g., N. eutropha, e.g., optionally axenic N. eutropha described herein (e.g., strain D23). Similarly, the present disclosure provides ammonia oxidizing bacteria, e.g., N. eutropha, e.g., optionally axenic N. eutropha described herein (e.g., strain D23) for use in reducing body odor in a subject. Likewise, the present disclosure provides a use of ammonia oxidizing bacteria, e.g., N. eutropha, e.g., optionally axenic N. eutropha described herein (e.g., strain D23) in the manufacture of a medicament or composition for reducing body odor.

The present disclosure also provides a method of treating or preventing a disease associated with low nitrite levels, comprising topically administering to a subject in need thereof a therapeutically effective dose of ammonia oxidizing bacteria, e.g., N. eutropha, e.g., optionally axenic N. eutropha described herein (e.g., strain D23). Similarly, the present disclosure provides a topical formulation of ammonia oxidizing bacteria, e.g., N. eutropha, e.g., optionally axenic N. eutropha described herein (e.g., strain D23) for use in treating a disease associated with low nitrite levels. Likewise, the present disclosure provides a use of ammonia oxidizing bacteria, e.g., N. eutropha, e.g., optionally axenic N. eutropha described herein (e.g., strain D23) in the manufacture of a topical medicament for treating a disease associated with low nitrite levels.

The present disclosure also provides a method of treating or preventing a skin disorder or skin infection, comprising topically administering to a subject in need thereof a therapeutically effective dose of ammonia oxidizing bacteria, e.g., N. eutropha, e.g., optionally axenic N. eutropha described herein (e.g., strain D23). Similarly, the present disclosure provides ammonia oxidizing bacteria, e.g., N. eutropha, e.g., optionally axenic N. eutropha described herein (e.g., strain D23) for use in treating a skin disorder in a subject. Likewise, the present disclosure provides a use of ammonia oxidizing bacteria, e.g., N. eutropha, e.g., optionally axenic N. eutropha described herein (e.g., strain D23) in the manufacture of a medicament for treating skin disorder. In embodiments, the skin disorder is acne, rosacea, eczema, psoriasis, or urticaria; the skin infection is impetigo.

While not wishing to be bound by theory, it is proposed that treatment of acne with a therapeutically effective dose of optionally axenic N. eutropha bacteria as described herein (e.g., strain D23) may involve the downregulation of inflammation due to NO generation; and/or limiting and/or inhibiting the spread and proliferation of Propionibacterium acnes associated with acne vulgaris through acidified nitrite and NO production.

For instance, the disclosure provides uses, for treating a condition or disease (e.g., inhibiting microbial growth on a subject's skin), a composition of ammonia oxidizing bacteria. In embodiments, the ammonia oxidizing bacteria may be used to treat, e.g., chronic wounds, acne, rosacea, eczema, psoriasis, uticaria, or skin infections.

The systems and methods of the present disclosure may provide for, or contain contents, to be useful for treating or preventing a skin disorder, treating or preventing a disease or condition associated with low nitrite levels, a treating or preventing body odor, treating to supply nitric oxide to a subject, or treating to inhibit microbial growth.

The systems and methods of the present disclosure may provide for reducing an amount of undesirable bacteria from an environment, e.g., a surface of a subject.

The systems and methods of the present disclosure may provide for, or contain contents, to be useful in a treatment of at least one of acne, eczema, psoriasis, uticaria, rosacea, skin infections and wounds, e.g., an infected wound.

In some embodiments, ammonia oxidizing bacteria may be used to treat a subject. Subjects may include an animal, a mammal, a human, a non-human animal, a livestock animal, or a companion animal.

In some embodiments, ammonia oxidizing bacteria described herein are used to inhibit the growth of other organisms. For instance, ammonia oxidizing bacteria may be well-adapted for long-term colonization of human skin, and in some embodiments it out-competes other bacteria that are undesirable on the skin. Undesirable skin bacteria include, e.g., those that can infect wounds, raise the risk or severity of a disease, or produce odors. Undesirable bacteria may be referred to as pathogenic bacteria. Certain undesirable skin bacteria include Staphylococcus aureus (S. aureus), e.g., methicillin resistant Staphylococcus aureus Pseudomonas aeruginosa (P. aeruginosa), Streptococcus pyogenes (S. pyogenes), Acinetobacter baumannii (A. baumannii), Propionibacteria, and Stenotrophomonas. The ammonia oxidizing bacteria described herein may out-compete other organisms by, e.g., consuming scarce nutrients, or generating byproducts that are harmful to other organisms, e.g., changing the pH of the skin to a level that is not conducive to the undesirable organism's growth.

Accordingly, the present disclosure provides, inter alia, a method of inhibiting microbial growth on a subject's skin, comprising topically administering to a human in need thereof an effective dose of ammonia oxidizing bacteria as described herein. Similarly, the present disclosure provides ammonia oxidizing bacteria as described herein for use in inhibiting microbial growth on a subject's skin. Likewise, the present disclosure provides a use of ammonia oxidizing bacteria in the manufacture of a medicament for inhibiting microbial growth on a subject's skin.

The present disclosure provides, inter alia, a method of changing a composition of a skin microbiome, e.g., modulating a composition of a skin microbiome, e.g., modulating or changing the proportions of the skin microbiome, in an environment, e.g., a surface, e.g., a surface of a subject. The method may comprise administering, e.g., applying, a preparation comprising ammonia oxidizing bacteria to an environment, e.g., a surface, e.g., a surface of a subject. In some embodiments, the amount and frequency of administration, e.g., application, may be sufficient to reduce the proportion of pathogenic bacteria on the surface of the skin. In some embodiments, the subject may be selected on the basis of the subject being in need of a reduction in the proportion of pathogenic bacteria on the surface of the skin.

The present disclosure may further provide obtaining a sample from the surface of the skin, and isolating DNA of bacteria in the sample. Sequencing of the DNA of bacteria in the sample may also be performed to determine or monitor the amount or proportion of bacteria in a sample of a subject.

The present disclosure may also provide for increasing the proportion of non-pathogenic bacteria on the surface. In some embodiments, the non-pathogenic bacteria may be commensal non-pathogenic bacteria. In some embodiments, the non-pathogenic bacteria may be of the Staphylococcus genus. In some embodiments, the non-pathogenic bacteria may be Staphylococcus epidermidis. In some embodiments, the non-pathogenic bacteria that is increased in proportion may be of the Staphylococcus genus, comprising at least about 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% Staphylococcus epidermidis.

The increase in the proportion of non-pathogenic bacteria may occur with a pre-determined period of time, e.g., in less than 1 day, 2 days, 3 days, 4 days, 5 days, 1 week, 2 weeks, 3 weeks, or 4 weeks, or in less than 1-3, 3-5, 5-7, 7-9, 5-10, 10-14, 12-18, 12-21, 21-28, 28-35, 35-42, 42-49, 49-56, 46-63, 63-70, 70-77, 77-84, 84-91 days.

The increase in the proportion of Staphylococcus bacteria, e.g., Staphylococcus epidermidis, may be observed in less than about 3 weeks, e.g., about 16 days, e.g., about 2 weeks.

The present disclosure may provide for decreasing the proportion of pathogenic bacteria, e.g., potentially pathogenic bacteria, e.g., disease-associated bacteria on the surface. In some embodiments, the pathogenic bacteria may be Propionibacteria. In some embodiments, the pathogenic bacteria may be Stenotrophomonas.

The decrease in the proportion of pathogenic bacteria may occur with a pre-determined period of time, e.g., in less than 1 day, 2 days, 3 days, 4 days, 5 days, 1 week, 2 weeks, 3 weeks, or 4 weeks, or in less than 1-3, 3-5, 5-7, 7-9, 5-10, 10-14, 12-18, 12-21, 21-28, 28-35, 35-42, 42-49, 49-56, 46-63, 63-70, 70-77, 77-84, 84-91 days.

The decrease in the proportion of Propionibacteria bacteria and/or Stenotrophomonas may be observed in less than about 3 weeks, e.g., about 16 days, e.g., about 2 weeks.

The present disclosure also provides a method of supplying nitric oxide to a subject, comprising positioning an effective dose of ammonia oxidizing bacteria described herein in close proximity to the subject. Similarly, the present disclosure provides ammonia oxidizing bacteria as described herein for use in supplying nitric oxide to a subject. Likewise, the present disclosure provides a use of in the manufacture of a medicament or composition suitable for position in close proximity to a subject.

The present disclosure also provides a method of reducing body odor, comprising topically administering to a subject in need thereof an effective dose of ammonia oxidizing bacteria described herein. Similarly, the present disclosure provides ammonia oxidizing bacteria as described herein for use in reducing body odor in a subject. Likewise, the present disclosure provides a use of ammonia oxidizing bacteria as described herein in the manufacture of a medicament or composition for reducing body odor.

The present disclosure also provides a method of treating or preventing a disease associated with low nitrite levels, comprising topically administering to a subject in need thereof a therapeutically effective dose of ammonia oxidizing bacteria described herein. Similarly, the present disclosure provides a topical formulation of ammonia oxidizing bacteria as described herein for use in treating a disease associated with low nitrite levels. Likewise, the present disclosure provides a use of ammonia oxidizing bacteria as described herein in the manufacture of a topical medicament for treating a disease associated with low nitrite levels.

The present disclosure also provides a method of treating or preventing a skin disorder or skin infection, comprising topically administering to a subject in need thereof a therapeutically effective dose of ammonia oxidizing bacteria as described herein. Similarly, the present disclosure provides ammonia oxidizing bacteria as described herein for use in treating a skin disorder in a subject. Likewise, the present disclosure provides a use of ammonia oxidizing bacteria as described herein in the manufacture of a medicament for treating skin disorder. In embodiments, the skin disorder is acne, rosacea, eczema, psoriasis, or urticaria; the skin infection is impetigo.

While not wishing to be bound by theory, it is proposed that treatment of rosacea with a therapeutically effective dose of a therapeutically effective dose of ammonia oxidizing bacteria, e.g., optionally axenic *N. eutropha* bacteria as described herein (e.g., strain D23) may involve downregulation due to NO generation. This may be due to expression of Kazal-type KLK5/KLK7 inhibitor(s) that may reduce formation of the human cathelicidin peptide LL-37 from its precursor propeptide hCAP18.

While not wishing to be bound by theory, it is proposed that treatment of eczema and/or atopic dermatitis with a therapeutically effective dose of ammonia oxidizing bacteria, e.g., optionally axenic *N. eutropha* bacteria as described herein (e.g., strain D23) may involve downregulation of inflammation due to NO generation; and/or limiting and/or inhibiting the spread and proliferation of *S. aureus* and other skin pathogens often associated with very high colonization rates and skin loads in atopic dermatitis through acidified nitrite and NO production.

While not wishing to be bound by theory, it is proposed that treatment of psoriasis with a therapeutically effective dose of ammonia oxidizing bacteria, e.g., optionally axenic *N. eutropha* bacteria as described herein (e.g., strain D23) may involve downregulation of inflammation due to NO generation and reduction in formation of human cathelicidin peptide LL-37.

While not wishing to be bound by theory, it is proposed that treatment of psoriasis with a therapeutically effective dose of ammonia oxidizing bacteria, e.g., optionally axenic *N. eutropha* bacteria as described herein (e.g., strain D23) may involve downregulation of inflammation due to NO generation.

While not wishing to be bound by theory, it is proposed that treatment of impetigo or other skin and soft tissue infections with a therapeutically effective dose of ammonia oxidizing bacteria, e.g., optionally axenic *N. eutropha* bacteria as described herein (e.g., strain D23) may involve limiting and/or inhibiting the spread and proliferation of *S. aureus* and *S. pyogenes*.

The present disclosure also provides a method of promoting wound healing, comprising administering to a wound an effective dose of ammonia oxidizing bacteria, e.g., optionally axenic *N. eutropha* bacteria as described herein (e.g., strain D23). Similarly, the present disclosure provides ammonia oxidizing bacteria, e.g., optionally axenic *N. eutropha* as described herein (e.g., strain D23) for use in treating a wound. Likewise, the present disclosure provides a use of ammonia oxidizing bacteria, e.g., optionally axenic *N. eutropha* as described herein (e.g., strain D23) in the manufacture of a medicament or a composition for treating a wound.

Ammonia oxidizing bacteria, e.g., optionally axenic *N. eutropha* as described herein (e.g., strain D23) may be used to promote wound healing in a patient that has an impaired healing ability, e.g., a diabetic patient.

In some embodiments, this disclosure provides methods of using ammonia oxidizing bacteria, e.g., optionally axenic *N. eutropha* as described herein (e.g., strain D23) to prevent a disease or disorder, e.g., a skin disorder. Prevention, in certain embodiments, means reducing the risk of a subject developing a disease, compared to a similar untreated subject. The risk need not be reduced to zero.

In some embodiments, the present disclosure provides a method of treating a wound by applying a bandage comprising *N. eutropha* to the wound. Also provided are methods of producing such a bandage. The bandage may comprise, for example, an adhesive portion to affix the bandage to undamaged skin near the wound and a soft, flexible portion to cover or overlay the wound. In some embodiments, the bandage contains no other organisms but *N. eutropha*.

The bandage may be made of a permeable material that allows gasses like oxygen and carbon dioxide to reach the *N. eutropha* when the bandage is applied to the wound. In certain embodiments, the bandage comprises nutrients for *N. eutropha* such as ammonium, ammonia, urea, or trace minerals. In certain embodiments, the bandage comprises an antibiotic to which the *N. eutropha* is resistant. The antibiotic resistance may arise from one or more endogenous resistance gene or from one or more transgenic.

In some embodiments, the ammonia oxidizing bacteria, e.g., *N. eutropha* is administered at a dose of about $10^8$-$10^9$ CFU, $10^9$-$10^{10}$ CFU, $10^{10}$-$10^{11}$ CFU, or $10^{11}$-$10^{12}$ CFU per application. In some embodiments, the ammonia oxidizing bacteria, e.g., *N. eutropha* is administered topically at a dose of about $10^{10}$-$10^{11}$ CFU, e.g., about $1\times10^{10}$-$5\times10^{10}$, $1\times10^{10}$-$3\times10^{10}$, or $1\times10^{10}$-$2\times10^{10}$ CFU. In some embodiments, the ammonia oxidizing bacteria, e.g., *N. eutropha* is administered topically at a dose of about $2\times10^9$, $4\times10^9$ or $8\times10^9$ CFU.

In some embodiments, the ammonia oxidizing bacteria, e.g., *N. eutropha* is administered in a volume of about 1-2, 2-5, 5-10, 10-15, 12-18, 15-20, 20-25, or 25-50 ml per dose. In some embodiments, the solution is at a concentration of about $10^8$-$10^9$, $10^9$-$10^{10}$, or $10^{10}$-$40^{11}$ CFUs/ml. In some embodiments, the ammonia oxidizing bacteria, e.g., *N. eutropha* is administered as two 15 ml doses per day, where each dose is at a concentration of $10^9$ CFU/ml. In some embodiments, the ammonia oxidizing bacteria, e.g., *N. eutropha* is administered at a concentration of $2\times10^9$, $4\times10^9$ or $8\times10^9$ CFU/L. In some embodiments, the ammonia oxidizing bacteria, e.g., *N. eutropha* is administered at a concentration of $2\times10^9$, $4\times10^9$ or $8\times10^9$ CFU/mL.

In some embodiments, the preparation of ammonia oxidizing bacteria may comprise an ammonia oxidizing bacteria having a dose as described herein, in combination with ammonia, for example, an ammonia concentration of between about 0.01 mM to about 100 mM. For example, the ammonia concentration may be about 0.01, 0.05, 0.1, 0.2, 0.4, 0.5, 0.6, 0.8, 1.0, 1.2, 1.4, 1.6, 1.8, 2.0, 2.2, 2.4, 2.5, 2.6, 2.8, 3.0, 3.2, 3.4, 3.6, 3.8, 4.0, 4.2, 4.4, 4.5, 4.6, 4.8, 5.0, 5.2, 5.4, 5.6, 5.8, 6.0, 6.2, 6.4, 6.6, 6.8, 7.0, 7.2, 7.4, 7.6, 7.8, 8.0, 8.2, 8.4, 8.6, 8.8, 10.0, 15.0, 20.0, 25.0, 30.0, 35.0, 40.0, 45.0, 50.0, 55.0, 60.0, 65.0, 70.0, 75.0, 80.0, 85.0, 90.0, 95.0, 100.0 mM.

In some embodiments, ammonia oxidizing bacteria, e.g., the *N. eutropha* is administered once, twice, three, or four times per day. In some embodiments, ammonia oxidizing bacteria, e.g., the *N. eutropha* is administered once, twice, three, four, five, or six times per week. In some embodiments, ammonia oxidizing bacteria, e.g., the *N. eutropha* is administered shortly after bathing. In some embodiments, ammonia oxidizing bacteria, e.g., the *N. eutropha* is administered shortly before sleep.

In certain aspects, the present disclosure provides combination therapies comprising ammonia oxidizing bacteria, e.g., a *N. eutropha* and a second therapeutic. For instance, the disclosure provides physical admixtures of the two (or more) therapies are physically admixed. In other embodiments, the two (or more) therapies are administered in combination as separate formulation. The second therapy may be, e.g., a pharmaceutical agent, surgery, or any other medical approach that treats the relevant disease or disorder. The following paragraphs describe combination therapies capable of chronic wounds, acne, rosacea, eczema, and psoriasis.

In a combination therapy capable of treating chronic wounds, the second therapy may comprise, e.g., an antibiotic (e.g., topical or systemic, and bacteriocidal or bacteriostatic) such as Penicillins, cephalosporins, polymyxins, rifamycins, lipiarmycins, quinolones, sulfonamides, macrolides, lincosamides, tetracyclines, cyclic lipopeptides, glycylcyclines, oxazolidinones, and lipiarmycins; angiotensin, angiotensin analogues; debridement; drainage; wound irrigation; negative pressure wound therapy; application of heat; arterial revascularization; hyperbaric oxygen therapy; antioxidants such as ascorbic acid, glutathione, lipoic acid, carotenes, α-tocopherol, or ubiquinol; low level laser therapy; gastrocnemius recession; growth factors such as vascular endothelial growth factor, insulin-like growth factor 1-2, platelet derived growth factor, transforming growth factor-β, or epidermal growth factor; application of autologous platelets such as those that secrete one or more growth factors such as vascular endothelial growth factor, insulin-like growth factor 1-2, platelet derived growth factor, transforming growth factor-β, or epidermal growth factor; implantation of cultured keratinocytes; allograft; collagen, for instance a dressing comprising collagen; or protease inhibitors such as SLPI. The combination therapy may comprise one or more of the above-mentioned treatments.

In a combination therapy capable of treating acne, the second therapy may comprise, e.g., a medication (e.g., systemic or topical) such as Benzoyl peroxide, antibiotics (such as erythromycin, clindamycin, or a tetracycline), Salicylic acid, hormones (e.g., comprising a progestin such as desogestrel, norgestimate or drospirenone), retinoids such as tretinoin, adapalene, tazarotene, or isotretinoin. The second therapy may also be a procedure such as comedo extraction, corticosteroid injection, or surgical lancing. The combination therapy may comprise one or more of the above-mentioned treatments. The combination therapy may comprise one or more of the therapies described in Table 1, above, for example an acne treatment selected from the group consisting of a topical retinoid, azaelaic acid, salicylic acid, a topical antimicrobial, an oral antibiotic, benzoyl peroxide, an oral anti-androgen, an oral isotretinoin, and combinations thereof.

For instance, the disclosure provides physical admixtures of the two (or more) therapies are physically admixed. In other embodiments, the two (or more) therapies are administered in combination as separate formulation. The therapies may be administered as "simultaneous" or "concomitant" or "concurrent delivery". In other embodiments, the delivery of one treatment ends before the delivery of the other treatment begins. This is sometimes referred to herein as "successive" or "sequential delivery." The beginning of the treatments or therapies may begin before or after diagnosis of a subject as having a skin condition or disorder. The beginning of treatment with ammonia oxidizing bacteria may begin where there has been insufficient response to another treatment. The method may comprise discontinuing use of the other treatment, and/or continuing use of the other treatment, in conjunction with beginning administration of ammonia oxidizing bacteria.

The therapy, e.g., acne treatment such as those listed in Table 1, above, may be administered for a period of time prior to commencing administration of the ammonia oxidizing bacteria. The therapy, e.g., acne treatment such as those listed in Table 1, above may be continued throughout a time period for administration of the ammonia oxidizing bacteria. In certain embodiments, the therapy, e.g., acne treatment such as those listed in Table 1, above, may be ceased during the administration of the ammonia oxidizing bacteria. The therapy, e.g., acne treatment such as those listed in Table 1, above, may be continued throughout administration of the ammonia oxidizing bacteria. The therapy, e.g., acne treatment such as those listed in Table 1, above, may be commenced subsequent to ceasing administration of ammonia oxidizing bacteria.

In a combination therapy capable of treating rosacea, the second therapy may comprise, e.g., an antibiotic, e.g., an oral tetracycline antibiotic such as tetracycline, doxycycline, or minocycline, or a topical antibiotic such as metronidazole; azelaic acid; alpha-hydroxy acid; isotretinoin can be prescribed; sandalwood oil; clonidine; beta-blockers such as nadolol and propranolol; antihistamines (such as loratadine); mirtazapine; methylsulfonylmethane or silymarin, optionally in combination with each other; lasers such as dermatological vascular laser or $CO_2$ laser; or light therapies such as intense pulsed light, low-level light therapy or photorejuvenation. The combination therapy may comprise one or more of the above-mentioned treatments.

In a combination therapy capable of treating eczema, the second therapy may comprise, e.g., a corticosteroid such as hydrocortisone or clobetasol propionate, immunosuppressants (topical or systemic) such as pimecrolimus, tacrolimus, ciclosporin, azathioprine or methotrexate, or light therapy such as with ultraviolet light. The combination therapy may comprise one or more of the above-mentioned treatments.

In a combination therapy capable of treating psoriasis, the second therapy may comprise, e.g., a corticosteroid such as desoximetasone; a retinoid; coal tar; Vitamin D or an analogue thereof such as paricalcitol or calcipotriol; moisturizers and emollients such as mineral oil, vaseline, calcipotriol, decubal, or coconut oil; dithranol; or fluocinonide. The combination therapy may comprise one or more of the above-mentioned treatments.

While not wishing to be bound by theory, it is proposed that treatment of psoriasis with a therapeutically effective dose of ammonia oxidizing bacteria described herein may involve downregulation of inflammation due to NO generation and reduction in formation of human cathelicidin peptide LL-37.

While not wishing to be bound by theory, it is proposed that treatment of psoriasis with a therapeutically effective dose of ammonia oxidizing bacteria as described herein may involve downregulation of inflammation due to NO generation.

While not wishing to be bound by theory, it is proposed that treatment of impetigo or other skin and soft tissue infections with a therapeutically effective dose of ammonia oxidizing bacteria as described herein may involve limiting and/or inhibiting the spread and proliferation of *Staphylococcus aureus* (*S. aureus*), e.g., methicillin resistant *Staphylococcus aureus*, *Pseudomonas aeruginosa* (*P. aeruginosa*), *Streptococcus pyogenes* (*S. pyogenes*), *Acinetobacter baumannii* (*A. baumannii*), *Propionibacteria*, and *Stenotrophomonas*.

The present disclosure also provides a method of promoting wound healing, comprising administering to a wound an effective dose of ammonia oxidizing bacteria as described herein. Similarly, the present disclosure provides ammonia oxidizing bacteria as described herein for use in treating a wound. Likewise, the present disclosure provides a use of ammonia oxidizing bacteria as described herein in the manufacture of a medicament or a composition for treating a wound.

In some embodiments, this disclosure provides methods of using ammonia oxidizing bacteria as described herein to prevent a disease or disorder, e.g., a skin disorder. Prevention, in certain embodiments, means reducing the risk of a subject developing a disease, compared to a similar untreated subject. The risk need not be reduced to zero.

Individuals having a reduced bathing frequency, such as astronauts, submarine crew members, military personnel during a campaign, civilian workers in remote locations, refugees, bedridden individuals and many others may maintain healthier skin by maintaining ammonia oxidizing bacteria on the skin. With regard to bedridden individuals, the ammonia oxidizing bacteria in some embodiments reduces the frequency or severity of bed sores by augmenting inadequate circulation.

It is appreciated that many modern degenerative diseases may be caused by a lack of NO species, and that ammonia oxidizing bacteria on the external skin can supply those species by diffusion, and that application of ammonia oxidizing bacteria to the skin resolves long standing medical conditions. In certain embodiments, ammonia oxidizing bacteria are applied to a subject to offset modern bathing practices, especially with anionic detergents remove ammonia oxidizing bacteria from the external skin.

One suitable method of topical application to apply sufficient ammonia oxidizing bacteria and then wear sufficient clothing so as to induce sweating. However, many people will want to derive the benefits of ammonia oxidizing bacteria while maintaining their current bathing habits, in which case, a culture of the bacteria can be applied along with sufficient substrate for them to produce NO. A nutrient solution approximating the inorganic composition of human sweat can be used for this purpose. Using bacteria adapted to media approximating human sweat minimizes the time for them to adapt when applied. Since sweat evaporates once excreted onto the skin surface, using a culture media that has a higher ionic strength is desirable. A concentration approximately twice that of human sweat is suitable, but other conditions are also contemplated. Ammonia oxidizing bacteria's nutritional needs are typically met with $NH_3$ or urea, $O_2$, $CO_2$, and minerals. In some embodiments, the substrate comprises trace minerals including iron, copper, zinc, cobalt, molybdenum, manganese, sodium, potassium, calcium, magnesium, chloride, phosphate, sulfate, or any combination thereof.

In some embodiments, the present disclosure provides a method of treating a wound by applying a bandage comprising ammonia oxidizing bacteria to the wound. Also provided are methods of producing such a bandage. The bandage may comprise, for example, an adhesive portion to affix the bandage to undamaged skin near the wound and a soft, flexible portion to cover or overlay the wound. In some embodiments, the bandage contains no other organisms but ammonia oxidizing bacteria. The bandage may made of a permeable material that allows gasses like oxygen and carbon dioxide to reach the ammonia oxidizing bacteria when the bandage is applied to the wound. In certain embodiments, the bandage comprises nutrients for ammonia oxidizing bacteria such as ammonium, ammonia, urea, or trace minerals. In certain embodiments, the bandage comprises an antibiotic to which the ammonia oxidizing bacteria is resistant. The antibiotic resistance may arise from one or more endogenous resistance gene or from one or more transgenes.

In some embodiments, the ammonia oxidizing bacteria, e.g., a preparation of ammonia oxidizing bacteria, is administered at a dose of about $10^8$-$10^9$ CFU, $10^9$-$10^{10}$ CFU, $10^{10}$-$10^{11}$ CFU, or $10^{11}$-$10^{12}$ CFU per application or per day. In some embodiments, the ammonia oxidizing bacteria is administered topically at a dose of about $10^9$-$10^{10}$ CFU, e.g., about $1\times10^9$-$5\times10^9$, $1\times10^9$-$3\times10^9$, or $1\times10^9$-$10\times10^9$ CFU.

In some embodiments, the ammonia oxidizing bacteria is administered in a volume of about 1-2, 2-5, 5-10, 10-15, 12-18, 15-20, 20-25, or 25-50 ml per dose. In some embodiments, the solution is at a concentration of about $10^8$-$10^9$, $10^9$-$10^{10}$, or $10^{10}$-$10^{11}$ CFU/ml. In some embodiments, the ammonia oxidizing bacteria is administered as two 15 ml doses per day, where each dose is at a concentration of $10^9$ CFU/ml.

In some embodiments, the ammonia oxidizing bacteria is administered once, twice, three, or four times per day. In some embodiments, the ammonia oxidizing bacteria is administered once, twice, three, four, five, or six times per week. In some embodiments, the ammonia oxidizing bacteria is administered shortly after bathing. In some embodiments, the ammonia oxidizing bacteria is administered shortly before sleep.

In some embodiments, the ammonia oxidizing bacteria is administered for about 1-3, 3-5, 5-7, 7-9, 5-10, 10-14, 12-18, 12-21, 21-28, 28-35, 35-42, 42-49, 49-56, 46-63, 63-70, 70-77, 77-84, 84-91 days, e.g., for about 1 month, for about 2 months, for about 3 months. In some embodiments, the ammonia oxidizing bacteria is administered for an indefinite period of time, e.g., greater than one year, greater than 5 years, greater than 10 years, greater than 15 years, greater than 30 years, greater than 50 years, greater than 75 years.

5. Use of Microbiome Compatible Cosmetics, e.g, Cleanser, Shampoo, and/or Conditioner, with Administration of Ammonia Oxidizing Bacteria The systems and methods of the disclosure provide, inter alia, cosmetic products, e.g., finished cosmetic products that may be considered to be "biome-friendly" or "biome-compatible." The systems and methods of the disclosure may provide for use of cosmetic products, e.g., finished cosmetic products, that may be used in combination with bacteria, e.g., non-pathogenic bacteria, e.g., ammonia oxidizing bacteria, which may be used in the form of a preparation or composition to be applied to a subject. Table 4 provides for a list of components, one or more of which may be provided in a preparation or composition and that may provide for a biome-friendly or biome compatible product.

TABLE 4

Potential components of a biome-friendly product.

| Component | Category |
| --- | --- |
| Decyl glucoside | Surfactant/Cleanser |
| cocamidopropyl betaine (ColaTeric COAB) | Surfactant/Cleanser |
| polyethylene sorbitol ester (e.g., Tween 80) | Surfactant/Cleanser |
| ethoxylated lauryl alcohol (RhodaSurf 6 NAT) | Surfactant/Cleanser |
| sodium laureth sulfate/lauryl glucoside/ cocamidopropyl betaine (Plantapon 611 L UP) | Surfactant/Cleanser |
| sodium laureth sulfate (e.g., RhodaPex ESB 70 NAT) | Surfactant/Cleanser |
| alkyl polyglucoside (e.g., Plantaren 2000 N UP) | Surfactant/Cleanser |
| sodium laureth sulfate (Plantaren 200) | Surfactant/Cleanser |
| Dr. Bronner's Castile soap | Surfactant/Cleanser |
| Dr. Bronner's baby soap | Surfactant/Cleanser |
| Lauramine oxide (ColaLux Lo) | Surfactant/Cleanser |

TABLE 4-continued

Potential components of a biome-friendly product.

| Component | Category |
|---|---|
| sodium dodecyl sulfate (SDS) | Surfactant/Cleanser |
| polysulfonate alkyl polyglucoside (PolySufanate 160 P) | Surfactant/Cleanser |
| sodium lauryl sulfate (Stepanol-WA Extra K) | Surfactant/Cleanser |
| Sodium Laurylglucosides Hydroxypropylsulfonate (Suga ®nate 160NC) | Surfactant/Cleanser (bio-based) |
| lauramidopropyl betaine (Cola ®Teric LMB) | Surfactant/Cleanser |
| Cocamidopropyl hydroxysultaine (Cola ®Teric CBS) | Surfactant/Cleanser |
| disodium cocoamphodiacetate (Cola ®Teric CDCX-LV) | Surfactant/Cleanser |
| sodium laurylglucosides hydroxypropyl phosphate (Suga ®Fax D12). | Surfactant/Cleanser |
| sodium lauroyl methyl isethionate (Iselux ® LQ-CLR-SB) | Surfactant/Cleanser |
| sodium methyl cocoyl taurate (Pureact WS Conc.) | Surfactant/Cleanser |
| Aqua (and) Sodium Lauroyl Methyl Isethionate (and) Cocamidopropyl Betaine (and) Sodium Cocoyl Isethionate (and) Sodium Methyl Oleoyl Taurate (Iselux ®SFS-SB) | Surfactant/Cleanser |
| Coco glucoside (Plantacare 818) | Surfactant/Cleanser (bio-based) |
| Sodium cocoyl-glycinate | Surfactant/Cleanser (bio-based) |
| Caprylic/Capric triglyceride (Myritol) | Conditioner |
| Cationic guar (N-Hance) | Conditioning/de-tangling |
| Coconut oil | Conditioning |
| Apple saccharides, e.g., *plyrus malus* (apple) fruit extract e.g., *plyrus malus* (apple) fruit extract and glycerin (Botanimoist AMS); | Humectant |
| Hydrolyzed *quinoa* | Moisture binding |
| Hydrolyzed *adansonia digitata* (Baobab) Seed Protein | Softener |
| Hydroxyethylcellulose (Natrosol) | Viscosity modifier |
| Hydroxypropylcellulose (Klucel MCS) | Viscosity modifier/film former |
| Hydrolyzed soy protein (Soy Tein NPNF) | Fragrance |
| Natural Rose Hydrosol | Fragrance |
| Natural Rose Water | Fragrance |
| *Damascena* flower water | Fragrance |
| Coco-glucoside and glyceryl oleate (Lamisoft ® PO 65) | Lipid layer enhancer |
| Polysorbate 80 | Emulsifier |
| Citric acid | pH stabilizer |

The cosmetic products that may be used with the present disclosure may be, or include, or be disposed in any one or more of a baby product, e.g., a baby shampoo, a baby lotion, a baby oil, a baby powder, a baby cream; a bath preparation, e.g., a bath oil, a tablet, a salt, a bubble bath, a bath capsule; an eye makeup preparation, e.g., an eyebrow pencil, an eyeliner, an eye shadow, an eye lotion, an eye makeup remover, a mascara; a fragrance preparation, e.g., a colognes, a toilet water, a perfume, a powder (dusting and talcum), a sachet; hair preparations, e.g., hair conditioners, hair sprays, hair straighteners, permanent waves, rinses, shampoos, tonics, dressings, hair grooming aids, wave sets; hair coloring preparations, e.g., hair dyes and colors, hair tints, coloring hair rinses, coloring hair shampoos, hair lighteners with color, hair bleaches; makeup preparations, e.g., face powders, foundations, leg and body paints, lipstick, makeup bases, rouges, makeup fixatives; manicuring preparations, e.g., basecoats and undercoats, cuticle softeners, nail creams and lotions, nail extenders, nail polish and enamel, nail polish and enamel removers; oral hygiene products, e.g., dentrifices, mouthwashes and breath fresheners; bath soaps, e.g., foaming body cleansers, and detergents, deodorants, douches, feminine hygiene deodorants; shaving preparations, e.g., aftershave lotions, beard softeners, talcum, preshave lotions, shaving cream, shaving soap; skin care preparations, e.g., cleansing, depilatories, face and neck, body and hand, foot powders and sprays, moisturizing, night preparations, paste masks, skin fresheners; and suntan preparations, e.g., gels, creams, and liquids, and indoor tanning preparations.

The cosmetic products may comprise any one or more of the ingredients disclosed herein, e.g., the ingredients disclosed in Table 4.

The cosmetic product or finished cosmetic product may comprise, consist essentially or consist of the following composition(s), as shown in Table 5, below:

TABLE 5

| Component | Preferred Concentration | Preferred Concentration Range | Description |
|---|---|---|---|
| Klucel MCS (Hydroxypropyl Cellulose) | 1.5% | 1.0-2.0% | Viscosity Modifier |
| Cocamidopropyl Betaine | 20.0% | 15.0%-30.0% | Cleanser/Surfactant |
| Decyl Glucoside | 7.5% | 0.0-10.0% | Cleanser/Surfactant |
| Botanimoist AMG (Glycerine + Apple extract | 3.0% | 0.0-4.0% | Humectant |
| Hydrolyzed Baobab Protein | 2.0% | 0.0-4.0% | Skin Conditioner |
| Natural Rose Hydrosol | 10.0% | 0.0-15.0% | Fragrance |

This product may be used as a cosmetic product, e.g., for a shampoo, e.g., for a body wash. The product includes water to make 100%. In some embodiments, the cosmetic product, e.g., shampoo, may or may not contain citric acid, and the citric acid may be needed in cases where pH stabilization is required or desired.

The cosmetic product or finished cosmetic product may comprise, consist essentially or consist of the following composition(s), as shown in Table 6, below:

TABLE 6

| Component | Preferred Concentration | Preferred Concentration Range | Description |
|---|---|---|---|
| Klucel MCS (Hydroxypropyl Cellulose) | 0.25% | 0.10-0.50% | Viscosity modifier |
| Cocamidopropyl betaine | 8.00% | 5.0-12.0% | Cleanser/Surfactant |
| Decyl Glucoside | 4.0% | 0.0-6.0% | Cleanser/Surfactant |
| Botanimoist AMG (Glycerine + Apple extract) | 2.0% | 0.0%-4.0% | Humectant |
| Hydrolyzed *Quinoa* Protein conditioner | 1.0% | 0.0-3.0% | Skin Conditioner |
| Natural Rose Hydrosol | 7.5% | 0.0%-10.0% | Fragrance |
| Citric Acid | Added as needed, usually in very small amounts, for pH stabilization | As needed, usually in very small amounts, for pH stabilization | pH stabilizer |

This product may be used as a cosmetic product, e.g., for a cleanser, e.g., for a body, hands, or face. The product includes water to make 100%. In some embodiments, the cosmetic product, e.g., cleanser, may or may not contain citric acid, and the citric acid may be needed in cases where pH stabilization is required or desired.

Other hydrolyzed protein may be used, and may include, but is not limited to rice, soy baobab, and oat. Other fragrance alternatives may be contemplated.

The finished cosmetic product may have one or more, or all the properties described herein.

Other products are contemplated, including hair and/or skin conditioners that may comprise, consist essentially of, or consist of the following, as shown in Table 7, below:

TABLE 7

| Component | Preferred Concentration | Preferred Concentration Range | Description |
| --- | --- | --- | --- |
| Hydroxypropyl cellulose (Klucel MCS) | 1.5% | 0.50-2.50% | Viscosity modifier/film former |
| Cationic guar (N-Hance) | 0.5% | 0.10-1.5% | Conditioning and detangling |
| Coconut oil | 1.0% | 0.0-3.0% | Conditioning |
| Fragrance | As desired | As desired | |

The product includes water to make 100%. In some embodiments, the cosmetic product, e.g., conditioner, may or may not contain citric acid, and may be needed in cases where pH stabilization is required or desired.

6. Mechanism of Therapeutic Benefit

While not wishing to be bound by theory, it is believed that one or more of the following mechanisms contributes to the beneficial effect of ammonia oxidizing bacteria, e.g., *N. eutropha* in treating the diseases and conditions discussed herein. Additional mechanistic details are found in International Application WO/2005/030147, which is herein incorporated by reference in its entirety.

In order to understand the beneficial aspects of these bacteria, it is helpful to understand angiogenesis. All body cells, except those within a few hundred microns of the external air, receive all metabolic oxygen from the blood supply. The oxygen is absorbed by the blood in the lung, is carried by red blood cells as oxygenated hemoglobin to the peripheral tissues, where it is exchanged for carbon dioxide, which is carried back and exhaled from the lung. Oxygen must diffuse from the erythrocyte, through the plasma, through the endothelium and through the various tissues until it reached the mitochondria in the cell which consumes it. The human body contains about 5 liters of blood, so the volume of the circulatory system is small compared to that of the body. Oxygen is not actively transported. It passively diffuses down a concentration gradient from the air to the erythrocyte, from the erythrocyte to the cell, and from the cell to cytochrome oxidase where it is consumed. The concentration of oxygen at the site of consumption is the lowest in the body, and the $O_2$ flux is determined by the diffusion resistance and the concentration gradient. Achieving sufficient oxygen supply to all the peripheral tissues requires exquisite control of capillary size and location. If the spacing between capillaries were increased, achieving the same flux of oxygen would require a larger concentration difference and hence a lower $O_2$ concentration at cytochrome oxidase. With more cells between capillaries, the $O_2$ demand would be greater. If the spacing between capillaries were decreased, there would be less space available for the cells that perform the metabolic function of the organ.

In certain aspects, it is appreciated that NO from ammonia oxidizing bacteria is readily absorbed by the outer skin and converted into S-nitrosothiols since the outer skin is free from hemoglobin. M. Stucker et al. have shown that the external skin receives all of its oxygen from the external air in "The cutaneous uptake of atmospheric oxygen contributes significantly to the oxygen supply of human dermis and epidermis. (Journal of Physiology (2002), 538.3, pp. 985-994.) This is readily apparent, because the external skin can be seen to be essentially erythrocyte free. There is circulation of plasma through these layers because they are living and do require the other nutrients in blood, just not the oxygen. S-nitrosothiols formed are stable, can diffuse throughout the body, and constitute a volume source of authentic NO and a source of NO to transnitrosate protein thiols.

In some aspects, it is appreciated that capillary rarefaction may be one of the first indications of insufficient levels of NO. F. T. Tarek et al. have shown that sparse capillaries, or capillary rarefaction, is commonly seen in people with essential hypertension. (Structural Skin Capillary Rarefaction in Essential Hypertension. Hypertension. 1999; 33:998-1001

A great many conditions are associated with the capillary density becoming sparser. Hypertension is one, and researchers reported that sparse capillaries are also seen in the children of people with essential hypertension, and also in people with diabetes. Significant complications of diabetes are hypertension, diabetic nephropathy, diabetic retinopathy, and diabetic neuropathy. R. Candido et al. have found that the last two conditions are characterized by a reduction in blood flow to the affected areas prior to observed symptoms. (Haemodynamics in microvascular complications in type 1 diabetes. Diabetes Metab Res Rev 2002; 18: 286-304.) Reduced capillary density is associated with obesity, and simple weight loss increases capillary density as shown by A Philip et al. in "Effect of Weight Loss on Muscle Fiber Type, Fiber Size, Capilarity, and Succinate Dehydrogenase Activity in Humans. The Journal of Clinical Endocrinology & Metabolism Vol. 84, No. 11 4185-4190, 1999.

Researchers have shown that in primary Raynaud's phenomena (PRP), the nailfold capillaries are sparser (slightly) than in normal controls, and more abundant than in patients that have progressed to systemic sclerosis (SSc). M. Bukhari, Increased Nailfold Capillary Dimensions In Primary Raynaud's Phenomenon And Systemic Sclerosis. British Journal of Rheumatology, Vol. 24 No 35: 1127-1131, 1996. They found that the capillary density decreased from 35 loops/mm$^2$ (normal controls) to 33 (PRP), to 17 (SSc). The average distance between capillary limbs was 18μ, 18μ, and 30μ for controls, PRP and SSc, respectively.

In certain aspects, it is appreciated that the mechanism that the body normally uses to sense "hypoxia" may affect the body's system that regulates capillary density. According to this aspect of the invention, a significant component of "hypoxia" is sensed, not by a decrease in $O_2$ levels, but rather by an increase in NO levels. Lowering of basal NO levels interferes with this "hypoxia" sensing, and so affects many bodily functions regulated through "hypoxia." For Example, anemia is commonly defined as "not enough hemoglobin," and one consequence of not enough hemoglobin is "hypoxia", which is defined as "not enough oxygen." According to some aspects, these common definitions do not account for the nitric oxide mediated aspects of both conditions.

At rest, acute isovolemic anemia is well tolerated. A ⅔ reduction in hematocrit has minimal effect on venous return PvO2, indicating no reduction in either $O_2$ tension or delivery throughout the entire body. Weiskopf et al. Human cardiovascular and metabolic response to acute, severe isovolemic anemia. JAMA 1998, vol 279, No. 3, 217-221. At 50% reduction (from 140 to 70 g Hb/L), the average PvO2 (over 32 subjects) declined from about 77% to about 74% (of saturation). The reduction in $O_2$ capacity of the blood is compensated for by vasodilatation and tachycardia with the heart rate increasing from 63 to 85 bpm. That the compensation is effective is readily apparent, however, the mechanism is not. A typical explanation is that "hypoxia" sensors detected "hypoxia" and compensated with vasodilatation and tachycardia. However, there was no "hypoxia" to detect. There was a slight decrease in blood lactate (a marker for anaerobic respiration) from 0.77 to 0.62 mM/L indicating less anaerobic respiration and less "hypoxia." The 3% reduction in venous return PvO2 is the same level of "hypoxia" one would get by ascending 300 meters in altitude (which typically does not produce tachycardia). With the $O_2$ concentration in the venous return staying the same, and the $O_2$ consumption staying the same, there is no place in the body where there is a reduction in $O_2$ concentration. Compensation during isovolemic anemia may not occur because of $O_2$ sensing.

Thus the vasodilatation that is observed in acute isovolemic anemia may be due to the increased NO concentration at the vessel wall. NO mediates dilatation of vessels in response to shear stress and other factors. No change in levels of NO metabolites would be observed, because the production rate of NO is unchanged and continues to equal the destruction rate. The observation of no "hypoxic" compensation with metHb substitution can be understood because metHb binds NO just as Hb does, so there is no NO concentration increase with metHb substitution as there is with Hb withdrawal.

Nitric oxide plays a role in many metabolic pathways. It has been suggested that a basal level of NO exerts a tonal inhibitory response, and that reduction of this basal level leads to a dis-inhibition of those pathways. Zanzinger et al. have reported that NO has been shown to inhibit basal sympathetic tone and attenuate excitatory reflexes. (Inhibition of basal and reflex-mediated sympathetic activity in the RVLM by nitric oxide. Am. J. Physiol. 268 (Regulatory Integrative Comp. Physiol. 37): R958-R962, 1995.)

In some aspects, it is appreciated that one component of a volume source of NO is low molecular weight S-nitrosothiols produced in the erythrocyte free skin from NO produced on the external skin by ammonia oxidizing bacteria. These low molecular weight S-nitrosothiols are stable for long periods, and can diffuse and circulate freely in the plasma. Various enzymes can cleave the NO from various S-nitrosothiols liberating NO at the enzyme site. It is the loss of this volume source of NO from AOB on the skin that leads to disruptions in normal physiology. The advantage to the body of using S-nitrosothiols to generate NO far from a capillary is that $O_2$ is not required for NO production from S-nitrosothiols. Production of NO from nitric oxide synthase (NOS) does require $O_2$. With a sufficient background of S-nitrosothiols, NO can be generated even in anoxic regions. Free NO is not needed either since NO only exerts effects when attached to another molecule, such as the thiol of a cysteine residue or the iron in a heme, so the effects of NO can be mediated by transnitrosation reactions even in the absence of free NO provided that S-nitrosothiols and transnitrosation enzymes are present.

Frank et al. have shown that the angiogenesis that accompanies normal wound healing is produced in part by elevated VEGF which is induced by increased nitric oxide. (Nitric oxide triggers enhanced induction of vascular endothelial growth factor expression in cultured keratinocytes (HaCaT) and during cutaneous wound repair. FASEB J. 13, 2002-2014 (1999).)

NO has a role in the development of cancer, indicating that the bacteria described herein may be used in methods of cancer treatment and prevention. According to certain aspects, it is appreciated that the presence of NO during hypoxia may prevent cells from dividing while under hypoxic stress, when cells are at greater risk for errors in copying DNA. One relevant cell function is the regulation of the cell cycle. This is the regulatory program which controls how and when the cell replicates DNA, assembles it into duplicate chromosomes, and divides. The regulation of the cell cycle is extremely complex, and is not fully understood. However, it is known that there are many points along the path of the cell cycle where the cycle can be arrested and division halted until conditions for doing so have improved. The p53 tumor suppressor protein is a key protein in the regulation of the cell cycle, and it serves to initiate both cell arrest and apoptosis from diverse cell stress signals including DNA damage and p53 is mutated in over half of human cancers as reported by Ashcroft et al. in "Stress Signals Utilize Multiple Pathways To Stabilize p53." (Molecular And Cellular Biology, May 2000, p. 3224-3233.) Hypoxia does initiate accumulation of p53, and while hypoxia is important in regulating the cell cycle, hypoxia alone fails to induce the downstream expression of p53 mRNA effector proteins and so fails to cause arrest of the cell cycle. Goda et al. have reported that hypoxic induction of cell arrest requires hypoxia-inducing factor-1 (HIF-1α). (Hypoxia-Inducible Factor 1α Is Essential for Cell Cycle Arrest during Hypoxia. Molecular And Cellular Biology, January 2003, p. 359-369.) Britta et al. have reported that NO is one of the main stimuli for HIF-1α. (Accumulation of HIF-1α under the influence of nitric oxide. Blood, 15 Feb. 2001, Volume 97, Number 4.) In contrast, NO does cause the accumulation of transcriptionally active p53 and does cause arrest of the cell cycle and does cause apoptosis. Wang et al., P53 Activation By Nitric Oxide Involves Down-Regulation Of Mdm2. THE JOURNAL OF BIOLOGICAL CHEMISTRY Vol. 277, No. 18, Issue Of May 3, Pp. 15697-15702, 2002.

In certain aspect of the invention, it is appreciated that preventing the necrotic death of cells by preventing the capillary rarefaction that leads to their hypoxic death may prevent autoimmune disorders. When cells are exposed to chronic hypoxia, the production of reactive oxygen species (ROS) is increased, and there is increased damage to the cells metabolic machinery and ultimately to the cells' DNA. Decreased metabolic capacity will decrease capacity for repair of damage due to ROS and due to exogenous carcinogen exposure. Over time, the damage accumulates and increases the chance of three events: the cell will undergo deletion of cancer-preventing genes and the cell will become cancerous, the cell will die through necrosis, or the cell will die through apoptosis. When cells die, either through necrosis or apoptosis, the cell debris must be cleared from the site. Dead cells are phagocytosed by immune cells, including dendritic cells and macrophages. When these cells phagocytose a body, it is digested by various proteolytic enzymes into antigenic fragments, and then these antigens are attached to the major histocompatability complex (MHC1, MHC2) and the antigen-MHC complex is moved to the surface of the cell where it can interact with T cells and activate the T cells in various ways. Any cell injury releases adjuvants which stimulate the immune system in various ways. In general, cells that undergo necrosis stimulate a greater immune response than cells that undergo apoptosis. Chronic exposure of immune cells to dead and dying cells is therefore likely to lead to autoimmune disorders.

In certain aspects, it is appreciated that low basal NO leads to fibrotic hypertrophy. Once a dead cell has been cleared, a new cell cannot easily take its place, because there is insufficient $O_2$ to support it. Any such new cell would suffer the same fate. The space can remain empty, in which case the organ shrinks, the capillaries draw closer together, new cells are now deprived of the VEGF formerly produced by the now-missing cell, so capillaries ablate and the hypoxic zone reforms. This could result in a general shrinkage of the affected tissues. In tissues that support fibrosis, relatively inert collagen fibers can fill the space. Since the metabolic requirements of the body for the particular organ in question are not reduced, the organ may attempt to grow larger, but now with a significant fibrous content. This may result in fibrotic hypertrophy, such as of the heart and liver. Some organs, such as the brain, cannot grow larger or smaller because the three-dimensional connectivity of nerves and blood vessels are important, and cannot be continuously and simultaneously mapped onto an asymmetrically shrinking brain. The space must be filled with something, and β-amyloid might be the (not so inert) space filler. The kidney cannot grow larger because of the renal capsule, so the number of living cells becomes smaller and they are replaced with fibrotic tissue. If the dead cells are cleared, the tissue shrinks, and the ratio of $NO/O_2$ goes down again, and the capillaries again become sparser. This may set up the vicious circle of end stage renal disease, congestive heart failure/cardiac hypertrophy, primary biliary cirrhosis, Alzheimer's disease, atherosclerosis, inflammatory bowel disease, hypertrophic scar formation, and the multiple connective tissue diseases starting with Raynaud's phenomena and ending with Systemic Sclerosis and primary Sjogren's syndrome where capillary rarefaction is also observed. Ferrini et al, have shown that a reduction in basal NO levels through chronic inhibition of NOS with L-NAME leads to generalized fibrosis of the heart and kidneys. (Antifibrotic Role of Inducible Nitric Oxide Synthase. Nitirc Oxide: Biology and Chemistry Vol. 6, No. 3, pp. 283-294 (2002).) It may be that low basal NO leads to fibrotic hypertrophy.

In certain aspects, it is appreciated that capillary rarefaction affects a subject's ability to control their appetite. Capillary rarefaction is observed in the brains of aged humans and animals. Capillary rarefaction is associated with declines in circulating growth factors including insulin like growth factor-1. Neurogenesis in the adult brain is coordinated with angiogenesis. Since the brain regulates many homeostatic functions, increased diffusion lengths between capillaries to control elements of the brain might be "interpreted" as inadequate blood concentrations of those species. The flux of glucose in the brain is quite close to normal metabolic needs, where glucose flux is only 50 to 75% greater than glucose consumption and the glucose transporters across the blood brain barrier are saturable, steriospecific and independent of energy or ion gradients. A large part of the regulation of appetite is mediated through the brain, and capillary rarefaction may cause an adequate blood concentration of "nutrients" (or marker compounds proportional to "nutrients") to be interpreted as insufficient. This may be one cause of obesity.

According to certain aspects, it is appreciated that capillary rarefaction may be a cause of non-insulin dependent diabetes. Non-insulin dependent diabetes (NIDDM) is also known as the Metabolic Syndrome or Diabetes type 2, and is characterized by insulin resistance. The sensitivity of the body to insulin is reduced, and insulin levels increase People with NIDDM have high blood glucose, high blood triglycerides, are typically obese, hypertensive, and typically have significant visceral fat.

Other symptoms accompany NIDDM, which may point to capillary rarefaction as the cause. In a study of 40 men, with and without NIDDM, obese (BMI 29) and lean (BMI 24) (10 of each), Konrad et al. report that blood lactate levels at rest were 1.78, 2.26, 2.42, and 2.76 (mM/L) for lean men without, obese men without, lean men with NIDDM, obese men with NIDDM respectively. (A-Lipoic acid treatment decreases serum lactate and pyruvate concentrations and improves glucose effectiveness in lean and obese patients with type 2 diabetes. Diabetes Care 22:280-287, 1999.) Lactate is a measure of anaerobic glycolysis. When $O_2$ is insufficient to generate ATP through oxidative phosphorylation, cells can produce ATP through anaerobic glycolysis. One of the products of anaerobic glycolysis is lactate, which must be exported from the cells, otherwise the pH drops and function is compromised. Blood lactate is commonly measured in exercise studies, where an increase indicates the work load at which maximum oxidative work can be done. Higher levels of lactate at rest would indicate increased anaerobic glycolysis at rest, which is consistent with capillary rarefaction.

Primary biliary cirrhosis is associated with Raynaud's phenomena, pruritus, sicca syndrome, osteoporosis, portal hypertension, neuropathy, and pancreatic insufficiency, and liver abnormalities are associated with rheumatic diseases. Elevated liver enzymes are a symptom of liver inflammation, and elevated liver enzymes are observed as an early symptom of "asymptomatic" primary biliary cirrhosis. Accordingly, the bacteria described herein may be used to treat liver inflammation.

Torre et al have reported that Alzheimer's disease (AD) is a microvascular disorder with neurological degeneration secondary to hypoperfusion, resulting in part from insufficient nitric oxide. (Review: Evidence that Alzheimer's disease is a microvascular disorder: the role of constitutive nitric oxide, Brain Research Reviews 34 (2000) 119-136.) Accordingly, the bacteria described herein may be used to treat AD.

Adverse health effects that are associated with hypertension may also be consequences of low basal NO. The decreased response to vasodilatation is also consistent with low basal NO. NO is a diffusible molecule that diffuses from a source to a sensor site where it has the signaling effect. With low NO levels, every NO source must produce more NO to generate an equivalent NO signal of a certain intensity a certain distance away. NO diffuses in three dimensions and the whole volume within that diffusion range must be raised to the level that will give the proper signal at the sensor location. This may result in higher NO levels at the source and between the source and the sensor. Adverse local effects of elevated NO near a source may then arise from too low a NO background. There is some evidence that this scenario actual occurs. In rat pancreatic islets, Henningsson et al have reported that inhibition of NOS with L-NAME increases total NO production through the induction of iNOS.

(Chronic blockade of NO synthase paradoxically increases islet NO production and modulates islet hormone release. Am J Physiol Endocrinol Metab 279: E95-E107, 2000.) Increasing NO by increasing NOS activity will only work up to some limit. When NOS is activated but is not supplied with sufficient tetrahydrobiopterin (BH4) or L-arginine, it becomes "uncoupled" and generates superoxide (O2−) instead of NO. This $O_2^-$ may then destroy NO. Attempting to produce NO at a rate that exceeds the supply of BH4 or L-arginine may instead decrease NO levels. This may result in positive feedback where low NO levels are made worse by stimulation of NOS, and uncoupled NOS generates significant $O_2^-$ which causes local reactive oxygen species (ROS) damage such as is observed in atherosclerosis, end stage renal disease, Alzheimer's, and diabetes.

The bacteria described herein may also be used to delay the signs of aging. Caloric restriction extends lifespan, and Holloszy reported that restricting food intake to 70% of ad lib controls, prolongs life in sedentary rats from 858 to 1,051 days, almost 25%. (Mortality rate and longevity of food restricted exercising male rats: a reevaluation. J. Appl. Physiol. 82(2): 399-403, 1997.) The link between calorie restriction and prolonged life is well established, however, the causal mechanism is not. Lopez-Torres et al. reported that the examination of liver mitochondrial enzymes in rats indicates a reduction in $H_2O_2$ production due to reduced complex I activity associated with calorie restriction. (Influence Of Aging And Long-Term Caloric Restriction On Oxygen Radical Generation And Oxidative DNA Damage In Rat Liver Mitochondria. Free Radical Biology & Medicine Vol. 32 No 9 pp 882-8899, 2002.) $H_2O_2$ is produced by dismutation of $O_2^-$, which is a major ROS produced by the mitochondria during respiration. The main source of $O_2^-$ has been suggested by Kushareva et al. and others to be complex I which catalyzes the NAD/NADH redox couple by reverse flow of electrons from complex III, the site of succinate reduction. The free radical theory, proposed by Beckman, of aging postulates, that free radical damage to cellular DNA, antioxidant systems and DNA repair systems accumulates with age and when critical systems are damaged beyond repair, death ensues. (The Free Radical Theory of Aging Matures. Physiol. Rev. 78: 547-581, 1998.)

As an additional mechanism, NO has been demonstrated by Vasa et al. to activate telomerase and to delay senescence of endothelial cells. (Nitric Oxide Activates Telomerase and Delays Endothelial Cell Senescence. Circ Res. 2000; 87:540-542.) Low basal NO will increase basal metabolic rate by disinhibition of cytochrome oxidase. Increased basal metabolism will also increase cell turn-over and growth rate. Capillary rarefaction, by inducing chronic hypoxia may increase free radical damage and may also increase cell turn-over, and so accelerate aging by both mechanisms.

In some aspects, it is appreciated that autotrophic ammonia-oxidizing bacteria may produce protective aspects for allergies and autoimmune disorders. The best known autoimmune disease is perhaps Diabetes Type 1, which results from the destruction of the insulin producing cells in the pancreas by the immune system. Recurrent pregnancy loss is also associated with autoimmune disorders where the number of positive autoimmune antibodies correlated positively with numbers recurrent pregnancy losses. Systemic Sclerosis, Primary Biliary Cirrhosis, autoimmune hepatitis, and the various rheumatic disorders are other examples of autoimmune disorders. Application of AOB was observed to reduce an allergy, hay fever, as described in WO/2005/030147.

One mechanism by which AOB may exert their protective effect on allergies and autoimmune disorders is through the production of nitric oxide, primarily through the regulatory inhibition of NF-KB and the prevention of activation of immune cells and the induction of inflammatory reactions. NF-KB is a transcription factor that up-regulates gene expression and many of these genes are associated with inflammation and the immune response including genes which cause the release of cytokines, chemokines, and various adhesion factors. These various immune factors cause the migration of immune cells to the site of their release resulting in the inflammation response. Constitutive NO production has been shown to inhibit NF-KB by stabilizing IKBα (an inhibitor of NF-KB) by preventing IKBα degradation.

Administration of an NO donor has been shown by Xu et al. to prevent the development of experimental allergic encephalomyelitis in rats. (SIN-1, a Nitric Oxide Donor, Ameliorates Experimental Allergic Encephalomyelitis in Lewis Rats in the Incipient Phase: The Importance of the Time Window. The Journal of Immunology, 2001, 166: 5810-5816.) In this study, it was demonstrated that administering an NO donor, reduced the infiltration of macrophages into the central nervous system, reduced the proliferation of blood mononuclear cells, and increased apoptosis of blood mononuclear cells. All of these results are expected to reduce the extent and severity of the induced autoimmune response.

Low basal NO may lead to autism via the mechanism that new connections in the brain are insufficiently formed as a result of insufficient basal nitric oxide. While not wishing to be bound in theory, in some embodiments, formation of neural connections is modulated by NO. In these cases, any condition that lowers the range of NO diffusion may decrease the volume size of brain elements that can undergo connections. A brain which developed under conditions of low basal NO levels may be arranged in smaller volume elements because the reduced effective range of NO.

Additional symptoms exhibited in autistic individuals may also point to low NO as a cause, including increased pitch discrimination, gut disturbances, immune system dysfunction, reduced cerebral blood flow, increased glucose consumption of the brain, increased plasma lactate, attachment disorders, and humming. Each of these symptoms may be attributed to a low basal NO level.

Takashi Ohnishi et al. have reported that autistic individuals show decreased blood flow. Takashi Ohnishi et al., Abnormal regional cerebral blood flow in childhood autism. Brain (2000), 123, 1838-1844. J. M. Rumsey et al. have reported that autistic individuals have increased glucose consumption. Rumsey J M, Duara R, Grady C, Rapoport J L, Margolin R A, Rapoport S I, Cutler N R. Brain metabolism in autism. Resting cerebral glucose utilization rates as measured with positron emission tomography. Arch Gen Psychiatry, 1985 May; 42(5):448-55 (abstract). D. C. Chugani has reported that autistic individuals have an increased plasma lactate levels. Chugani D C, et al., Evidence of altered energy metabolism in autistic children. Prog Neuropsychopharmacol Biol Psychiatry. 1999 May; 23(4):635-41. The occurrence of these effects may be a result of capillary rarefaction in the brain, which may reduce blood flow and $O_2$ supply, such that some of the metabolic load of the brain may be produced through glycolysis instead of oxidative phosphorylation.

Nitric oxide has been demonstrated by B. A. Klyachko et al. to increase the excitability of neurons by increasing the after hyperpolarization through cGMP modification of ion channels. Vitaly A. Klyachko et al., cGMP-mediated facilitation in nerve terminals by enhancement of the spike after hyperpolarization. Neuron, Vol. 31, 1015-1025, Sep. 27, 2001. C. Sandie et al. have shown that inhibition of NOS reduces startle. Carmen Sandi et al., Decreased spontaneous motor activity and startle response in nitric oxide synthase inhibitor-treated rats. European journal of pharmacology 277 (1995) 89-97. Attention-Deficit Hyperactivity Disorder (ADHD) has been modeled using the spontaneously hypertensive rat (SHR) and the Naples high-excitability (NHE) rat. Both of these models have been shown by Raffaele Aspide et al, to show increased attention deficits during periods of acute NOS inhibition. Raffaele Aspide et al., Non-selective attention and nitric oxide in putative animal models of attention-deficit hyperactivity disorder. Behavioral Brain Research 95 (1998) 123-133. Accordingly, the bacteria herein may be used in the treatment of ADHD.

Inhibition of NOS has also been shown by M. R. Dzoljic to inhibit sleep. M. R. Dzoljic, R. de Vries, R. van Leeuwen. Sleep and nitric oxide: effects of 7-nitro indazole, inhibitor of brain nitric oxide synthase. Brain Research 718 (1996) 145-150. G. Zoccoli has reported that a number of the physiological effects seen during sleep are altered when NOS is inhibited, including rapid eye movement and sleep-wake differences in cerebral circulation. G. Zoccoli, et al., Nitric oxide inhibition abolishes sleep-wake differences in cerebral circulation. Am. J. Physiol. Heart Circ Physiol 280: H2598-2606, 2001. NO donors have been shown by L. Kapas et al. to promote non-REM sleep, however, these increases persisted much longer than the persistence of the NO donor, suggesting perhaps a rebound effect. Levente Kapas et al. Nitric oxide donors SIN-1 and SNAP promote nonrapid-eye-movement sleep in rats. Brain Research Bulletin, vol 41, No 5, pp. 293-298, 1996. M. Rosaria et al., Central NO facilitates both penile erection and yawning. Maria Rosaria Melis and Antonio Argiolas. Role of central nitric oxide in the control of penile erection and yawning. Prog Neuro-Psychopharmacol & Biol. Phychiat. 1997, vol 21, pp 899-922. P. Tani et al, have reported that insomnia is a frequent finding in adults with Asperger's. Pekka Tani et al., Insomnia is a frequent finding in adults with Asperger's syndrome. BMC Psychiatry 2003, 3:12. Y. Hoshino has also observed sleep disturbances in autistic children. Hoshino Y, Watanabe H, Yashima Y, Kaneko M, Kumashiro H. An investigation on sleep disturbance of autistic children. Folia Psychiatr Neurol Jpn. 1984; 38(1):45-51. (abstract) K. A. Schreck et al. has observed that the severity of sleep disturbances correlates with severity of autistic symptoms. Schreck K A, et al., Sleep problems as possible predictors of intensified symptoms of autism. Res Dev Disabil. 2004 January-Febraury; 25(1):57-66. (abstract). Accordingly, the bacteria herein may be used in the treatment of insomnia.

W. D. Ratnasooriya et al reported that inhibition of NOS in male rats reduces pre-coital activity, reduces libido, and reduces fertility. W. D. Ratnasooriya et al., Reduction in libido and fertility of male rats by administration of the nitric oxide (NO) synthase inhibitor N-nitro-L-arginine methyl ester. International journal of andrology, 23: 187-191 (2000).

It may be that a number of seemingly disparate disorders, characterized by ATP depletion and eventual organ failure are actually "caused" by nitropenia, caused by a global deficiency in basal nitric oxide. When this occurs in the heart, the result is dilative cardiomyopathy. When this occurs in the brain, the result is white matter hyperintensity, Alzheimer's, vascular depression, vascular dementia, Parkinson's, and the Lewy body dementias. When this occurs in the kidney, the result is end stage renal disease, when this occurs in the liver, the result is primary biliary cirrhosis. When this occurs in muscle, the consequence is fibromyaligia, Gulf War Syndrome, or chronic fatigue syndrome. When this occurs in the bowel, the consequence is ischemic bowel disease. When this occurs in the pancreas, the consequence is first type 2 diabetes, followed by chronic inflammation of the pancreas, followed by autoimmune attack of the pancreas (or pancreatic cancer), followed by type 1 diabetes. When this occurs in the connective tissue, the consequence is systemic sclerosis.

In the remnant kidney model of end stage renal disease, part of the kidney is removed, (either surgically or with a toxin) which increases the metabolic load on the remainder. Superoxide is generated to decrease NO and increase $O_2$ diffusion to the kidney mitochondria. Chronic overload results in progressive kidney capillary rarefaction and progressive kidney failure. In acute kidney failure, putting people in dialysis can give the kidney a "rest", and allows it to recover. In acute renal failure induced by rhabdomyolysis (muscle damage which releases myoglobin into the blood stream) kidney damage is characterized by ischemic damage. Myoglobin scavenges NO, just as hemoglobin does, and would cause vasoconstriction in the kidney leading to ischemia. Myoglobin would also induce local nitropenia and the cascade of events leading to further ATP depletion.

In some aspects, low NO levels lead to reduced mitochondrial biogenesis. Producing the same ATP at a reduced mitochondria density will result in an increase in $O_2$ consumption, or an accelerated basal metabolic rate. An accelerated basal metabolic rate is observed in a number of conditions, including: Sickle cell anemia, Congestive heart failure, Diabetes, Liver Cirrhosis, Crohn's disease, Amyotrophic lateral sclerosis, Obesity, End stage renal disease, Alzheimer's, and chronic obstructive pulmonary disease.

While some increased $O_2$ consumption might be productively used, in many of these conditions uncoupling protein is also up-regulated, indicating that at least part of the increased metabolic rate is due to inefficiency. Conditions where uncoupling protein is known to be up-regulated include obesity and diabetes.

With fewer mitochondria consuming $O_2$ to a lower $O_2$ concentration, the $O_2$ gradient driving $O_2$ diffusion is greater, so the $O_2$ diffusion path length can increase resulting in capillary rarefaction, which is observed in dilative cardiomyopathy, hypertension, diabetes type 2, and renal hypertension.

Copper, either as Cu2+ or as ceruloplasmin (CP) (the main Cu containing serum protein which is present at 0.38 g/L in adult sera and which is 0.32% Cu and contains 94% of the serum copper) catalyzes the formation of S—NO-thiols from NO and thiol containing groups (RSH). The Cu content of plasma is variable and is increased under conditions of infection. Berger et al. reported that the Cu and Zn content of burn-wound exudates is considerable with patients with ⅓ of their skin burned, losing 20 to 40% of normal body Cu and 5 to 10% of Zn content in 7 days. (Cutaneous copper and zinc losses in burns. Burns. 1992 October; 18(5):373-80.) If the patients skin were colonized by AOB, wound exudates which contains urea and Fe, Cu, and Zn that AOB need, would be converted into NO and nitrite, greatly supplementing the local production of NO by iNOS, without consuming resources (such as $O_2$ and L-arginine) in the metabolically challenged wound. A high production of NO and nitrite by AOB on the surface of a wound would be expected to inhibit infection, especially by anaerobic bacteria such as the Clostridia which cause tetanus, gas gangrene, and botulism.

The practice of the present invention may employ, unless otherwise indicated, conventional methods of immunology, molecular biology, and recombinant DNA techniques within the skill of the art. Such techniques are explained fully in the literature. See, e.g., Sambrook, et al. Molecular Cloning: A Laboratory Manual (Current Edition); and Current Protocols in Molecular Biology (F. M. Ausubel, et al. eds., current edition).

7. Adjusting the Skin Microbiome with Ammonia Oxidizing Bacteria

The present disclosure provides for systems and methods for changing the skin microbiome, e.g., the human skin microbiome. The systems and methods may provide treatment of infections or conditions, e.g., related to the skin, e.g., skin infections and/or skin conditions.

Ammonia-oxidizing bacteria (AOB) of the genus *Nitrosomonas* are Gram-negative obligate autotrophic bacteria with a unique capacity to generate nitrite and nitric oxide exclusively from ammonia as an energy source. They are widely present both in soil and water environments and are essential components of environmental nitrification processes. Due to the roles of nitrite and nitric oxide on human skin as important components of several physiological functions, such as vasodilation, skin inflammation and wound healing, these bacteria may have beneficial properties for both healthy and immunopathological skin conditions. These bacteria may be safe for use in humans because they are slow-growing, cannot grow on organic carbon sources, may be sensitive to soaps and antibiotics, and have never been associated with any disease or infection in animals or humans.

Topical application of ammonia oxidizing bacteria to a subject, e.g., a human subject may lead to unexpected changes in the skin microbiome, and more specifically it may lead to increases in the proportion of normal commensal non-pathogenic species and reductions in the proportion of potentially pathogenic, pathogenic, or disease causing organisms.

EXAMPLES

Example 1: Studies with Ammonia-Oxidizing Bacteria for the Human Skin: Cosmetic Effects, Safety, Detection and Skin Metagenomics A blinded, placebo-controlled 24 human volunteer study randomized 4:1 AOB to placebo control was performed. Subjects applied a *Nitrosomonas* suspension ($10^9$ CFU/ml, 2 times per day, for a total of $3 \times 10^{10}$ CFU per day) to their face and scalp twice daily for one week and were followed for two additional weeks post-application. Volunteers were instructed to refrain from using hair products during the one-week AOB application as well as the week following application, then returned to regular shampoo use for the third week. Scalp swabs were obtained on Day 0 as baseline controls and on Day 1, 3, 8, 14 and 21 to assess presence/absence of AOB by PCR and 16S rRNA sequencing analyses.

No serious adverse events were associated with AOB application for one week and the product was deemed safe. AOB users reported a clear improvement in skin condition and quality, as indicated by self-assessment reports completed after the seven-day application period. Using AOB-specific PCR analyses of the skin samples, we could demonstrate presence of the bacteria in 83-100% of AOB users during the application period, whereas no AOB were detected in the placebo control samples. All subjects lacked AOB from baseline swabs obtained prior to study initiation, consistent with the predicted sensitivity of these bacteria to soaps and other commercial products. Amplification of the 16S rRNA gene and sequencing of a subset of samples confirmed presence of AOB in corresponding samples and suggested potential trends in modulating the skin microbiome by topical AOB application. In summary, live AOB-based products are safe and could hold great promise as novel self-regulating topical delivery agents of nitrite and nitric oxide to the human skin.

As shown in Table 8, below, the proportion of *Nitrosomonas* (AOB) went up when comparing Day 0 versus Day 8. The proportion of other bacteria, *Propionibacterium*, *Enterobacter*, and *Citrobacter* went down, when comparing Day 0 versus Day 8. The p-values indicated in Table 8 demonstrate that the most significant change between Day 0 and Day 8 was observed with *Nitrosomonas* (AOB) followed by *Propionibacterium*. *Enterobacter* and *Citrobacter* also showed changes between Day 0 and Day 8 to a lesser degree.

TABLE 8

Trends in microbiome composition following AOB application (Day 0 versus Day 8)

| Genus | P-value (unadjusted) | Fold Change | Trend |
|---|---|---|---|
| *Nitrosomonas* (AOB) | 0.0039 | 10.0 | Up |
| *Propionibacterium* | 0.0078 | 0.4 | Down |
| *Enterobacter* | 0.0346 | 0.8 | Down |
| *Citrobacter* | 0.036 | 0.6 | Down |

Example 2

Placebo-Controlled, Double-Blind, Randomized, Multi-Site Cosmetic Trial to Evaluate the Performance and Tolerability of a Cosmetic Product to Improve the Appearance of Oily Skin, Facial Pores, and Other Cosmetic Parameters in Acne Prone Subjects Phase 2b Study:

AO+Mist (preparation of D23 *N. eutropha*) treatment demonstrated strong efficacy signals in both Skindex, Investigator Global Assessment, and inflammatory lesion count (adult cohort).

The AO+Mist preparation used in the Example 2 testing includes ammonia oxidizing bacteria at a concentration of $1 \times 10^9$ CFU/mL in an aqueous buffer solution of 50 mM $Na_2HPO_4$ and 2 mM $MgCl_2$.

In a four week (two weeks treatment, two weeks wash out) randomized (1:1:1:1) double-blinded placebo controlled dose ranging (2, 4, $8 \times 10^9$ CFU) study of B244 (D23 *N. eutropha*) in 36 adults (age 18+) with acne vulgaris. The study is 80% powered to detect a 30% net improvement in IGA (% subjects improving) at week 2 (pooled B244 vs. placebo). The study is also 80% powered to detect a 30% difference ($p<0.05$) in the mean change in lesion count from baseline between the pooled treatment groups and placebo.

A brief summary of the treatment protocol is as follows. Subjects administered ammonia oxidizing bacteria to the face, neck and scalp for a total of four weeks. After the four week time period, discontinuation of application of ammonia oxidizing bacteria occurred for one week. Use of the biome-compatible shampoo and conditioner occurred for the full five weeks. Clinical evaluations were performed at baseline (time 0), week 4 and week 5.

Purpose

This multi-site, double-blind, randomized, 4-week, placebo-controlled cosmetic trial was conducted to assess the overall cosmetic efficacy on skin appearance and tolerance of the AO+Mist mist when used by men and women ages 12-45 with mild to moderate acne prone skin.

Summary

A total of 83 subjects completed the study, with 42 subjects using AO+Mist (*Nitrosomonas eutropha* preparation) and 41 subjects using Placebo. During the course of the study, subjects were assigned to use AO+Mist (*Nitrosomonas eutropha* preparation) or the Placebo according to a predetermined randomization. Subjects applied the test material to the hair, scalp, and face twice per day as directed. Subjects used ("biome-compatible") standardized soap and shampoo as supporting materials, Shampoo (Lot 293178; shown as the "preferred concentration" in Table 5) and Cleanser (Lot 293162; shown as the "preferred concentration" in Table 6), once per day throughout the course of the study. After the 4-week usage phase, subjects discontinued test material use (while still using supporting materials) and participated in a 1-week regression phase. Clinical evaluations were conducted at visit 1 (baseline), visit 2 (week 4), and visit 3 (week 5). Subjects participated in the following procedures at each time point (unless otherwise indicated):

Clinical Grading of Acne An expert clinical grader evaluated each subject's VISIA and self-photographs for acne conditions post-study.

Acne Counts

An expert clinical grader counted inflammatory lesions (papules, pustules, and cysts/nodules) and non-inflammatory lesions (open and closed comedones) on each subject's forehead, left cheek, chin, and right cheek (separately).

Investigator's Global Improvement Assessment (IGIA)

The Investigator or designee performed a global acne assessment of the face at week 4 and week 5. A description of IGA may be found through the U.S. Food and Drug Administration, e.g., at http://www.fda.gov/downloads/Drugs/ . . . /Guidances/UCM071292.pdf: Guidance for Industry; Acne Vulgaris: Developing Drugs for Treatment (U.S. Department of Health and Human Services; Food and Drug Administration; Center for Drug Evaluation and Research (CDER); September 2005, Clinical/Medical PIH/PIE Lesion Grading Post-inflammatory hyperpigmentation/post-inflammatory erythema (PIH/PIE) lesions were selected for each subject and an expert clinical grader graded selected PIH/PIE lesions for darkness and size.

Imaging Procedures

Digital images were taken of each subject's face (right side, left side, and center view) using the VISTA CR photo-station (Canfield Imaging Systems, Fairfield, N.J.) with a Canon Mark II 5D digital SLR camera (Canon Incorporated, Tokyo, Japan) using standard 1 and 2, cross-polarized, parallel polarized, and UV-NF lighting conditions. The digital images using cross-polarized lighting were analyzed for pores.

Survey and Self-Photographs

Subjects took weekly standardized self-photographs ("selfies") using their smart phone and completed questionnaires.

Tolerability Evaluations

An expert clinical grader evaluated each subject's global face for objective irritation parameters (erythema, edema, and scaling) and subjects reported the degree of subjective irritation parameters (stinging, burning, and itching).

Clinical Grading of Cosmetic Efficacy Parameters

An expert clinical grader evaluated each subject's face for oily appearance (shine and feel), pore appearance, radiance, blotchiness, skin tone (color) evenness, visual smoothness, and tactile smoothness.

Sebumeter Measurements

Triplicate Sebumeter SM 815 (Courage+Khazaka, Germany) measurements were taken on the forehead to measure sebum quantity on the skin using a photometric method.

Microbiome Sample Collections

Microbiome samples were collected on the back of the neck, behind the right ear, and right cheek (1 from each location).

Overall Conclusions

Overall results from this multi-site, double-blind, randomized, 4-week, placebo-controlled cosmetic trial indicate that use of the test material, AO+Mist (*Nitrosomonas eutropha* preparation), was demonstrated to be safe and effective in subjects with mild and moderate acne conditions. The severity of disease and the count of inflammatory lesions in adults were shown to have improved with AO+Mist treatment. The use of AO+Mist (*Nitrosomonas eutropha* preparation), was very well tolerated by subjects with no statistically significant increase (worsening) in clinical grading scores for erythema, scaling, edema, burning, stinging, and itching at weeks 4 when compared with baseline scores.

The study used the standard FDA Investigator's Global Acne (IGA) scale[1] to assess acne conditions using VISIA images under completely blinded condition. Subjects who used AO+Mist (*Nitrosomonas eutropha* preparation) showed a statistically significant decrease (improvement) in IGA scores at weeks 4 and 5 when compared with baseline scores. Comparisons between the test materials based on the change from baseline indicated a statistically significant difference for acne grading at week 4, in favor of AO+Mist (*Nitrosomonas eutropha* preparation).

Figure 4:
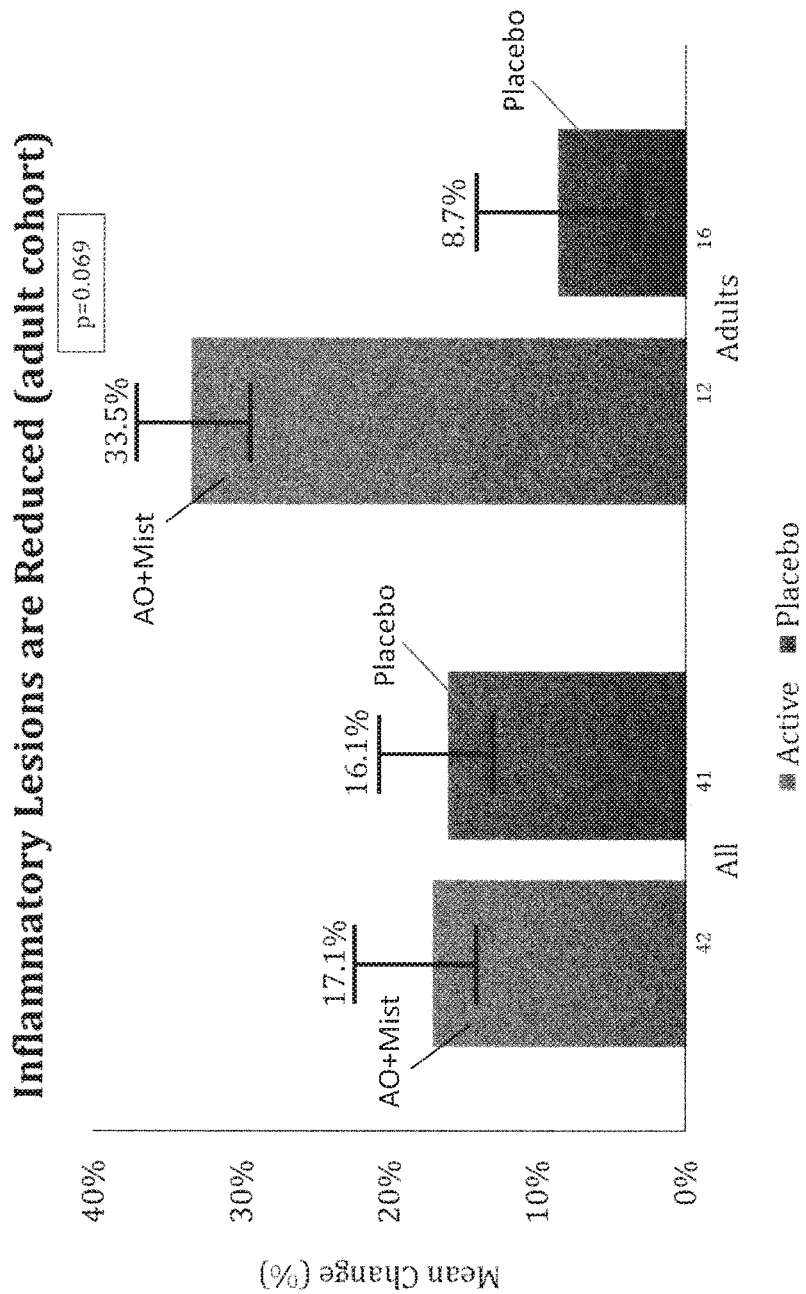
FIG. 4 shows reduction in inflammatory lesions. Mean change (%) is plotted for all test subjects and adult test subjects for ammonia oxidizing bacteria (AO+Mist) and Placebo.

Results of the acne counts for use of AO+Mist (*Nitrosomonas eutropha* preparation) showed a statistically significant decrease (improvement) in papules and inflammatory lesion counts at weeks 4 and 5, and global lesion counts at week 4 when compared with baseline counts. Although no statistically significant difference was observed between AO+Mist (*Nitrosomonas eutropha* preparation) and placebo, the data indicated a greater and more sustained reduction in inflammatory lesion count in adult subjects who used AO+Mist (*Nitrosomonas eutropha* preparation), as shown in FIG. 4. The AO+Mist bars depicted on the graph are the first (from the left) and third (from the left). The Placebo bars depicted on the graph are the second (from the left) and fourth (from the left).

Subject-reported outcomes were measured using the Skindex16 Quality-of-Life survey. AO+Mist was associated with changes (improvements) in the group of questions that captured the subjects' emotional assessment of their disease. Specifically, statistically significant improvements were observed, in favor of AO+Mist (*Nitrosomonas eutropha* preparation), for skin condition hurting (week 2), persistence/reoccurrence of skin condition (week 4), worry about skin condition (week 5), and appearance of skin condition (weeks 2, 4, and 5).

Results of clinical grading for use of AO+Mist (*Nitrosomonas eutropha* preparation) showed a statistically significant decrease (improvement) in clinical grading scores for visual and tactile smoothness at weeks 4 and 5, and for blotchiness at week 5, when compared with baseline scores.

Test Material Descriptions

Table 9 and Table 10 present the descriptions of each test material and supporting material.

TABLE 9

TEST MATERIAL DESCRIPTIONS

| TMIN | ID | Physical Properties | Frequency |
|---|---|---|---|
| 0052-15C | AO + Mist (*Nitrosomonas eutropha* preparation) | Clear, transparent liquid | Twice per day (morning and evening) |
| 0053-15C | Placebo | Clear, transparent liquid | Twice per day (morning and evening) |

TABLE 10

SUPPORTING MATERIAL DESCRIPTIONS

| TMIN | ID | Physical Properties | Frequency |
|---|---|---|---|
| 0099-15C | Cleanser (Lot 293162) | Pale yellow, transparent liquid | Once per day |
| 0100-15C | Shampoo (Lot 293178) | Pale yellow, transparent liquid | Once per day |

Subject Disposition and Demographics

A summary of subject disposition information is included in Table 11. The demographic information for the per-protocol (PP) population is presented in Table 12. For applicable parameters, the number of subjects in each category is listed with the percentage of total subjects in parentheses.

TABLE 11

SUBJECT DISPOSITION

| | All Subjects n | AO + Mist n | Placebo n |
|---|---|---|---|
| Enrolled Subjects | 98 | 49 | 49 |
| Completed Subjects (PP Population) | 83 | 42 | 41 |
| Discontinued Subjects | 15 | 7 | 8 |
| Reason for Discontinuation | | | |
| Subject Requested withdrawal | 7 | 5 | 2 |
| Non-compliance | 3 | 0 | 3 |
| Lost to follow-up | 5 | 2 | 3 |

TABLE 12

SUMMARY OF DEMOGRAPHIC INFORMATION - PP POPULATION

| | All Subjects | AO + Mist | Placebo |
|---|---|---|---|
| N | 83 | 42 | 41 |
| Age (Years) | | | |
| Mean | 19.8 | 18.9 | 20.8 |
| Standard Deviation | 8.5 | 7.6 | 9.3 |
| Minimum | 12 | 12 | 12 |
| Median | 17.0 | 16.0 | 17.0 |
| Maximum | 44 | 40 | 44 |
| | n (%) | n (%) | n (%) |
| Sex | | | |
| Female | 50 (60.2) | 23 (54.8) | 27 (65.9) |
| Male | 33 (39.8) | 19 (45.2) | 14 (34.1) |
| Ethnicity/Race | | | |
| Asian | 8 (9.6) | 4 (9.5) | 4 (9.8) |
| Black or African American | 9 (10.8) | 5 (11.9) | 4 (9.8) |
| Hispanic or Latino | 6 (7.2) | 2 (4.8) | 4 (9.8) |
| White | 50 (60.2) | 24 (57.1) | 26 (63.4) |
| Multi-Racial | 10 (12.0) | 7 (16.7) | 3 (7.3) |
| Skin Type | | | |
| Combination | 49 (59.0) | 22 (52.4) | 27 (65.9) |
| Normal | 15 (18.1) | 7 (16.7) | 8 (19.5) |
| Oily | 19 (22.9) | 13 (31.0) | 6 (14.6) |
| Fitzpatrick Skin Type | | | |
| I | 2 (2.4) | 2 (4.8) | 0 (0.0) |
| II | 6 (7.2) | 5 (11.9) | 1 (2.4) |
| III | 49 (59.0) | 21 (50.0) | 28 (68.3) |
| IV | 19 (22.9) | 10 (23.8) | 9 (22.0) |
| V | 7 (8.4) | 4 (9.5) | 3 (7.3) |
| Acne Type | | | |
| Adolescent Acne | 55 (66.3) | 30 (71.4) | 25 (61.0) |
| Adult Acne | 28 (33.7) | 12 (28.6) | 16 (39.0) |
| Age Group (Years) | | | |
| 12-15 | 33 (39.8) | 16 (38.1) | 17 (41.5) |
| 16-18 | 22 (26.5) | 14 (33.3) | 8 (19.5) |
| 19-28 | 12 (14.5) | 5 (11.9) | 7 (17.1) |
| >28 | 16 (19.3) | 7 (16.7) | 9 (22.0) |

Procedures and Methods

Prior to the start of the study, potential subjects were screened over the telephone through the use of an IRB-approved script for eligibility criteria. Male and female adolescents and adults, between the ages of 12 and 45 years, with self-perceived normal, oily, and combination skin types were scheduled for eligibility screening at the clinic. Prospective subjects were instructed to remove all makeup at least 3 hours prior to each scheduled visit.

At visit 1 (baseline), prospective subjects 18 years of age or older or the parent/legal guardian of any minor subject under the age of 18 years, read and signed an informed consent form after the nature of the study was explained and any study-related questions were answered. Prospective minor subjects read and signed an assent form. Prospective subjects that signed this initial paperwork were assigned a screening number and evaluated for the following eligibility criteria:

Fitzpatrick Skin Classification: Types I-V qualified

The Fitzpatrick Skin Classification is based on the skin's unprotected response to the first 30 to 45 minutes of sun exposure after a winter season without sun exposure. The categories of skin types are as follows in Table 13:

TABLE 13

| Type | Physical Characteristics | Skin Reaction to UV |
|---|---|---|
| I | White; very fair; red or blonde hair; blue eyes; freckles | Always burns easily; never tans |
| II | White; fair; red or blonde hair; blue, hazel, or green eyes | Always burns easily; tans minimally |

TABLE 13-continued

| Type | Physical Characteristics | Skin Reaction to UV |
|---|---|---|
| III | Cream white; fair with any eye or hair color; very common | Burns moderately; tans gradually |
| IV | Brown; typical Mediterranean white skin | Burns minimally; always tans well |
| V | Dark Brown; mid-eastern skin types, black hair, olive skin | Rarely burns; tans profusely |
| VI | Black; black hair, black eyes, black skin | Never burns; deeply pigmented |

Clinically determined mild to moderately acne combined acne severity scale (minimum of 5-50 inflammatory lesions and 5-100 inflammatory lesions to qualify.

At least 1 target PIH/PIE lesion on the face

Prospective subjects completed an eligibility and health questionnaire. Screened subjects who passed eligibility requirements were enrolled into the study and assigned a subject number. Subjects participated in the following procedures:

Clinical Grading of Cosmetic Efficacy Parameters

Subjects were clinically graded by an expert blinded clinical grader for the following cosmetic efficacy parameters globally on the face using a modified Griffiths' 10-point scale[3] according to the following numerical definitions (with half-point scores assigned as necessary to accurately describe the skin condition):

0=none (best possible condition)
1 to 3=mild
4 to 6=moderate
7 to 9=severe (worst possible condition)

The following parameters (Table 14) were graded according to the listed scale anchors:

TABLE 14

| Parameter | 0 = | 9 = |
|---|---|---|
| Oily appearance (shine and feel) | No shine, flat/matte appearance | Strong shiny/oily appearance |
| Pore appearance | Small, tight, barely perceptible pores | Large, noticeable pores |
| Radiance | Radiant, luminous appearance | Dull/matte and or/sallow appearance |
| Blotchiness | No blotchiness/clear | Blotchy skin appearance |
| Skin tone (color) evenness | Even, healthy skin color | Uneven, discolored appearance |
| Visual smoothness | Smooth, even looking skin texture | Rough, uneven looking skin texture |
| Tactile smoothness | Smooth, even feeling skin texture | Rough, uneven feeling skin texture |

PIH/PIE Lesion Grading

An expert blinded clinical grader selected post-inflammatory hyperpigmentation/post-inflammatory erythema (PIH/PIE) lesions on the face of each subject and graded the lesions for darkness and size using the following grading scales:

Darkness
1 Slightly lighter than tone/color of surrounding skin
2 Equal to tone/color of surrounding skin (no visible PIH/PIE)
3 Slightly darker/redder than tone/color of surrounding skin
4 Moderately darker/redder than tone/color of surrounding skin
5 Markedly darker/redder than tone/color of surrounding skin
6 Extremely darker/redder than tone/color of surrounding skin Size
0 Not visible
1 0.5 mm or less in diameter
2 Greater than 0.5 mm to 1.5 mm in diameter
3 Greater than 1.5 mm to 2.5 mm in diameter
4 Greater than 2.5 mm in diameter Acne Counts An expert blinded clinical grader counted and recorded the number of inflammatory acne lesions (papules, pustules, and cysts/nodules) and non-inflammatory acne lesions (open comedones and closed comedones) on each subject's forehead, left cheek, chin, and right cheek, separately (excluding lesions on the nose, under the jawline or along the hairline, including eye brows).

Tolerability Evaluations

Local cutaneous tolerability was evaluated by assessing the signs and symptoms of objective and subjective irritation globally on each subject's face (cosmetic treatment area). The following irritation parameters were evaluated:

Objective Irritation (clinically graded): erythema, edema, and scaling

Subjective Irritation (assessed by subjects): stinging, burning, and itching

Results of the irritation evaluations were recorded using the following scales (with half-point scores assigned as necessary to better describe the clinical condition):

| Erythema | |
|---|---|
| 0 = None | No erythema of the cosmetic treatment area |
| 1 = Mild | Slight, but definite redness of the cosmetic treatment area |
| 2 = Moderate | Definite redness of the cosmetic treatment area |
| 3 = Severe | Marked redness of the cosmetic treatment area |
| Edema | |
| 0 = None | No edema/swelling of the cosmetic treatment area |
| 1 = Mild | Slight, but definite edema of the cosmetic treatment area |
| 2 = Moderate | Definite edema of the cosmetic treatment area |
| 3 = Severe | Marked edema of the cosmetic treatment area |
| Scaling | |
| 0 = None | No scaling of the cosmetic treatment area |
| 1 = Mild | Barely perceptible, fine scales in limited areas of the cosmetic treatment area |
| 2 = Moderate | Fine scaling generalized to all areas of the cosmetic treatment area |
| 3 = Severe | Scaling and peeling of skin over all areas of the cosmetic treatment area |
| Stinging | |
| 0 = None | No stinging of the cosmetic treatment area |
| 1 = Mild | Slight stinging sensation of the cosmetic treatment area; not really bothersome |
| 2 = Moderate | Definite stinging of the cosmetic treatment area that is somewhat bothersome |
| 3 = Severe | Marked stinging sensation of the cosmetic treatment area that causes definite discomfort and may interrupt daily activities and/or sleep |
| Burning | |
| 0 = None | No burning of the cosmetic treatment area |
| 1 = Mild | Slight burning sensation of the cosmetic treatment area; not really bothersome |
| 2 = Moderate | Definite warm, burning of the cosmetic treatment area that is somewhat bothersome |
| 3 = Severe | Hot burning sensation of the cosmetic treatment area that causes definite discomfort and may interrupt daily activities and/or sleep |

-continued

Itching

| | |
|---|---|
| 0 = None | No itching of the cosmetic treatment area |
| 1 = Mild | Slight itching sensation of the cosmetic treatment area; not really bothersome |
| 2 = Moderate | Definite itching of the cosmetic treatment area that is somewhat bothersome |
| 3 = Severe | Marked itching sensation of the cosmetic treatment area that causes definite discomfort and may interrupt daily activities and/or sleep |

Subjects acclimated to ambient temperature and humidity conditions for at least 15 minutes prior to participating in bioinstrumentation/imaging/microbiome sampling procedures. During the course of the study, applicable waiting/instrumentation rooms were maintained at a temperature of 68° F. to 75° F. and the relative humidity ranged from 35% to 65%.

After acclimation, subjects participated in the following procedures:

Sebumeter Measurements

Triplicate Sebumeter SM 815 (Courage+Khazaka, Germany) measurements were taken on the forehead to measure sebum quantity on the skin using a photometric method, independent of moisture. The measurement is the transmission of light through sebutape, a synthetic material that becomes transparent upon contact with sebum. A microprocessor in the Sebumeter calculates the amount (μg sebum/$cm^2$) on the skin surface based on the transparency of the sebutape.

Imaging Procedures

Prior to photography procedures, clinic personnel ensured subjects had a clean face with no makeup and subjects removed any jewelry from the area(s) to be photographed. Subjects were provided with a black or gray matte headband to keep hair away from the face and a black matte shirt or a black or gray matte cloth was draped over subjects' clothing. Subjects were instructed to adopt neutral, nonsmiling expressions with their eyes gently closed, and were carefully positioned for each photograph.

Full-face images were taken of each subject (center, right side, and left side views) using the VISTA CR photo-station (Canfield Imaging Systems, Fairfield, N.J.) with a Canon Mark II 5D digital SLR camera (Canon Incorporated, Tokyo, Japan) under standard lighting 1 (visible), standard lighting 2 (visible/bright), cross-polarized, parallel polarized, and UV-NF lighting conditions.

Microbiome Procedures

Microbiome samples were collected on the back of the neck, behind the right ear, and right cheek (1 from each location) of each subject. The swab was removed from its sterile wrapping, held from the stem away from the swab, rubbed vigorously about 20 times and rotated over a 3 inch area of the site being sampled. The swab was then placed into a tube (labeled with the time point) and the stem was clipped to ensure that the tube could close. The skin swabs were collected and frozen at −80° C. for subsequent DNA extraction and microbiome profiling.

Subjects were instructed on how to take weekly standardized self-photographs ("selfies") using their smart phones and to complete questionnaires.

Subjects were distributed units of the supporting materials, and instructed to apply Shampoo (Lot 293178) once per day to the hair and scalp and use Cleanser (Lot 293162) once per day on the face for the duration of the study. Subjects were distributed a pre-weighed unit of the test material, AO+Mist (*Nitrosomonas eutropha* preparation), or Placebo according to a predetermined randomization.

Subjects were given the following verbal and written usage instructions:

Usage Instructions

Apply the test material (at least 6 pumps each time) to the hair, scalp, and face twice per day (each morning and evening) after cleansing and before bed and never directly before showering. Do not apply any makeup (foundation, eye shadow, et.) for 1 hour after product application and use the minimal amount.

Subjects were provided with written usage instructions, study instructions, a calendar of study visits, and a daily diary to record product application times.

Subjects returned to the clinic for visit 2 (week 4) and participated in the following procedures:

Clinic personnel recorded concomitant medications and questioned subjects regarding changes in their health. Adverse events were recorded if applicable.

Daily diaries were collected, reviewed for compliance, and retained by the clinic. New diaries were distributed.

Test material units were collected, visually inspected, weighed for compliance, and retained by the clinic. Supporting materials were visually inspected for compliance and returned to subjects.

Subjects participated in the following procedures as described for baseline:
Clinical grading of cosmetic efficacy parameters
PIH/PIE lesion grading
Acne counts
Tolerability evaluations
Subjects participated in the following procedure:
Investigator's global improvement assessment (IGA) was performed using the following scale and numerical definitions:
1=Worse
2=No Improvement
3=Mildly Improved
4=Moderately Improved
5=Markedly Improved Subjects acclimated for at least 15 minutes and then participated in the following procedures as described for baseline:
Sebumeter measurements
Imaging procedures
Microbiome sampling After completion of the week 4 assessments, subjects participated in a 1-week regression period where test material use was discontinued (supporting materials were still used). Subjects returned to the clinic for visit 3 (week 5) and participated in the following procedures:

Clinic personnel recorded concomitant medications and questioned subjects regarding changes in their health. Adverse events were recorded if applicable.

Daily diaries were collected, reviewed for compliance, and retained by the clinic.

Supporting material units were collected, visually inspected for compliance, and retained by the clinic.

Subjects participated in the following procedures as described for baseline and week 4:
Clinical grading of cosmetic efficacy parameters
PIH/PIE lesion grading
Acne counts
Investigator's global improvement assessment
Tolerability evaluations Subjects acclimated for at least 15 minutes and then participated in the following procedures as described for baseline:
Sebumeter measurements
Imaging procedures
Microbiome sampling
After completion of week 5 study procedures, the following procedure was performed by a blinded clinical grader:
Acne Grading
Clinical grading of acne was performed using a modified Griffiths' 10-point scale[3] (where 0=no acne and 9=severe acne) on VISIA images taken in the clinic at baseline, week 4, and week 5 and from subjects' self-photographs taken at baseline and weeks 1, 2, 3, 4, and 5 to screen for any exacerbation of subject's underlying acne.
In addition, the VISIA images were clinically graded for acne using the FDA IGA scale[1] (0-4):

| | |
|---|---|
| 0 = Clear | No inflammatory or non-inflammatory lesions |
| 1 = Almost clear | Rare non-inflammatory lesions with no more than one small inflammatory lesion |
| 2 = Mild | Greater than Grade 1, some non-inflammatory lesions with no more than a few inflammatory lesion (papules/pustules only, no nodular lesions) |
| 3 = Moderate | Greater than Grade 2, up to many non-inflammatory lesions and may have some inflammatory lesions, but no more than one small nodular lesion |
| 4 = Severe | Greater than Grade 3, up to many non-inflammatory and inflammatory lesions, but no more than a few nodular lesions |

Biostatistics and Data Management
The per-protocol (PP) population was the primary population for all statistical analyses testing. The PP population included all subjects who were deemed eligible for study participation and completed the study according to protocol. Only the data of completing subjects were analyzed. Subjects may have been removed from the analysis in the case of an AE, an SAE, non-compliance, or Investigator discretion.
Triplicate Sebumeter measurements for each subject and time point were averaged prior to statistical analysis.
The digital images taken using cross-polarized lighting conditions were analyzed for pores using Macroversion "Pore_20121207" developed by Stephens & Associates using Image Pro Plus v7 software (MediaCybernetics, Inc., Rockville, Md.). An irregularly shaped area of interest was selected on the cheek area for the analysis. Pore analysis reported values for the number of pores (count), total area covered by pores, and the average depth of pores.
Acne count data was analyzed as follows for each grading location and for the total of the 4 graded areas (forehead, right cheek, left cheek, and chin):
Papules, pustules, cysts/nodules, open comedones and closed comedones separately.
Inflammatory acne lesions (combining papules, pustules and cysts/nodules) and noninflammatory acne lesions (combining open comedones and closed comedones) separately
Global lesions (total of all 5 types of acne)
For the cosmetic efficacy grading data, acne grading data, PIH/PIE lesion grading data, acne counts, tolerability evaluation data, Sebumeter measurements, and pore image analysis parameters, a descriptive statistical summary is provided, including the number of observations (N), mean, median, standard deviation (SD), minimum (MIN) and maximum (MAX) at all visits.

Mean of the change from baseline (defined as the post-baseline value minus the baseline value) was estimated at each applicable postbaseline time point. The null hypothesis that the mean change from baseline is zero was estimated at week 4 and tested using a Wilcoxon signed-rank test for cosmetic efficacy grading parameters, acne grading, acne counts, image analysis for number of pores (count), and tolerability evaluations, and a paired t-test for Sebumeter measurements and image analysis for pores (total area covered by pores, and average depth of pores). For the regression phase, a similar analysis was performed for the change from week 4 at the week 5 time point, including testing the Investigator's global improvement assessment using a Wilcoxon signed-rank test.
Percent mean change from baseline/week 4 and percentage of subjects showing improvement or worsening was calculated using the following formulas:

Percent mean change from baseline=(visit mean score−baseline mean score)×100 baseline mean score Percent of subjects improved/worsened=(number of subjects improved/worsened from baseline)×100 total number of subjects Comparisons between the treatment cells were made at week 4 in terms of changes from baseline. The null hypothesis, that the mean change from baseline is equal between the 2 treatment cells, was tested for all parameters (except Investigator's global improvement assessment) at each applicable post-baseline time point using a Wilcoxon rank-sum test for cosmetic efficacy grading parameters, acne grading, acne counts, image analysis for number of pores (count), and tolerability evaluations, and a two sample t-test for Sebumeter measurements and image analysis for pores (total area covered and average depth of pores).
For the regression phase, a similar analysis was performed at week 5 in terms of changes from week 4 including testing the Investigator's global improvement assessment using a Wilcoxon rank-sum test.
Overall statistical results, as well as statistical results stratified by age (12-15, 16-18, 19-28, 29 and above), sex (male/female), adult acne (age 19 and above) and adolescent acne (age less than 19), and Fitzpatrick skin type (III, IV, and V [no analysis was run on I and II due to the small sample size]) are presented for clinical grading of cosmetic efficacy parameters, PIH/PIE lesion grading, acne grading, acne counts, Investigator's global improvement assessment, Sebumeter measurements, and image analysis of pore size. In addition demographic tabulation by treatment is presented for age, sex, adult and adolescent acne, and Fitzpatrick skin type.
For acne grading, Spearman's rank correlation coefficients for scores using the 2 scales (Griffiths' scale[3] and FDA scale[1]) were calculated for each applicable time point and treatment.
A statistical test was provided for the null hypothesis that the correlation coefficient is equal to 0. No treatment comparison was made. Similar correlation coefficients were calculated for the modified Griffiths' scores from VISIA and selfie images.
The SkinDex data, a subject-reported outcome that assesses Quality-of-Life, was provided from, which contained the responses to the 16 questions from each subject at baseline and weeks 2, 4, and 5. A frequency table, including count and percentage, is provided for the SkinDex data. A similar analysis is provided as for the clinical grading data, including analysis of data according to age, sex, adult and adolescent acne, and Fitzpatrick type.

Information on Skindex may be found through: http://www.researchgate.net/publication/51646907_Using_the_Skindex-16_and_Common_Terminology_Criteria_for_Adverse_Events_to_assess_rash_symptoms_results_of_a_pooled-analysis_(N0993)

The survey was provided, containing the responses to 37 questions answered by subjects at weeks 1, 2, 3, 4, and 5. For questions 1 through 19, responses ranged from 0 (worsened) to 6 (improved). For the remainder of the questions, response ranged from −1 (no/no change) to 1 (yes/positive change).

A frequency table, including count and percentage of subjects that selected each response option, is provided for the survey data. In addition, a binomial (sign) test was performed to test if the proportion of the combined designated favorable/positive responses is equal to the combined designated unfavorable/negative responses for each question at each time point. Treatment comparison was performed using a Fisher's exact test. For the questions #1 to #19, the test null hypothesis is that the proportion of favorable/unfavorable/neutral responses is equal between treatments. For the rest of the questions, the test null hypothesis is that the proportion of positive/negative responses is equal between treatments. Analysis of data was also performed according to age, sex, adult and adolescent acne, and Fitzpatrick type.

All statistical tests were 2-sided at significance level alpha=0.05. P-values are reported to 3 decimal places (0.000). No multiple testing corrections were considered in the study. Statistical analyses were performed using SAS software version 9.30 series (SAS Statistical Institute). Clinical grading and bioinstrumentation measurements were recorded using Stephens electronic data capture (EDC) system. The Stephens EDC is a computerized system designed for the collection of clinical data in electronic format. The 3 major aspects of EDC consist of a graphical user interface for data entry, a validation component to check for user data, and a reporting tool for analysis of the collected data.

Results

Clinical Grading of Acne From Images

For subjects that used AO+Mist (*Nitrosomonas eutropha* preparation), there was a statistically significant decrease (improvement) in acne grading scores on VISIA images using the FDA scale[1] at weeks 4 and 5 and using the Griffiths' scale[3] at week 5 when compared with baseline scores. Comparisons between the test materials based on the change from baseline for acne grading scores indicated a statistically significant difference VISIA image acne grading using the FDA scale[1] at week 4, in favor of AO+Mist (*Nitrosomonas eutropha* preparation).

Analysis of correlation coefficient from image grading results indicated a statistically significant positive correlation between acne grading scores on VISIA images at baseline, week 4 and week 5 (correlation coefficients ranging from 0.495-0.847), suggesting that self-photos may be a viable approach for documentation of progress during clinical trials.

Acne Counts

All Subjects

Subjects that used AO+Mist (*Nitrosomonas eutropha* preparation) had a statistically significant decrease (improvement) in counts for the total of the 4 graded areas (forehead, left cheek, chin, and right cheek) for papules and inflammatory acne at weeks 4 and 5 and for global lesions at week 4 when compared with baseline counts. Subjects that used Placebo had a statistically significant decrease (improvement) in counts for the total of the 4 graded areas for open comedones, closed comedones, non-inflammatory acne, and global lesions at weeks 4 and 5 and for papules and inflammatory acne at week 4 when compared with baseline counts. Comparisons between the test materials based on the change from baseline for acne counts for the total of the 4 graded areas indicated a statistically significant difference for closed comedones at week 4, in favor of Placebo.

Adult Acne Subjects

Subjects that used AO+Mist (*Nitrosomonas eutropha* preparation) had a statistically significant decrease (improvement) in acne counts for the total of the 4 graded areas (forehead, left cheek, chin, and right cheek) for papules, inflammatory acne, and global lesions at weeks 4 and 5 when compared with baseline counts. Subjects that used Placebo had a statistically significant decrease (improvement) in acne counts for the total of the 4 graded areas for closed comedones, non-inflammatory acne, and global lesions at weeks 4 and 5 and for open comedones at week 5 when compared with baseline counts. Comparisons between the test materials based on the change from baseline for acne counts for total of the 4 areas indicated a statistically significant difference for papules at week 4 in favor of AO+Mist (*Nitrosomonas eutropha* preparation) and for non-inflammatory acne at week 5 in favor of Placebo.

PIH/PIE Lesion Grading

All Subjects

Subjects that used AO+Mist (*Nitrosomonas eutropha* preparation) or Placebo had a statistically significant decrease (improvement) in PIH/PIE lesion grading scores for darkness and size of lesion 1 and lesion 2 at weeks 4 and 5 when compared with baseline scores. Comparisons between the test materials based on the change from baseline for PIH/PIE lesion grading scores indicated a statistically significant difference for size of lesion 1 at week 4, in favor of Placebo.

Adult Acne Subjects

Subjects that used AO+Mist (*Nitrosomonas eutropha* preparation) or Placebo had a statistically significant decrease (improvement) in PIH/PIE lesion grading scores for darkness of lesion 1 at weeks 4 and 5 and size of lesion 1 at week 5, and in the size of lesion 1 at week 4 for Placebo when compared with baseline scores. Comparisons between the test materials based on the change from baseline for PIH/PIE grading scores indicated no statistically significant differences.

SkinDex16

Results from the SkinDex16 data for subjects who used AO+Mist (*Nitrosomonas eutropha* preparation) indicated a statistically significant decrease (improvement) in response scores for the following inquiries and time points when compared with baseline scores:

Worry about your skin condition—week 2

The appearance of your skin condition—weeks 2, 4, and 5

Frustration about your skin condition—weeks 2 and 4

Embarrassment about your skin condition—weeks 2 and 5

Being annoyed about your skin condition—weeks 2 and 4

Figures 2A, 2B:
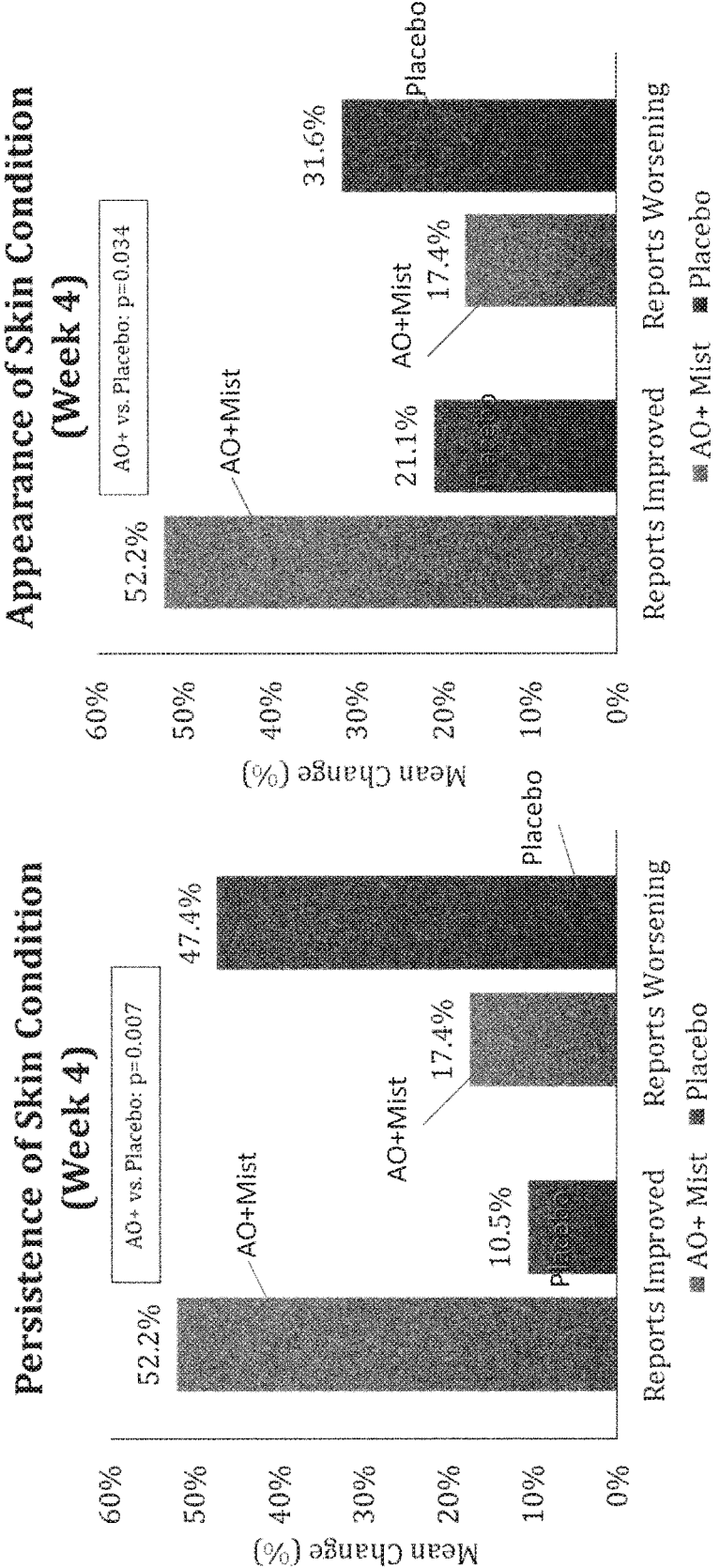
FIG. 2A shows the improvement of persistence of skin condition using ammonia oxidizing bacteria (AO+Mist) at Week 4. Mean change (%) is plotted versus report of improvement and report of worsening in AO+Mist and Placebo.
FIG. 2B shows the improvement of appearance of skin condition using ammonia oxidizing bacteria (AO+Mist) at Week 4. Mean change (%) is plotted versus report of improvement and report of worsening in AO+Mist and Placebo.
Figure 3B:
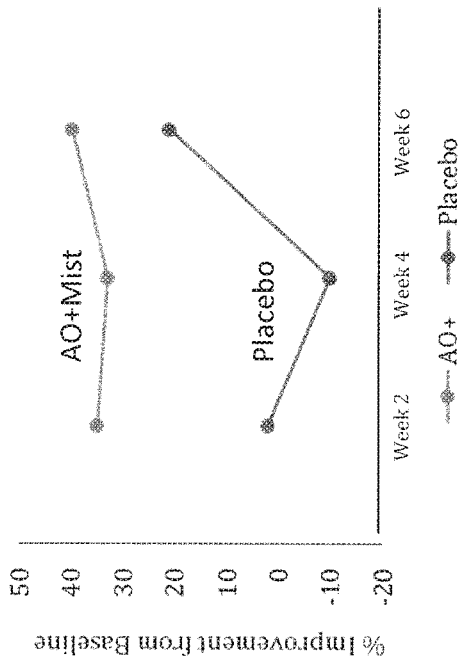
FIG. 3B shows the improvement in appearance of skin condition using ammonia oxidizing bacteria (AO+Mist) at Weeks 2, 4, and 6. Percent Improvement from Baseline (%) is plotted versus Week for AO+Mist and Placebo.
Figure 3A:
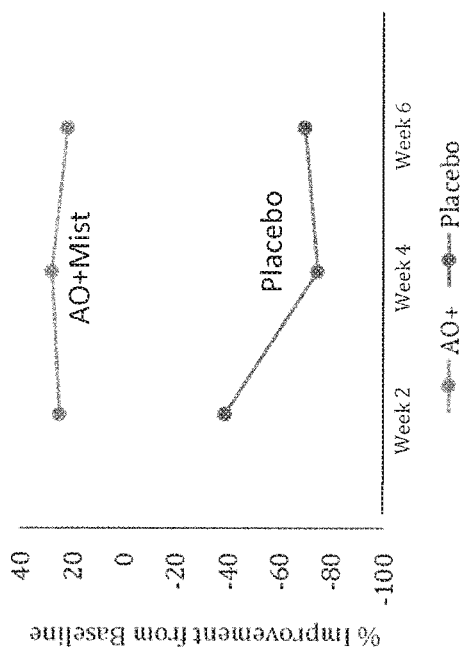
FIG. 3A shows the improvement of persistence of skin condition using ammonia oxidizing bacteria (AO+Mist) at Weeks 2, 4, and 6. Percent Improvement from Baseline (%) is plotted versus Week for AO+Mist and Placebo.

Results for subjects who used Placebo indicated a statistically significant increase (worsening) in response scores for the inquiry "the persistence/reoccurrence of your skin condition" at week 4 when compared with baseline scores. This is shown in FIG. 2A. The AO+Mist bars depicted on the graph are the first (from the left) and third (from the left). The Placebo bars depicted on the graph are the second (from the left) and fourth (from the left). FIG. 3A, also shows improvement in persistence in skin condition at week 2, week 4, and week 6 using AO+Mist. The line depicting the AO+Mist data resides above the line depicting Placebo data. Comparisons between the test materials based on the change from baseline for SkinDex response scores indicated a statistically significant difference for the following inquiries at the indicated time points, in favor of AO+Mist (*Nitrosomonas eutropha* preparation):

Your skin condition hurting—week 2

The persistence/reoccurrence of your skin condition—week 4

Worry about your skin condition—week 5

The appearance of your skin condition—weeks 2, 4, and 5

Tolerability Evaluations
All Subjects and Adult Acne
Use of AO+Mist (*Nitrosomonas eutropha* preparation) or Placebo did not produce any statistically significant increase (worsening) in tolerability evaluation scores for erythema, scaling, edema, burning, stinging, and itching at weeks 4 and 5 when compared with baseline scores or during the regression phase when week 5 was compared with week 4. Comparisons between the test materials based on the change from baseline for tolerability evaluation scores indicated no statistically significant differences at weeks 4 and 5.

Clinical Grading of Cosmetic Efficacy Parameters
All Subjects
Subjects that used the test material, AO+Mist (*Nitrosomonas eutropha* preparation), for 4 weeks had a statistically significant decrease (improvement) in clinical grading scores for blotchiness at week 5 (regression), and visual and tactile smoothness at weeks 4 and 5 (regression) when compared with baseline scores.

Subjects that used Placebo had a statistically significant decrease (improvement) in clinical grading scores for oily appearance (shine and feel) at week 4 when compared with baseline scores. Comparisons between the test materials based on the change from baseline for clinical grading scores indicated a statistically significant difference for blotchiness at week 5, in favor of AO+Mist (*Nitrosomonas eutropha* preparation).

Adult Acne Subjects
Subjects that used AO+Mist (*Nitrosomonas eutropha* preparation) had a statistically significant decrease (improvement) in clinical grading scores for blotchiness at week 5 and tactile smoothness at week 4 when compared with baseline scores. Comparisons between the test materials based on the change from baseline for clinical grading scores indicated a statistically significant difference for blotchiness and skin tone (color) evenness at week 5, in favor of AO+Mist (*Nitrosomonas eutropha* preparation).

Sebumeter Measurements
All Subjects and Adult Acne
Tables 15, 16, and 17 are related to the Sebumeter measurements and show that AOB application reduced sebum levels on the face of acne patients. Excess sebum is thought to contribute to acne.

TABLE 15

C15-CD035 Descriptive Statistics for Sebumeter Measurements

| Parameter | Treatment | Time Point | N (Total Available) | Mean | Standard Deviation | Minimum | Median | Maximum |
|---|---|---|---|---|---|---|---|---|
| Sebumeter measurements | AO+Mist | Baseline | 18 | 151.69 | 39.76 | 109.33 | 153.52 | 222.33 |
| | | Week 4 | 18 | 117.17 | 54.98 | 56.67 | 99.17 | 217.67 |
| | | Week 5 | 18 | 128.94 | 63.61 | 45.67 | 108.17 | 240.33 |
| | Placebo | Baseline | 18 | 154.50 | 47.68 | 100.67 | 142.67 | 249.33 |
| | | Week 4 | 18 | 148.89 | 62.53 | 42.00 | 143.33 | 248.33 |
| | | Week 5 | 18 | 120.56 | 67.96 | 38.67 | 112.00 | 299.00 |

TABLE 16

C15-CD035 Change from Baseline Statistics for Sebumeter Measurements

| Parameter | Treatment | Time Point | N (Total Available) | Subject Improved, % | Subject Worsened, % | Mean Change | Standard Deviation for Change | Mean Change, % | Paired T-test P-value[a] |
|---|---|---|---|---|---|---|---|---|---|
| Sebumeter measurements | AO+Mist | Week 4 | 18 | 77.8 | 22.2 | −34.52 | 39.96 | −22.8 | 0.002 |
| | | Week 5 | 18 | 61.1 | 38.9 | −22.74 | 46.27 | −15.0 | 0.052 |
| | Placebo | Week 4 | 18 | 50.0 | 50.0 | −5.61 | 46.91 | −3.6 | 0.619 |
| | | Week 5 | 18 | 77.8 | 22.2 | −33.94 | 54.56 | −22.0 | 0.017 |

[a]Calculated from Paired t-test
The testing hypothesis is that the mean change from baseline is equal to zero.

TABLE 17

C15-CD035 Comparisons Between Treatments for Sebumeter Measurements

| Parameter | Time Point | Comparison | Estimated Difference (SE) | Pairwise P-value[a] |
|---|---|---|---|---|
| Sebumeter measurements | Week 4 | AO + Mist vs Placebo | −28.91 (14.52) | 0.055 |
| | Week 5 | AO + Mist vs Placebo | 11.20 (16.86) | 0.511 |

[a] Calculated from Two sample t-test.
Testing hypothesis is that the mean change from baseline is equal between treatments.

Image Analysis of Pore Parameters

There were no statistically significant changes in image analysis data for number of pores, total area covered by pores, and average depth of pores at week 4 when compared with baseline values for either test material.

Comparisons between the test materials based on the change from baseline for image analysis data indicated a statistically significant difference for average depth of pores at week 4, in favor of Placebo.

DISCUSSION AND CONCLUSIONS

Overall results from this multi-site, double-blind, randomized, 4-week, placebo-controlled cosmetic trial indicate that use of the test material, AO+Mist (*Nitrosomonas eutropha* preparation), demonstrated safety and efficacy for the treatment of mild to moderate acne. The severity of disease, subjects' reported quality of life, and the number of inflammatory lesion counts all showed improvement in the AO+ treated group with a course of 4-week treatment. AO+ treatment appeared to have particularly beneficial effects in adult acne condition.

The study used the standard FDA Investigator's Global Acne (IGA) scale[1] to assess acne conditions using VISIA images under completely blinded condition. Results from acne grading of VISIA images indicate that subjects who used the AO+Mist (*Nitrosomonas eutropha* preparation) had a statistically significant decrease (improvement) in IGA scores using the FDA scale[1] at weeks 4 and 5 and in scores using the Griffiths' scale[3] at week 5 when compared with baseline scores. Comparisons between the test materials based on the change from baseline indicated a statistically significant difference for acne grading using the FDA scale[1] at week 4, in favor of AO+Mist (*Nitrosomonas eutropha* preparation). (See FIG. 1.)

Results of the acne counts showed that use of AO+Mist (*Nitrosomonas eutropha* preparation) resulted in a statistically significant decrease (improvement) in papules and inflammatory lesion counts at weeks 4 and 5, and global lesion counts at week 4, when compared with baseline counts. Although no statistically significant difference was observed between AO+Mist (*Nitrosomonas eutropha* preparation) and placebo, the data indicated a better and more sustained reduction in acne count in adult subjects who used AO+Mist (*Nitrosomonas eutropha* preparation).

The test product of the study, AO+Mist containing live *Nitrosomonas eutropha*, converts ammonia in sweat to acidified nitrite and nitric oxide locally. This mechanism is expected to potentially alleviate the main causes of acne by reducing local inflammation and reducing proliferation of pathogenic bacteria. The reduction in papules and inflammatory lesions and VISIA grading of IGA in a relatively short 4-week period are consistent with the expected mechanism of AO+Mist. FIG. 1 shows the improved IGA results at Week 4, through use of AO+Mist as compared to Placebo. The AO+Mist bars depicted on the graph are the first (from the left) and third (from the left). The Placebo bars depicted on the graph are the second (from the left) and fourth (from the left).

In preclinical studies higher concentrations of *Nitrosomonas eutropha* show enhanced antimicrobial effects against the acne-causing organism *Propionibacterium* acne, and accelerated skin healing. Subject-reported outcomes were measured using the Skindex16 Quality-of-Life survey. AO+Mist was associated with changes (improvements) in the group of questions that captured the subjects' emotional assessment of their disease. Specifically, statistically significant improvements were observed, in favor of AO+Mist (*Nitrosomonas eutropha* preparation), for skin condition hurting (week 2), persistence/reoccurrence of skin condition (week 4) (see FIG. 2A), worry about skin condition (week 5), and appearance of skin condition (weeks 2, 4, and 5). The appearance in skin condition improved significantly, as can be seen in FIG. 2B. The AO+Mist bars depicted on the graph are the first (from the left) and third (from the left). The Placebo bars depicted on the graph are the second (from the left) and fourth (from the left). FIG. 3B, also shows improvement in appearance of skin condition at week 2, week 4, and week 6 using AO+Mist. The line depicting the AO+Mist data resides above the line depicting Placebo data. Results of clinical grading for use of AO+Mist (*Nitrosomonas eutropha* preparation) showed a statistically significant decrease (improvement) in clinical grading scores for visual and tactile smoothness at weeks 4 and 5 when compared with baseline scores and for blotchiness at week 5 when compared with baseline scores and to Placebo.

The use of the test material, AO+Mist (*Nitrosomonas eutropha* preparation), was very well tolerated by subjects with no statistically significant increase (worsening) in clinical grading scores for erythema, scaling, edema, burning, stinging, and itching at weeks 4 when compared with baseline scores. The incidence of AEs was at about 2% and is consistent with the spontaneously reported incidence from approximately 3,000 users of AO+Mist. This safety tolerability profile would be attractive for many populations including women and adolescents.

This clinical trial is among one of the first to use self-photographs ("selfies") to capture facial acne conditions during the course of the trial. In order to determine if the self-photos are of sufficient quality for clinical assessment, the photos taken by subjects and the VISIA-CR images taken in the clinic were evaluated by a blinded trained grader. Analysis of correlation coefficient from grading results indicated a statistically significant positive correlation between acne grading scores from VISIA images (using the Griffiths' scale[3]) and from selfie images (using the Griffiths' scale[3]) at week 4 and week 5 (correlation coefficients ranging from 0.692-0.847), suggesting that self-photos by subjects may be a viable approach for documentation of progress during clinical trials.

REFERENCES

1. U.S. Food and Drug Administration. Guidance for industry: acne vulgaris: developing drugs for treatment. September 2005. http://www.fda.gov.
2. Shai, A., Maibach, H I, Baran, R. Baran. Acne in Handbook of Cosmetic skin Care. Publisher Martin Duntiz Ltd., Chapter 9, 81-100, 2001.
3. Griffiths C E, Wang T S, Hamilton T A, Voorhees J J, Ellis C N. A photonumeric scale for the assessment of cutaneous photodamage. *Arch Dermatol.* 1992; 128(3):347-351.
4. Rizer, R L, Mills, O H, Trookman, N S. The assessment of acne: a re-evaluation of grading strategies. Scientific Poster, Annual Meeting of the Am. Acad. Dermatol (2001).

INCORPORATION BY REFERENCE

All publications and patents mentioned herein are hereby incorporated by reference in their entirety as if each individual publication or patent was specifically and individually indicated to be incorporated by reference.

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations.

Certain embodiments are within the following claims.

SEQUENCE LISTING (66 sequences)

SEQ ID NO: 1 - DNA, 2537572 bp, Nitrosomonas eutropha (residues 1-1,268,786 of 2,537,572)
ttttctaaatccgggttaatttcttctacttgtcatgcagaaaatagagactttctggtatttctgtcttaagcatttcaaacaggaattgaatggacagcagtttaatacctggatcaagccgctcaagctggaaatctgtccggatgtggaaaataccctggttttaattgctcccaatcgttttgtattgcaatggatcaaggataattttgtcaaccgcatcgacgaaatggcacaaggtcatttcaatgaaaaaatccatttcaaactggagctgaaagatccagccgagatcgaaacagcaacaatcaaggcacctgaaccgaaaaacaaggaagacaagaaaccacctacagataaagcgcatggcaccaccgccagaaaaaccaatcccagccggctcaatcctgcttttacctttgacgcctttgttaccgggaaggccaatcagctggcacgtgccggggccattcaggtagcagaacgaccaggtattgcctataaccctttatttatttacgggggggtaggattaggcaaaacgcatctgatgcatgcggtcggcaattacgttatggaactagatgccggggccaaaatccgctatgtccatgctgaaaaatatgtatcggatgtcgtcagtgcctatcagcacaagtcattcgataaattcaagctttactatcattcgcttgatctgttgctggtggatgatgtccagtttttcagcggtaaaaaccggacacaggaagaatttttctacgccttcaacgcattaatcgaagcacacaagcaagtaatcataacttccgattgttatccgaaggagatttccgggctggaggaacgtttggtatcaaggttcggttggggattgactgtggcgatcgaaccccccgaactcgaaatgcgcgtagccattctgctcaaaaaagctttcatcgagaagatcgaactggacgaaagtaccgcctttttcatcgctaaatatatccgttccaatgtccgggaactggaaggcgcactaaaacgggttctggcgtattcacgctttaccggtcatccgatttcccttgatctggccaaggaagcgttaaaggatctgctagccatacaaaatcggcagatttcaatcgaaaacattcagaaaaccgtagcggattactacaaaataaaagtagccgacatgtattcaaagaaacgtgtcagggctatcgcccgacccagacaagttgcaatggctatcgccaaggaactaactcagttaagcctgcctgatataggcgaagctttcggtggaagagaccatacaactgtactgcatgcccatcgtaaaatcgtagaactacgtgcttccgatcccggaataaaccgggattacagtacattgatacatatcctgcgtggatgacgtaacacgccaataacccctgcatgttttgtggataactcgcataaaatcctgattggaaaattttgttcacaattcatccacaggctatactcaaatcatacaggattaatttaacgtgtaaatatataatatgtaagtaattttgttacttatccttatttttttcactacttaattattattatttagtttttaaattaaatgaaactaacaatatccgaccgggatttgctgttcaaaccactacaaacagtgagtggtatcgtagaacgaagacacacgcttcccatacttttaaacgtcttgatttcaatcagggatggcaaactggcactggtgacaacagatctggaaatagaagtcgaggcaacttccaatattccggaactggaaaatcagggctcactgcaaatgactgtttctgtcagaaaattacaggacatattgcgtgctttgccatctggttccccagtcgaactgatccggtcagaaaaccgtttacagatcgtttctggaaaaagccgctttagtctgcaactacttccagctgaagattttccgagaatggccagggacaatgagcgttgcgatacttcgttcacactgacacaacaaatgctgaagaagcatctgcagcgggtatcacatgccatggcgcagcaggatctgcgttattacctgaacgggacgttattgctgatcgaagacaacaagctgatgctggtagctactgacacgcacagactagcgataacttctttcgatctggatggacagtttgaaaaatcggaaacaattatcccgcgcaagacggtgttggaactgatcagacagctggaagatagtgacaaaccggtaattgtcgaaatttactcaaaaaagatctgcttccacttttcagatgctgtgttagtgtcgaaagtcatttcaggaaaatttatcgatttcagacgtgcaattccgcaaaccagtgtttttcagttcgatataaatcgtcttgatttcctccacgcactgcagcgcaccgcgattatttccagtagtaatgatttgtttcgcaacgttcatctgaatatcacaaacggaaagctgaatatatccgccaaaaacaaggaacaggaagaagcacaggaagaaattgaaatcgtttattcaaatgaaacaattgataccagttttaatatcgtttacctgatggaagtattgaacaacctggatagcgagcatatcaggtgctcttttgagagtatgcaaagcgctatattaattacgttgccggatgatgatcagttcaatcatgtcctaatgccaatgcgcgagtagtacaaacctactcgccttatcagatttaccggaattacaaaagagataactttaaatatgaatacaagtcagccagagtccaccaaaaataccgagagcagtcaacgcgattacgactcgaacagcattaaaattctgaagggactagatgctgttcgcaagcgccccggaatgtatattggtgataccagtgatggcaccgggttgcatcatatggtgttcgaggttgtcgataatgccatcgacgaggccttggcaggctactgtgatgaaatttccgtaattatccatgctgataactccatcagtgttcaggacaatggtcgcgggattcctaccgatatcaagcaggatgatgagcagaaacgttctgctgctgaaattgtcatgacggagctgcatgcgggcggcaagtttgatgacaattcctacaaggtatctggcgggttgcacggtgttggtgtgtccgtggtgaatgcgctgtcagaatggttacgactgacaatttaccgcaagggaaatgttcatcagatagagtttcgggatggcgtagcggttgctccattggcagttactggccaaactgataaacacggaacagaggtgcatttcctcgccagtcaagcgatatttggtaatgtaacttatcattacgatatcttcgccagacgattgcgtgaactctcctttcttaattacggaatcaggatcaggctggtcgatcggcgtgataatcgggaagagacttttgcgttttccggtggcatccgtaatttcgtcgaatacataaaccgtactaaaactgtgttgcacccgagcatcttttatgcgaaaggaatgaaagatgatattactgtcgaaattgcaatgcagtggaatgacagttatgctgaacaagtactgtgtttcactaataacatcccacagaaggatggtggcacccatctgaccggattgcgtgcagcgatgacgcgcacactcaacagttatatagaaaaaaacgagctggctaagaaagcaaaggttgataccacgggtgatgacatgcgagaagggatgacctgtgtgttgtcgatcaagctgttcgaacctaagttttcatcccaaaccaaggaaaaactggtttcatccgaagtacgtccagtggttgaggaagttgtttcacataaactttcagagtttatgctggaaaatcccaatgaagcaaagattatctgcaacaagattattgaagctgccagagcacgggaagctgccagaaaagcccgcgaactgacacgcagaaaaggcgtgctggatagtatgggtttgcctggaaaactggcagactgtcaggaaaaagacccgaaactatgcgagctttatctggtggagggagattctgccggcggttctgctaaacagggacgtgatcgtaaattccaggcgattatgccgctcaaaggaaaaatcctgaacgtcgagaaatcccgctttgacaagctaatttcctcccaggaaatcgtgtcacttataactgctttgggaacaggcatcggcaaggatgaatacaatccggataaactgcgttaccatcgcattatcatcatgactgacgcggacgtggatggatcgcacatccggactctgctgctgacctttttctaccggcaaatgcctgaattgattgagcgtggtcatatttacattgcacaaccacctttgtacaaaatcaaacatggcaagcaggaaagttatctcaaggatgattatgaactcaagcgccacatacttggtttagcgctcgtgggtgcagaactgcatcccgggatggataatccaccgattgtcggagaaacattagcaaagattgcagatgaatacctggtagctgaggcagtgattgaacgaatgagccagttgattgatcgggctgtgatgtatgcgctacttaagcaacctaatatcgatctaagttcagaagccggtgcgcaagacagcgccgtcagattggcatcgttgctggatgatgttgaaattactgcggaatacgatgaagattctgagaattaccagctcaggattaatcgtaaacagcacggcaatcttcgaactagttatctggatactgattttctgaaaagtggtgatttcgccaagatcaggcaaactgcacaaatattgcatggtctgatcgatgaaggtgcgaaggttaagcggggtgaacaggaagtacccattctggaatttaaggaagctctggaatggttgctggcggaggccaaaaagggtgttactatccagcgttacaaggggctgggagaaatgaatccggagcagttatgggaaacgacgatggatccgagtaatcgcctcctgttacgtgtacagattgaggacagtatcctgaccgatgaaatcttcactaccttgatgggcgatgtggtcgagcctcgccgggcattcattgaaagtaatgctcttcgcgcaaggaatatcgacatttaggtgaattttgaggattttttatgtcgacagaatttaataaatcaatgaatcaggcacaaacgaatattaacctgcttcaactgcatgattcacctgtcgtgcgctggttatacttgggtatcggtgtaactgccctgtttataggtatattaggcatatttttacccatactgccgacaacaccatttgttttactggcggcaggctgttttgcgcgtagctctgagcgttttcatggctatctgctcagtcatcgtatcgccggaccgattattcacgaatggtgcgaatatcgcagtgtgacgcgccaggtcaagcgttgggcatatctggtgatgtcgttatcctttggtagctcgattttgattgtttcttcctggggattaaaaagtatgttggttttactggctgtaatcctgtttacgtttatctggcgcttgcctgtacgggatgagaacaagtaacacaccgatttcacgttttttgatgatgtgtagttctataagcagtttgtttattgatggaaaaagttcgcttgtccaagctgatgtccgcgcagggaatgtgctcgcgcagggaagcagatgtttatatcgaacaaggttgggtctatgtggatggacagccggctcgtgaactggggacgaagatttatccctggcaggaaatcacacttgatcgaacagcccagataaaacagaatcagcaagtaacgattttgttgaataaaccggttggctatgtatccggccagcctgagcttggctataaaccagcggctagtctgatttgtcacgattctcgttttcatcgagatcgttcttctctgaaatttacttcgcaacatctcaaaaatcttgccccggctggtcggcttgatattgattcacagggattgctggtattcactcaggatggccgtgttgccaaacagttgatcggagaatattcgcaaattgaaaaggaatatctggtacgggtaatcggcaatctgacgcgcaaagggctggcattactcaatcatggtttgcagctcgacggccaagtattaaaacccgccaaggtgagccttttaaatcaagatcaacttcgttttatcctgcaggaaggtaaaaagcggcaaatccggcggatgtgtgagttggttggtttaaacgtatccggattaaagcgtgtccggattggccagatcagattggctgacctgccagaaggaaaatggcgctatcttggcaagaacgaattgttttgaatgtactggatcccaagttagtttcaatcaaaacaattattatcaaagccataattcttgacaaatttgaaggggtctctataatcacccgtctgtcgagaggcaaatccaagtttattagtccgttgtagtttgcgggaatagctcagttggtagagcacgaccttgccaaggtcggggtcgcgagttcgagtctcgtttcccgctccattttattgttttatgctgtgttctgcatattccggcgtttcttggtccacgtcaaatttccatgcttggcgtcgtaaagtaagcgacgcttatcaaacggttcatggcggggtggcagagtggttatgcagcggcctgcaaagccgtctacgccggttcgattccgacccccgcctccatacatattagaagtgcttcgtaattgcccgggtggtgaaattggtagacacaagggacttaaaatccctcggacataaacgtccatgccggttcgattccggccccgggcaccaggaagtcacagcgtacttactgagtagtctggtatgcgccggattatcagcacgatcggtagtaaaacgttctgtaaaaacagcatgtccgtcacaattgtcgaaataatggaataacccgcaattttgctgtgtggtagtggaattcatccggattctgataaaatcacagattcgttataggaagtgccgttcgaggaaaaaataccatcatgacttatgtagtgactgaaagttgtatcaaatgtaaatataccgattgtgttgacgtgtgccctgtggattgctttcgtgagggccccaattttctggtaatcgatccggatgaatgtatcgattgtacgctgtgtgtggcggaatgcccggtggaagcaatttatgcagaagatgacgttgctgaagatcagcgacggttcatcgcactcaatgcggagttatccaaaatctgggaaccgattatcgagaagaaagatgcactgccggatgcagatgaatgggcgtctgtcgcagacaaactggatcatctggaacgctgataaaggttgcaatcgcaaagccgttaatcatcatcacatataacaaaacagtcaaggagacgtgaatgatgaaaacttcgattatatggattttttttctgatgctgctttgtgtacttccgcagactgtcatggcagagcatggttcagcacaaagctatccggccgcagcaagtgaaaaactggttaacggtattgctaacgcggcaaccggttttgttgaacttcccaaaaacgtgattcttgccactcagcgggacggtgctgcatacggggtgactatcggttttttgaccggtattctgcatacgattggacgcactgtatttggcgcactggatgcagcaacctttcttattcccactcgaccgactgttcgcccgccttatatctggcaagattttgataaagaaactacctatgggtaatttttattgcctgcctgcttcagtttttcaattccgtcatcaatttcctgattttctttatccgctctccgatatccgggatttgcgcccggatgatcaagcgatcaggcccggacatactgtattccttaccactttggataagctgaatgatttttatagcttcgatcggtggatcagttacaaactgtaactgaatactatcttggcttgcgtcaatacgagtaatacccatttttttggcttcaatgcgtagtcggtgactgtccagtaatgcacgggctggatcaggtaacaggccaaagcgatcaatcaactcctggtgaatctcatccagctccgcctcatcgctgcaacccgccatgcgcttgtacagaacgagccgttcatgaatattgttacagtaattttctggcagtagtgcaggaacatgcagcctaacctccgttgaaataccgagaggttgctgcatattcggctcatgacctgctttcaatgatttaatcgccgcatccagtaacgaattgtaaaggctaaatccgacctcttgcatctcgccactttgtgaatcccccaacactgcacctgcaccacgaatctccaggtcatgcatggccagataaaaaccggatccaagctcttccattgcctgaatggcttccagtcgtctgattgcctgtattgtcagtgctgctttttccggtgtcagcaaataggcatacgcttgatggtgcgaacggcccaccctgccgcgcaactgatgtaactgtgccagaccgaacttatcagcgcgatggataataatcgtattggcggtgggaacatcaattcctgtttcaatgatggtcgtacacagcagcatattgaaacgctgctgataaaaatcacgcataatatgttccaactcgctttcccgcatttgcccatgtgcaatgtttatttttgcttctggcagcagtttgatcagcttggtatacatgttctgaatggtgctgacctcattgtagagaaaatagatttgtccaccacgtttcagttcgcgaaggcaggcttcgcgaatgattccctctgtgtaagggtgtacgaatgtccggattgccaatcttctctggggagcagtagcgataactgaaaaatccctaagaccttcaagcgacattgccagtgtgcgtggaattggcgttgcggtcagtgttagtacatccacttcagcacgtaatttcttgagttgttccttctggcgcacaccgaaacgatgttcttcatcgatgataaccagccccaggtttttgaatttgaccttgtcctgaatcagcttatgcgttccgataataatatcggttgttccttgcgccaagctttgtagcgcttcggattgttctttggtcgaacggaaacgtgaaagctcagcaatttttaccggccattggtcggcaatcagcccgaagcgatcagagaaactctgataatgctgctctgccagcagcgtggttggcaccaaaatcgcaacctgcctgccatccgcgatcgcaatgaaagcagcgcgcaaggcgacttcagtcttgccgaagccaacatctccacaaatcagtcgatccattggctttccggaaaccatatcctgaatgaccgcatgaatggcggcagcctgatctggtgtttcctcaaaaccaaagccgtctgcgaagacattgtaatcatgttgattaaggcgaaatgtatggcctttgcgggcggcacgctgtgcatacagatttagcagctcagcagcggtatcgcgtacctgttgcatcgccttgcgcttggctttttcccattggccacttcccagcttgtgcaaaggagccgcctccggcgcagcaccgctgtagcggctgataagatgaagctgtgtgaccggtacatacagcttgtctcctccctgatattccagcgcgaggaattcgtcagattggtctgaattattctcgccagcatccatacttaccaagccgagataacggccgataccatgttgttcgtgcaccactggattgccgggtttgatttcagacagatcacgcaaaatggaatcagcagaagtggttttacgtgcatcgcgcgcgcgctgtccgcgtacatgggtagcatacagctcggtttcggtgatcagtgccagtttttctgcagccagaataaaaccattgtgcaaggccgccacaccgagcatgcagagcgtgcgatccgattgaaaagcagcatagtcttcgcagagttttaattgcaggccatattcacgcaagtattcggccatcagctcgcgccgccccaggctttctgccaacagtaaaatccggcccccgtcctgcgtaaatgtgctgataaaagtggttaactgctcgattgggttggcagcacgacgatctacccgcacagatggaagaggaagagaaaacggctcaccaattgtttgctgatcaccgccttgtatttctattcgactgtatgctttgaggtagccgtaaaactgatcttccagcaaaaacagatcagcggggggaagtaaggggcgatcaatatcactgcgcatcagctgaaagcgtgatcgggtatcctgccagaaattttcaatggcggatgcaatttcaccgtgcaggcacagcgtggaatgctgtggtaaataatcaaataatgtagcagtctgttcaaaaaaaagtggcaggtaatattcgattccggcaggaatatttcccttgctgatttcctgatacagccagctgcgcgttggatctccctcaaatttttcccggaagccggtacggaaacggctgcgcccggtatcgtcgaggggaaattctcgtgccggtaacagccggatttcattgactggataaatactgcgctgggtatccgcatcgaatgtacgtatggattcaatttcatcatcgaacagatcaatacgataaggaagcgggctccccatgggaaacaggtcgatcaaccctccgcgaatactgtattctcccggcgaaattacttgtgaaacatgggaatagccagccaacgacatctggctgcgaaatgactgcaaatccaatgtactgttttgtttgatgaagaacgaatacgctgccagaaactctcgcggcggcattctgtataacgcggttgtaaccggtacgatcaatacgtcgcaggcattgtttacaatctggtgaaaagtagccaggcgttctgaaatcagatcatggtgtggggaaaaaacatcgtaaggtaaagtttcccagtccggcaataaactcacacgcaaatcgggtgcaaaaaaagggatttcctcaagtaatcttcgtgcatcctgtgcattggcggtgataacagtcaacagctggttgtcctgattctgctggtttgccagttgtgccagggcacaggtatcactggaccctacaaaaccagtgtaacgttgtagatgtcctggacgaattttgattggtttggatgacattgttttacaaacggagtttggattgttcagaaatatgccagatgtgaagccaggaaaaatgcaccaaccagaccggtaatggtagctattgttcccaggaaacatcgtttggccaatacaatgtttccggtaaaaaatattagtcccagcttaaaaatgagattggcaattactccgagcgtaattgcgatcacaacttcggtgatttccagttgacccatctcgtacaaacgtaagctgctcagtgtgatcgcatccacattggttagcccagaaataatggccacagcgtataatccgctattgccggcgatctctgataaccagccggaaagaaacaatactgccgcgtaaagcaggccaaatcttacggcgatcgagatttctgtcggatttttggtatccggcattggaacagcttgctgctggctaaattcacgccacctgaacactgaagcgattaatcccaaaaaaagaccgccgcccagaatgggcgtaaggtagggaaaaatagttggagaaatgatctcggtaatcaatgcaagcctgaccagtacaaccaaattggccagtaaaattacaataactgccgtattgatcagatcaggcttatctccgttatggcgcgtaaacaccatcgtggtagccgtactggaaaccagtcctcccagcacacccagcagaacagcaccatgacgctgaccaacgaaacgtaatgcaatatagccagccaggctaatgccagagatcagtacgatcatcagccatatctgataaggattgaatgcgttgaagggaccataatccttatcaggcaaaatgggcaggataatgaagctgagtaccgcgaattgcagtatcgaaatcagatcctttcggctcaggttttgtgaaattccctgaagctcggttttaaaataaagcaatatagttgtgataatggcaagcataactgccaatattgattcttcataccataccaaagcccccaatccgtaacagatcagtatcgcagcaattgtggtggtacctggatccttctgtttttcccgtttatcccggtaggacgaaatcatcatgattccgattagcaacaatccgctgattagcagccagggtgtttgcaccttatccgatagcacggcggccagcgtgccgaacatggccaccagggcaaaagtgcgtaaccccgctttggctgctggatgtcgttcacgctccagaccgatgagcaagccaatcgccatgctggtggcaaattcaaccaaataaacccgttcatgttcaggaaaaaatagttcatccatattgtgcgtaaccagacccaaaccagtgttcaagtagtaactgcatacgggtgcttccgttatattcgttcagctgtacccggtagacagcatcaatctcggctggcaaacgttcagtatgaaaaaacagaatgccatcgtatatccggctggcgccagctttgcgcagcttcagtttcaaatgtttttctcctacaattcgctgattttcaacccggaagcggccgttgaaactgggttcaggaaaaccttgtccccagacttgattggtcagatattgtgccagttccagagtcagatctctttcttccagttcaccatcggtttcaattacttgtatcaaatcaacaggcgtcagcagtgactgcgcaacttgctcgaatactacgcgaaattgttcaaaatgctgtgcatgtactgtcagaccggcagccatagcatggccaccaaatttgacgattaatcctgggtgacgttttgtaaccagatccagtgcatcgcgcaaatgcaagcccggaattgatctgccggaacctttgatttccccattatttccctgtgcaaacacgataaccggtcgatgcaatctgtctttgatgcgcgatgcaatcaggccgataacgccctgatgccaatctgaatcgtacaaacacaggctgtaaacagggtgcaccctgttattggctggcgcatcgatctgatcaagcatatttatcaccccttccagcttgctcatcgcttcatcctgcatgcctgcctcgatttcacgacgctggcggttcagttcatccagctcgctggccagatgcagggcacgggattcatcttcggccagtaaacattcgattcctagtgacatatcatccagccgtccggcagcatttaatctgggggcaagaataaatcccagctcataagtggtgacacgactgaaatcacgcccagctaccttgaacaacgcatgaataccagcacaacaatggccgctgcggattctctgcaatccctgctgtaccaggatgcggttggttccttccagcctgaccacatcggcaacggtgcccaatgccaccagatcaagcaggttggccagattgggctctttacctgtcgcaatgaaggatcctcgttcacgcagctctgctcgtaacgccagcattacgtaaaaaattacgccaactccggcaatatgcttatcaggaaaatcacatcctggctggttgggattaacgataaccgctgcctctggcagttgatctccaggcagatgatgatcagtgataaatacctgcatgcccagccggtttgcttccgcaacgccctccacgctggcaatgccgttatccacagtaatcaggattgcgggaggaggattgcaatttgctgccagctgcacgatttccggtgtcagcccatagccgtattcaaaacgattgggtacaagataatccaccacagcaccaaactggcttaatgcgcgcagggcgactgcacaagcagttgcgccgtctgtatcgtagtcggcaatgacaagtaaacgcttttttgccgcaattgcatcggctagtaaaactgcaatttgcctgatattttttagttgctgaaatgatgccatgtgggaaaatgttgtatcgagctgattcggtttttctatgccacgtgcagcaaaaatacgtgcaagtaccgatggcaggccgtgtacagtgagggtttcgtatgcgtgagagggaaacttgcggataataatattagtcatgaccaatattttatcaccgggttgcaataagccggtttgaagaaacagtttgcaagctggaggaggtggattttgctatatcaagaaaccggtatcaatcccgggaaaaggaagtaaaagggacaggagtatttcgatcacggatgaattaccgtcgaaaatactcctgtcagacaggtatcagaacttacttcggtgcaaccacgcctgattcgccggttgccttggctgcgcgcagtaccggataaaactgtgtgtaaaccatatctgtcttggcattttccttgtgacatgcagcacactcagccgtaggcaagtttttagctgcggtaaccagcggtgtaccaggcacatagaaaatgtagaaagcccagtttcctggttcatctgggaagcgttttgaatccttgacggatgcttccaggccgatatagtcacccatgaaatagccattaccgctgcccgggcctttgcggtcgccaacgctgatcagctcttttacggtcatggcgccatctcggaattcccctgtttttttccagtgggcatagctttcaggatcaatgtaaacggttctgatttcggtaaagggtgcttttccgtcattcagttcgtcgggtgtcacctgagtaccgatcatcacccattcacgataatcttttggtaacagcagctctcccttatcattaaattcggccatacttgctgccagtgtactgctgaccatcacggcagaaaaaaccagaccactcaagctgctcgccagttgttttttaaagttcataaaggtctccttttagttgatgttgatagcataattatttcatctcgatcgggaagatgcttacccggtcggcaggtgcggcgcagtttacgccagatttgttgtgaacaggtttgccagcgcaacaccagggtccggtgcgcgcatgaaggtttccccgatcagaaaagtgtggatgcgatgagatagcatcatctctacatcagctggtgtacgaatgccactttcggtaacgataattcgtccggacgggatatgtttgaccagctgcaaggtcgtatccagtgtggtttcaaacgttttcagattacggttgttgattccgatcaatggtgtggacaattgtaacgcgagatcaagctcatctgcgttatgcacttccaccagtacggccatgtccagttcctgtgcaatggtttccagtttgtgcatccgttcgagtgcactgtcaccttgattgatagcggaatcatgctgaaaaattggtgaaaaaaaggctgcaacgatcagcagaatacaatcggcacccatggcacgcgcttcgtagacctgatattcgtctaacataaaatccttgcgcagcaccggtaaatcacaagcagcgcgtgcctgccgtaaaaaatcagcattgcccatgaagaactgctcatccgtcagcacggatagacaggccgccccgtttctggcgtaactggctgcaatgtctgtcgggataaaatcttccgggatcggattctgcccggataaatttcccacatgtcctgatccagaaacattttgtgactctgtttggccgcgcaataagcccttgcttgggctggcccgtttgatctctgcaatgacagcagcgtggttttgattaatccggctgcgtatggcctggagaaaatcacgtggagcgggtactgcccgtgcttcgtcatgaattttatccagtgatttttgtgtttgggcagctgaaatctcctgcttttttacggcgaggatgcgatcaagaatatctgacatgcaaaactaattaatgggttaactgattggagaatttgattaatgccagcattttttctttggcagcaccactagccagcttgtcacgggcaatttccaccccttcggcccaggaatcagcttttccagcgacataaattgctgcacctgcattgagtagaacaatatctctggcaggcccgggatgattatccagcacagacagaagcattactcgtgcatcgtccgtactatttacctgcagagattctattgcggtacgttccaatccgaaatcttccggctgcaccgtatattcccggatttctccctccttgagttcagcaattttggttgggccggaaatggtaatttcatccagcccatcgctgccatggacgatcattgcgtgctggcttcccagccggagcaaggcctgtgccaatatcccggtcagatcttcattgaatacacccaacaactggtttttagcacctgcaggattggttaacggccccaggatgttaaataacgtgcgcacacccagctctcgacgaacgggggccgcatgtttcatggcatgatgaaaattaggagcaaacataaaaccaatgccaacttcggtaatggattgggcaatttggtcaggcgtttgattaagatggatgccgattgcttctagtacatctgcactgcccgctttgctcgaaacagaacgtccgccgtgtttggctacctgtgcatctgcagcagcagccacaaaggcggaagctgttgaaatattgaaggtattgcacccatccccaccggtaccgcaggtatcgaccagattgactgaatcggccacttcaatgtgcaaagccagttcacgcatgacttgagccgctgcagtaatttcaccgatgctctcacgtttcatgcgtaaacccgtcatcagggcagcagtcattgccggtgaaacgtttcctgacatgattgcgcgcatcagctcaaccatttcctcataaggagtttcgcgctgctccaggattcgagcgagaatagcttgtggtttcacgcttcgcacagttttgatgaatggtcttgaatatggtgatcgcgcagaaaatttttgagcagctgatggccatgttcacttaaaactgattctggatgaaattgcacaccttcgactggcaacgtacggtgtcgcacgcccataatttcaccttcttcagtccaagcggagatagcaagacagtcaggtatacttgatggttcgataattagtgaatgatagcgggttgccatgaacggactggcgatcccctggaaaacgccctgaccatcatgaaaaaccggcgatgttttaccatgcatgactttttcggcacgtacaatccgcccaccgaaagcttggccgatactttgatgaccaagacacactcccaatatgggaatttttccactaaaccgggtgatcaattccatagaaacacccgcttcatccggcgtgcatgggcctggtgaaataacgatgccggctggattcaactgctgaactgtatctagcaaaatttcatcgtttcgaacaaccgtaatttcctcaccgagttcacccagatattgcactaggttgtaggtaaaggaatcgtaattatcaatcatcagcaacatggcgagtacaatggttatttaatatccgggaaaaattgctgtgcagagaatcaatgcgggaaaatggccataatctttctactcaggtattttcgcccaggtcgcacgaaaggtaaacctgatatatgaaaatttctacagatgtttcatcttccgagcgaatacaccggaaaaacagatccagatataaaccgaaatcatttctggctctaatcctgcttggattttcaattgtcggcctgcctctgatcagcgcgctgatatacagtgccatacgtattgatcagttatccgaacaaagccgatacaatgtttatcaggccacccagattaccaatggtaccggggttattattggtgaaatcatggcgatggagcgtagtgtgcaacatgcgctggtgctggatgatgcaactctgctagaaggttattttattgcgcataccaagtttgaaaacattaccaatcacctctccattatttccacgtatccggaacaacagcttccactggaaaagctgcggctactggaaactggaatttttcgggaaatactggatctgaaagaacacccgcaggatttacagtatctgcttgaacgtttcgcttctttgctcgaccttgcccaggaattttcaaccaacagttttcgtatgatcgggcaaagtgtcggtaatgtaagtgagattgccacacaaacccgctcactggttgaatgggagttactgattctggttccactggttatttttctggcactggttttttccgtatttattgcccgtcccgtccgccagattgatgaagcaattgctcaaatggggcgtggtaatctttcccgaccaatccgtgtcaacgggccgcaaaacctcacctacattggggaacgtttagactggctgcgacagcgcctgctcaagctggagaaccagaaaatacagttctttcgccatatttcccatgagctgaaaacacccctgacagcgattcgggaaggcgctgatcttttggctgagggggtgacgggcaatctcaaccggaaacaacaactcattgccgggattcttcataccagcagcatacaattgcaaaaacgaatagaagatttgcttaatttcagcgcgctccaggcggagatcattacgcttgccaaacagaatgttaatctggaaaaaatgataaattcagtcattcaagcgcaaaatctttccattctgagcaaaagtcttacaattaacctgaattgcccggagttatttctggagtgtgacaaacagaagctggacatcatgcttgataatctactttccaatgccgtcaaattttcttcggcatatggttacatcgaaattactgctttgtgtgatgaaaacaaggtgcagattgacattatggattctggcccaggtgttgataatgctgatggagatcggatatttgagccgttctaccaggggcgcaatacgcctgaaaatcatgccaagggcacgggcctcggcctggcgattgcgaaggaatatgccgtcgcacatggaggaaatatcgaacttgttcgggataccggaaaatgtggtgcacattttcgattaacattgcccaccaacagttctgaatccacatcatgaaaacaatttgtaaattattggcagggctgattttaatcacgacccttcccgggtgtatgcgtacactagttcagccggtacatcaaccatccgaacatatggaaacccggattatccaggaaccggatgacctgggtgagctaatgcgttactacagtgtactacaagataaatccaaatcagagctcatcgaagagtatcagtacgccaacagtcattatcgcgacagcatcgatgcacaccagcgacttaaattattgatactgttgttgttgcccgataccggttttcaaagtacgcgagctgcactggatctaatggaaaatcctccggagcagatcgagtcgactcccgctacgaccgcctttcaaaacttgctgatattattacttaagcagcagcgagcagcgaatttcaaaatacaaagtttgtctgtaaagttacggacaacagaggcagaagtaaaaacactgcaagataagatcaacgcaattaaaaatattgaaaaacacttcatgcgcaaaagtgcattctgattaattagctggctaaatgatgcaaagtaaaaaaattcttctggtggatgatgatccggatttacttgagctgctttccattcgcctgacagcagccggatatgaaacggttcccgccgaaagtgccgaagcggccatcaattatctcgacatatcacgaccgcatctcgtcattagtgacatacagatgagcggcatggatggtatggcattgttcgagcatatccatcgtcatattccaacgcttccggtcattatcctgaccgcgttcggtaccattccggatgctgtcgcggcgacgcagcgcgggatttttggttatctcacaaaaccatataatcctaaaattctgctgagccaggtcgagcgtgcaattgatctggcgcctgctgtagatacaatctccagcaaagtgcctgccccgacatggcggaaagcgatcattactcgcagtgcgctcatggaagatctgcttgccaaagtggatcgcgtcgcgcaaggcaatgccagtgtgctgctgtctggtgaaagcggtgtcggcaaggaattatttgctcgtgccattcatcaagcatccaaacgctgtgagcagccgttcatcaccattaattgtgcggccattcctgaacaactcctggagtctgagctgttcggtcatgccaaaggtgcatttaccggggcagtccgggagcataaagggctgttccagctggcagaaggaggtagtctgtttctggacgagattggtgatatgcctttgctgctgcaggcaaaattgctacacgcactgcaggagagggttatccggccggttggaacagctcagagcatcccgattgatgtacgtatcatttctgccacgcataaagatctgaaatcggagatccaggcaggaaatttccgtgaagacctgtattaccggctttttgtggtgggtttgacaattccttcacttgcccagcgtggtgaagacattcctctgctggccaatcattttctgcgtgtatttgccgagaagcaccaaaaggatatcaatggcttttctccggaagcaatcagttttctgctggcatcttcctggccaggcaatatccgccagctgatgaatgttatcgaacaaagtatcgtcatgagtgcggttcctctcatctccagcgaactgatccgcgatgccatgcacaaagatgaagagcagatgatctcgtttgaggaagcccgcaaacagtttgaaagagattatctcgtcaaggtgctgaaaataactgccggaaatgtaacccaggcggccaggctagccaagcgcaaccgcaccgagttttacaaactgctgcaacgacaccagttggatttcacactctataagtccttgcaggaaaaggtctgatttcccgtttatttcactaaaggcgggaatttcgcaatgatttcaatgatgacaccttcccgcaacactttcaggggcaaccaggtacccggtgcctgacgtttaaccgcaacaatcacatcattgctttcctgaagggtactgccagccatttcaagaattacgtctccggcctgtaatccggcagattcggcgatactccgtttttcgacttgtagcacgagagcccccccggtttttttgctgaactcaaagccgatgcccaaacgctgctgcaatggagcggctgataccgatgtaaacggcatcaggccaaatactgcatcagcataaccttcaaccagtggcttgcaggatcggttggtatcccatggcaacaatgcagcaatttttttcacaccgagatcttctagctggtgaggtacaccaaagcctttcaggatatgaccggagcccataatgcccaccaccagcggatttttgttcttgtcataactgctgagcgccatatggatttcctgtgccattgcccgatcccataactgctgactgacaacaaagcgcaaaaaatcgggatcataaacatttggtttttgagcttttccagtagatttatgagcggggcgatcatgctgtacataaatgggcagcagaaattccagatattccggtgtgggaggtgctggtcgcgtgacgccttctcgatctttttccagtacaccatcgaatcctttggaggtgacagcccgtctcagtgcaatatcaatgttaagggcgcgcattggaatgcggttcatccgcgcaaagtggaacagcggcaggtacagattggcatccgtattccaaaccgattgccattcagatcgagccagaaattcggactctgtcagctctcccgccacccattgatccagaattttctgcacccggcgtggaaacatctcaaagccgattaccatgtccggacgtgcagcgtacaaggtagccaacatttgcagttgccagcgatgatgttcaggattagcgtgcatctcgcccagtaacaccacggatttgtcctttactgacgtcagcacgctggacagtgttgtttcccctttaccggggattatccagcttgcaaccggaacacatttgtccggtgtgatctgcttactggtagaaactatttttttctccgaagcagtttgggcggcaagatcagaaacattcaccattcctcctagcaacagtaaaccgggtatgacaaattgccgagcagactttaaatcaatcattattttgttatgtatttttaagtgtttgtgtaacatcaatatattagaagtattctcaatccacccatttgcgggcattcctgaacattttcatccagggggcatcttccggccaatcgtcagggtgccacgaatgctgcacggtgcggaatattctttccggatgcggcatcaaaattgttacccggccatcagttgaagtcatgccggtaatgcctgcaggggagccattgggattaagcgggtaggtttctgtaagctcgccgcggttgttgacaaactgtagtgcaatgtagggttgcgccgcgagcaattgcccattatcgcggaataccgccaacccttcaccatgcgcaacggtgatgggcaagcggctaccagccatgccatcaaaaaacagagaagggctgttcccgattttagccatgacaaaacgtgcttcaaactgctcggaacggttgcgctcgaaacgaggccaatgagcggttccgggaatgatagcctgcaggtggctcatcatctgacaaccattgcatacgcccagcgcaaaggtatcagtgcgaacaaagaaagcggcaaattcatcccgcgcccgcgcgttgaacaaaatggattgtgcccatccccggcctgcacccagcacgtcaccgtaagagaatccacctccggcaaccaagcccttgaattcggccagtttcacccgcccggacaaaatgtcgctcatgtggacatctacggtatcgaatccagcacggtcaaaagcagccgccatttctacctggccgttaactccctgttcgcgcagaatagcaactgcgggacggctggcaaggatgcctggtacagaagcagctttatccagtgaaaacgtcaggtgaatatgcaatcccggatcatctgtatccagcagtcgatcaaattcctgttgcgcacatccgggatgatcacgcagtttttgcatctgaaagctggtttccgaccagatacgttgtaatgccacacgtttttcctgaaagatcaccttgccgtcatacatcagatggatgtcatcctgtcggttcgggtggccgatcaggtagctggcttgtcccaatcctgcccctgccagaatagtcatcactgtagcatgatgccgggtttcgatctggataatggcgcccagttcctcgctaaacaaagttgacagcacttgtgtgtctacaacatcaactgatctggagatcagtgcatccagcgcgatgctgacgccgcaatgtccggcaaatgccatttcacagagtgcgacaaacagcccgccatcagagcgatcatggtaggccagcagcaaaccttgttcattgagcgtttgcacggcatcaaaaaaagctttgagtgtttccggactctccagatcaggtgcatgatcccctgattgtccgtaaacctgcgccagcgccgatccaccaagccgatttttgccattacccagatcaagcaaaatcagctcagtttcgcctttatctaaccgcagttgcggcgtgagtgtcttgcgtgcatcggagactttggcaaatgccgaaataatcaatgaaagcggtgcaattacttctttttgttgtgagtcatgccaactggttttcatcgacaatgaatccttgcctaccgggatactgattcccagtgtgggacacaattccattgctacggcatgtacggcgtcatacaatgcggcatcctcacccgggtgtcctgccgcggccatccagtttgcagataatcggacggttccaaggctggcaatcgcggcagcagccagattggtaattgcttcccctaccgccatacgtgccgaactggctgcatcgatcacagccagcggcgtgcgttcacctagcgcgaatgcttcgcccagatacgtctgaaagcccgaggtagtaaccgcgacatcggctaccggcacttgccatgggccaaccatctgatcgcgcgccgtctggccaccaactgtgcgatcgccaatcgtaatcagaaaggatttgttcgccacggctggcaggcgcagaacgcgactgaccgcttcctgcaagcgtataccggttttgtccagaggagtaggggcagggtggatacgttttacatcgcgcaccattttgggtggtttgcccagcagtacggataaaggaatatccgccggatgagtggccgaatgttcatcggccacaatcagttgcggctctgtcagtgcttcaccgacaacagcaaacggacagcgctcgcgttcgcaaattgcctggaacaaaggcagggattgcggatgaatggcaagcacataacgttcctgcgcttcattacaccagatctgcaggggcgacatgcccggttcgtcagagggaaccgcacgcagatcaaaccagccgccacgtgctgcaccatacactagctcgggcagggcattagaaagcccgccagcacccacatcgtgaatggccagaatcggattaggttgcccgctgcgtgccagttgccagcagcgatcaatcacctcctgcgcacgccgctgcatttcggcattaccccgctgcaccgagttgaaatcaagcgcttcctcattggtgccggcatccatactggatgccgcaccaccacccaacccgatagccatgcccggccctcccaggtggatcagcaaggtgcttggcggaaaaggtgctttggcagtgtgcaatgcggaaatctggccgatgccgcccgccagcataataggtttgtgatagccgcgtacctgaccgttgacttccacttcataggtacggaaataacctgccagattggggcggccaaattcgttactgaatgccgcaccaccaatcggagcagtcaacataatgtcaagcgcagaggcaatatgccccggtttgccataattatcagtctcccagggttggatggcctcaggaatgcgcaggttggatacgctgaatccggtcaagccggccttgggtttcgcgccggatccagttgcaccttcatcgcgaatctcgccccccacgccggttgccgcacctggaaaaggtgagatggccgtcggatgattgtgcgtctccaccttaatcaaccaatgggtcagttccggttcgtgcctgtacgaattgccttgactggggtaaaaccgctcaacagtttttccttccagaatggcagcgttatctgcataggcaacaatggtatgttcagggtggcgctgatgcgtatgccggatcatgtcaaacagcgaatggggttgctgcacaccatcgattacccagctcgcattgaaaatcttgtggcgacaatgttctgaattggcctgcgcaaacatcatcaactcgacatcggtagggttgcgctgaatgcggataaaataatccagcagataatcaatttcatcgggtgacaacgccagtcccatttcccggtttgcctgcagcagcgcatcacttccccggccaatcagatcaacttcagccaatgtacctggtgtggaatgctgaaacagaatcgcagcttcaggcagcgaatgcagtaccacttcagtcatgcggtcatgaatatacgcctcgatttgcaacatctgctccagcggtagtgttgtctggcaacgaaacgcgaaaacaatgccgcgctccagtcgctcgattttatccagactgcaacaatgcgcgatatcagtggccttggatgaccagggtgaaatcgtgccaggacgaggtacaaccagtaacagtttgctgcccagggaaagcggcgctgctgcctccccaacattgagcaactgtcgtagccgatcggtttcttccggcgtcaaatcacgctgaacctcacagaagtagtggtagtcggcagtaataccggaaatttccggtacgattgactgaattgaatgaagcaagcgttccagacgaaaaggagaaagcgcattgcgcccatgaaattgcaacatcaggaatgtagccagttaaatgaaaagacatgattttacacgagtaacctacagccagattattgtctggatgattaggttgggaaaaaccagaaactgatcgcatggatcaataatagttgcagtttctccgtttatacaaaattcggaacaccttcttaggacttgacttagttatttccagctgtcattttttacatattccccagatgtaatacttgcttttaggaaggaggacagcatgagaaaaatactacccgccggtatgttgtatgttgttatggtgttactcacaaccgcagtatgttttgcaggaaataaaagggatgctgcagaagggcgcaatatctggttcaatagtacttttggaggagagcgcttttttagtcttatcttgcctaatgctcccttcaatttccagattggctttgatcatatgttaacctggccacgggatagtcggtttgatgagtacggagttattaatgatccggattgcaccccgggtgatgcgtcaacgggctatttcgatcgatgtgcagatcctgagtccgccggtgtcataggagtgcgcaaatttccaaacccctcaggcggctcaccgcttatagggatcacctgtgccgcttgtcatgccggatttgatcccgttcatcctccttcaaatccaaataatccacaagaaagaaacattcatcctactgtcggaaatcagtatctgcggatcgacaagctttttaagagccatctttcgccgcatgatcctcgctatcaaatcttttccagctgggctcccggcactgtagatactactttactggaaaatgatcatattaataatccgggaatgattacgccgatctggtcactacccaatcgcccattctttgatgtgaccgctgatggtgagcctgctcgcgttcatcgtaacggacagggaggagaagatgatatcggctgtgagcaggcagcgctccgagtttatttcaacattggtatgtgcgctgcagaatgcatggttgggcatcttgccaacggacctggcgggagtcaaacgcccattaaccttgcagaatgcagacagatctgcccagagctcctgcaagcagaagagtcggtagacaagctctgtgcgtttctgcaaacgccacatgctccacgcttggtgcgtgccccgaaaggcgcacattatatcgattggaaagttgtaaggaagggtcagaaagtcttttctcaggcatgcgaatcatgccattccgatgggaatcgttcgttaaggcgaaatgttctctctgatgatctggttcatcctttcgccgagattggtacgaatagctgccgtgcccgcacgactaactggatgggtggccatatctgggccgcgttttcttcagatcaatataaggaacggccgaccggcggaccaggtttttaccgtgacatgcctcttgtaggcatttgggcaactgctccttttttccacaataacaggctgggccaaagcatcggcgatccatcagtggttggtcgtatcacggcatacgaggatgcaatggatctgttgctgaatcctgataagcgagatgagcctggttcgatcctgcgtacgactgaccaggtacaactaccaaccccatctggtgtcgttacgcttcctgccgggactcctattgctcaatttgcaagccttgatcccagtactggcaaaaatctctgcccggatctctctgaaaatcaggggcactactttggagcagaactttcggatgaagataagtatgcgctgatcgaatttctgaagacccgctgatgtcggttattttatgagtttcgtatatgaaaaatatgatcactcaatccaccattagttgcccacattgcggacataaagaaacagaggaaatgccaattgatgcctgtcagtggtactacgaatgcaagttgtgccatacattgttacatccactggcaggtgattgctgtgtgttttgttcgtatggtacgtttccatgcccgccaaagcagcaagatcactcatgttgcacttgaccgctgtcggctctcgcctggcggtacgaaaatcatcaacatacgcattaccaagagcagttatgaaacacctgttctggctcgttcgatcaactcacaaatcaaaggtaattattaacgctatctttgataggatcagcatattggctttcaagcacgccctgtttcttcccgggacgcgaaatatcgactgcacgtaattgcttgagattgatatgatgatttttatccaacccatttttttctgtgggctccagatttactgcaaaaggccagggtttatgttgaggaagtaaaggagcaacaatcaatgttctggaatggacattggccaggctactttgaagaatgacacatggcctcagttttttgtttctgcctccttggtcggttcaagattaatccagtaaattaatccagtaaatgtccagctgtttgaaatcagtcattggctaatccatctgacagcctactacctcattcttgtaattccgcctggtagttcgtgtcttctgcctcttcctggtttgctttacgtaaagctgcctgaaggaaatttttgcgttcctgtttcaagagttgattgatataggcgctaccgattgttattcgcaacattgttcaaaaaagtaaatacttcatcgtcaatcgtgatggttattctatgattcaggtaattaattacaccatcaacagtaaaacagtaatcgagcaacagatgcaggtggtgcccaaagaagtttgggccatgacgataaggctagatcatcaatgacaaagccaagggtagcaacgcgcgcttgacaagatacataacctgccgccattctcaaacataaagatacgaataagggaaacaatcagcccctatgggtattaataacctcggaggtatatcatgggtaacgaaaaatcttatacgggcaactgcttttgtggagcagttcaattcacagttactggagaacccgctgctatgggttattgtcattgtgaatcgtgccggcactggtctgcagggccagtcaatgcgtttactttgtggaagcccgaggcagttaaaattacacaaggtgctgacaacatcggaacctatcacaaaacaccagcaagttatcgtaaatggtgtcaaacctgtggtggccatctttttacagaccatccaggcatgggactcatcgacgtttatgcagcattactaccggaattgccttatacacccgaagttcatgtgcactaccaggaaacggtattgcacgtcagggacggcttgccaaaaatgaaagacctgccaaaggagatgggcggatcaggtgaaaatgtagaggaataacataatcttcacgaataatcttgcgatcaaatgaataccacgcccatctataccactgctgaaattcgcgagattgaatcgctagtgctatccgtacccaatccgccgccattgatggagaaggcagggttggcggcagcagaaattgcccaagcccgattgctgacaggtaacaatcaccggatattgattctggccggaccgggcaacaatggcggggatgcgttggtggctgcgcgccatttgcatggctggggaaaacaggtaacgctggtatttaccggagaatccgcacggctgtcgcgggatgccagacaagcgctggaacaatggcaatccatcggtgaaatgatccatcgggagattccggctaatggccaatgggatgccgtgatagacggcttgtttggtatcggcctgaacgaagcacgcccgctggaggaaaggtaccggcagctcatcgggcaaatcaatcatctgaatctcccgatactggcgctcgatattcccagcggtttgctgagcgattccggtcgtgtgtcggaggttgcggttagggcggcgattacggttacttttatcgccttcaagccaggcttgctgacgcatgacggctgtgatcattgcggcgaaatcattgtgtgcaatctggagctggacaccaccacactgctttctccacggaactggctgttggatcgagcgagtattgcctcgagattgccgcctctccgacaggcaaacagccataaaggtacttacggaagactcggtattctgggcggagccggcggcatgattggtgcggttctgctggccgggcgtgccgcactcaatctgggagcgggacgagtttatctggggttgctgacgcaggaggatgcaccggtagttgatttgacccaacctgagttgatgttgcgtcccccttccggtttttttgagccagattttctggatgctctggtaattggtcccggcttggggggagaaatcgctgcgtgcatttatctggaacaagcactgcaaaccagcctgccattagtgctggatgctgatgcactcaacttgattgcctgccatacagagctcagcaatgccatcaaggtacgcgaagcacccgccatactcacaccccacccggcagaagcagcccgtttgctgaatacaaccactgttgaaatacaacacaatcggctggaggccgctcaaacccttgcccgacagtttaattgcatcatcgtcctgaaaggggcgggcagcatttgcgcttttccggacggacattgccatttcaataccagtggcaaccctggtttaagcactgctggtactggtgatgtcctttcaggttttctgggtgcattgctggtgcaagcattacctccggaaaatactctgttattggccgttcacttgcacggcgcagcagcggatacactgctggaacagcaacatggccctgtcggcatgacggcatcggaaattattcccactgcccgccacctgctgaattgctggatcgatcagaaaacctccgggtaccgatatgcccggtttggcgggcagttcaaaccaaacaaccaatgaaatacggacaatcaagcccagcagtactgaaaagccagatatccaccagcatcatgcggatctgacaactgccgaaccagagcagtaatctatccggctggaattattgaaccgctacatgccgctgtggtaaagtgccgtcaaactggcggcagcctttgtcgcattttacccattggattccccggttaggctctgccgatcgtgcttattgatagatagtgaaacagcatggcagtaacgtgcctgaaacactttgagatcagtatcccgcacacaacaacgcatggtggtgcttgaaaatttcgtgaaagacactttacagtttgtgtcggatatcaaccagatttggcgaacgacaatcggaagtagttttgatgatcgcggagccggcttgtgtcagtaaacaaaaatacttaaccgatgcgcgaattttcagcaacaccaatagaaatgttcgtcagtctctggcgaaatcgcagcctggttcatgcctctgccaaacgggaagtgctggggcgctaccgtggctctgctttaggattgctgtggtcctttttcaatccaatttttatgctggctgtgtacacttttgtattcagcgtggtgttcaaggcgcgctggaataccggcagtgattccaaaaccgaatttgccctggtgctgtttgccggtttgattgtatttaacctgtttgccgagtgcatcaatcgcgcccccgggctgatactctccaacgttaactatgtcaaaaaagtggtcttcccgttggaaattctgcccttcgttgcgctactttccgccctttaccacgcagtgatcagcctgattgtctggcttgtggcctacctggtcctgtttggcgtgccgcacgctaccttattatttcttccgctagtcattttgccattttgtttattcatcatgggcctaagctgggccctggcttcactgggagtgtttttgcgggatgtatctcaatttatcggtgtcctcaccacggtattgatgttcctgagccctattttttacccggcaactgccttgccagaaaactatcgacactggctgtacttgaacccgcttactccggtcgtcgaaatggttcgggatgtactgtactggggaaaaatacctgagttcgccatgttaggactctactggctggccactggcttcatcgcctggctgggctttgcctggtttcagaaaaccagaaaaggatttgcggatgttctttgatatcaattcaatcataaattattcctgttaaaggcatgctggcccacaatctatctcgctacatccctgcgagcctcgtaatcaccaagtaaatcagtattcccgaggggtggagaaagcccatataatttccagcgaacatcaacaaatgagactctcaccgtacacacagcggatcatttgcgaaagcgatcaggatatctttggcaccgatgcctatgtcaaagtattcggttccaggctggatgataatgctcggggcaatgatattgatttgctggttgaactgccatctatcacgcaggaggttgaacgcaaagctctgcagcttatcgccagactgcaatactgatcggtaacaacaacatttttcacaaaccctggagatagttgcgaagaaggcaaacatcttgctatagctggcataacttgttcatgcagaagaataccgttttgttgtgaatttctcgcttcggcctatccagtttgatgagactctgttttaattttcacacgtgaaagaattatgagcagcattatcaagactgaaaatatcgaatgcatgattgagatcattcgagaccagagagtcatacttgattacgacattgcacgtatatatggtgttgaaactaaacgtataaacgaagctgtcaaaaataatccagataaatttccacaaggttatttctttgaactgaatgctgaggaatatgctaatttgcggtcgaaaaaaacgaccgcaaccttcgccaaggttcgcgtacctcccaaggcgtttatcgaaaaaggcctctatatgctagccactattctaaaaagtcaggacgcaacgcaggccacgctcaacattatcgaaacctttagtaagttgcgtgagctttctcgcaatgttaaggaactcgctaacttagaagacaagccaaagcaaaagacacttatgcagcggagtggcgagctgattgctgaaatcttggatggtgatctgcaaacgcgagacgcagaaaccactattgagctgaatttcgctgtcctgaaattcaagcacactgtcaaaaaaagtggaggtggtaaaagctgaagggccgcttcagttgatagctaaaatgggcacattagcattaccaatttgggcaagacccgcaaattacaccgtaccatcatggctcgccctatcctggatcccgaggcgtttgcacacgtacacattgctgaatgcaggggtgtcgagtggttcgataccgagtttggtcagagcaacatttatgcctgggccaaggaacaggcgggcgaaaccagccatgaaatgtttggtgactggatgcaccggaataacctgatcgctgatcactgccgaggcgccgggaatcagccggcggatggcaagttactgccgtaccgcgcacaaagccatcccgcgcactgtctgcagcccgcactcggggagctcccgtttcgttgcgatggtgacgctgctctcaaccatgggtttgttgttggtgaaatatagactgctcgcgatgatccggccagttgtctttacgaaactgtaaggttttagtcgcaacctcgaacgtagtatggcgggaagcaatacagaactgctttatttcttttgttctatgacactttgctgatgaatcacgatcatggctacaaactattgttctcccaccctgaaatggtggcggatttgctgcgcggttttgttcgggaagattggataaaacacctggatttctccacgctggagaagatcaacggcagctatgtcagtgatgacctgagagagcggcacgatgatgtcatttggcgtattcgctggagaaaagatcaggcaggagaaacggaaagcgactggctgtatatctacttgctgcttgaatttcagtctaccgtggattggttcatggcagtgcggattatgacttatgttggtctgttatatcaggatctgatccgcagcgaatcgattggcacagataagcggctaccgccgatactgccagtggtgctgtacaatggagaaccacgttggcaagcgccggtgaatattgccaatctgattatgccagtaccgggcgggctggaacgctatcggccgcagttgcattatttactgttagacgaaggtaactacagcgaacatgaactgaccagcctgcacaacctcgcggcagctttgttccggctggagaacagccacactccggaagatgtccaagaagtattgcaggcgttgattacctggctacaatcgcccgagcaaagtaacttgcgacgtgcattttctatatggatacaacgggtatatctgcgcaacagaatgccgggaatcaaatttgacgaagttcaggatttacaggaggtacacagcatgctttcagaacgtgtcaaggaatggaccaaagactggaaacaacagggaattgcagagggacttcaagaaggtttgcaaaaaggtttgcaagaaggtctacaagaaggcttgaaaaaaggacgactggagggtgaggctgagtttctacagtatttgctggagcagcgctttggttctggtgcaatcagtgaagcagtacgcaagcgaattgaggcggcagatacacatactttgcagcgctggggaaaacagatactgacagcacaaaccatcgaagaagtttttgaagcgtaatggtttctatgtttgcgtatccttccaccctgtttttgcgaggcggtacgccgaagcaatccagcagcgacatcagcagaatacgtgacgtacccttaaccccgaccacaaccatgctggatctccgcactggttgcaccgcctcgcgaagacgggattattcaggcagcatacgagaaaatactgtctttatggatcctaacagacctttagctgcgagagtagcgtggtaaaagaagtaatccagccactccctcttttgtcgtctttgcaaaacccaacaggttgaaacaatctagtaaaatacagcttttactcccatcaaaacgtaatgccaatccggattgacaagcaatcttcaaaagaaaaatcaagagagaatctgtttgcagcaagcaatagaaacacaagggataacatgaaatctatcccgagcagtacaagggtaattagccgttgccagtaccagttcaaatcaccggtgttcctcacgtctttgcacgcggcgttcaatttcatcgcgcgtgggcagtgttttcagatcgtagctggcctgcaaagcaagccaggaagcagcatcacccccgaaataatgcgccagccgttcagcagtatcagcggtaacggcgcgccgctccttgacgatttcatgaatgcgggtggctggcacactcaaggcaatcgccagagcgttgacacttattccagctggaatcaaaaaatcttcacgcagtacctcaccgggatggacggcacgcatgcagtttacaggtctagtcatggttatttctcaatgataatcaacaatctctacatcggcaggaccaagatcagaccaagtaaagcatatacgccattgtgcgttgatacgaatgctccattgaccttcctggtcgccagccagtttttccagccgatttcctggtggagaacgcaaaaaatcaagtgtttgtgctgcctccaattgtgccagcttacgttcagctgcagcttggatagcactaaaacgctgagggcattcaccctcaaacactgcttgcgtactcttacatcgaaaagactggatcatgcagcccatgatattacgtcaaacgtaacacgtaaagcgagaaaaatttcaagctatctaccctgctatgggcagtcagcggaggcagcgtgaacaaagaacagaacgacatcgccattcgcgtggaaaacctcagcaagtgttatcaaatctacgacacctcgcgtgaccggctcaagcaattcatcctgcctcgcgtgcagcgcgttattggtagacagccgaagcagtattttcgtgagttttgggcgcttaaggacatatcgtttgaggtgaagaaaggtgagactatcggtattatcgggcgtaacggcagcggtaaatccaccttgttgcaaatgatctgcggcacactcagcccgacttctggcagcattacaacccatggtcgcattgcagcgctactggagcttggctccggatttaacccggaatttaccgggcgtgaaaacgtctacatgaacgcatccgttctgggtttgagtcaggaagaaacggatgcgcgctttgatgatattgtcgcatttgccgatattggtgagttcattgaacaaccggtcaaaacttactccagtggcatgatggtgcggcttggttttgctgtacaggcacaagtcgaacctgacattcttgttgtggatgaagcattagctgtaggagatgctaaatttcaggcaaaatgctttgatcgcctccatcaattaaaggatggaggtacaagtatcctgcttgtaacgcactcatccgaacagatcgtaacacactgttcagaggccattcttcttaatgggggagacgtcatcgaatatggtgaaccccgttacgtagtgaatcactatatggatttactttttggcaaggaacgtaagaactattcagattcagcatcatctttttccactgaatcaaattccgccgagccaacccacggcgataaccttagcctgaatttcacaaacgatgttttttcttctcatgcaaactataacgagcatgaatatcgctggggagatggcactgcaacaattcttgatttttatttgttggctgataatgagccttacccttctgttattacaagcggacagagcgttgtacttggtgttgctgtaaggttttatgaagatttagtacgacccattcttggtatcaccatcaaaaccaaggagggagtgactgtttacggcgttaactctgagacattagaaacagatgaaataaaggtactaggcagtaaaggaacaaccgcactaatcaaggctgaatttatttgtcgccttgccccgggcgactatttcatctcatttggacttgctaccagaaaaggtgaagaaatagtgcctcatgatcggcgatatgacgccatttatctgcaaattgctccggtaacaaaattttttggcctggtagatctagacttgaaactgagtttacaaaaaacacccctatgaattcttatttaacagatacagactatatcctcgatgtaacaaccaatgtttggtctcgacaagattacacgggcattgcctacagtgatggcgatgaggtagagcaacggattgcttcaatcattaacgaagtttctgaccttgacgtactttccactgaattgcgtcagcattgcacagattggccatccctttatcatctgtcaggaacgcgagccaacattttacgaccttttgaaaatgatcttcatggagatattctggagattggtgcagggtgtggggcaattactcgctacctgggtgaatgtggtggcaatgtattggcgcttgaaggcagcccaagacgtgctgcaattgcaagagcaagaacgcgcaatttgcagaatgttacggtagtgtccgacaggtttgatcttttctcggctgaccggaaatttgatgccatcacattgattggcgttttggaatatgccaatctctttacctccggagaaaaacctgctctgaacatgctggggcgagttcgggcattgctgaagccagaaggaaaactcttcattgccattgagaatcaactgggcttgaaatattttgctggcgcacccgaagatcatcttgggcaacccatgtacggaatagaaggacgctatcgcaacgatcagcctcagacattcggtcgcattatcttgacagaaatgttgaaagaagccggtttttccgcttgtgattttttggcgcctttccctgattacaaattacccgtatctgtcattacagagcgtggcttcaaaacagagagatttgatgcagcggcatttgcctggcaaagcgtgcagcgggatccacaacttccgtctacattagtgttttcaccagagttggtatggccaaccctcgcacaaaataaccttgcattggatttggcaaactcatttcttattgtagccagtagcaataaagagcctaatctggagtcatctgcacttgcctggcatttcacaacagaaagaaaaaaagagttttgtaaagtaacttcgtttgtacaaacggaagctgatggtattgaagtccgatataaatctcacacaccgactttaccaagacctgtaattggtaaattactgaaatttgctatcccagatcgagcgtcttacgtgtatggcgcaccactttcacaagaatttatccaaatcgtcactcgtgacggatggcgtatagaagaactttgtatcttactgagaaaatatctcgatattgttgcaaatgttgcgtgtgtaaaatggcagattggaaaattatcagagccaactattaaattgcctggaagcacgtttgattacataccacaaaatattattacttctactgatggtggagcacatatcatcgataaagagtgggaagcaactgaatcagtgcagatcggatttctttgttttaggtcgttaattaccctttttcacaatgttaccaaatttggccattctgctgatgagtttggtaaaacatatatcaatctaattcaagctgtaatgaacggcttgggctggttaccagacaaagggatgatcattagctatgttaatctggaggccgccattcaaacagaagtatctggccgagttgtaactcccaaggaaacgatggactggctagacggccctatttctaaattgaataacctcaaccaagcagtagttgaacgtgattctcagattgccaatcttaatcaagccgtaattgaacgcgacggccagatcgctaaactaaataaaacattaactgaaagtgatcgtcagattatcagccttaaccgagctataaccaagcgtgacgagcagatcgccagcttgggccaggctgtaactgagcgcgatagtcagattattgctatatataactcccgaagttggcgtattaccagaccgctacggtttttgggtactctagttagtaaaactcaacatatcctggttctatttcgtacacttttgtatcgtagtggctctcttcggcaaacaatgaggaaaatactacaagtgttgttgcgagaagggtggcaaggtgtacgaatgcgccttgagtatccgactaacatcgaaattaaaaaaggcaatgcaggttttgatccgcaaaaagatatcgtgttggttgttagccacgacgcttcgcgtactggagctcctattttgactctaagtatcgttcaacgtttacaaaaaaaatataatgttatttccctgctattaggtgaaggttcaattacagaacatttctcaaaaaattcttctttcttaattgaagcaccattcgcacgtaacaacacacttacagcacatagccttatcgaacaattagtacgacagcatgatatccaattcgcaattgttaatagtatcgaatcgcgtattgtgctgcctcctttggcccgtcattttattcctactattcacttaatccatgagttcgcagcatataccaggcccatatctgcctttgtcgaagcgttactgtgggcgcgcgaaaccgtcttctctacacctattacttataaagatgctctcgcctgtcattctgaactaaacaatcgtccctgccacattattccgcagggattgtatgatctacccgctgtagaaaaggacaatctacaagcaactacggaaagagatcgtatttttagtctactgcatcccaacgacaaggcagatgactcaattatcataatcggtattggctcggtccatttaaggaaaggggtagatttatttattgagtgcgctacacatcttgcacagacagagtttagcgatcgtttacgatttgtttgggtaggcgcgggctacgaccctataaacgactcagcctattccgtatatttagcagatcaaatccgccgtgcaggtattcaggaacacatgatttttctgggtgaaatatccaaccctgatatagcgtaccaagcagccgacattatgcttctcagttctcgtttagacccgctaccaggtgtcgcaattgaagcaatgatgcatggagtaccactcgtttgctttgagaacactaccggcatagctgatgtcttaatagagcacggtttaggtgcgtactgcgtcgcacattatcttaatgtagtggatatggcggacaaagttctgtcttttgtccaatctaagatgcttcgagaagaaacgggtgaaaagctgcgtcaaatcgcacgagaagtatttaatatggaacgctacattgataagctggtagggttagcaatgctcgctagccatcgcacgaaacaggaacaggtagatctgtcagaaattaaaaaagcagggttggaacgcttggattactttacctctccggagataaatcttttggctgaagaggcgttgaggtattacgttcgaacttgggcaagcaatgttaagcctagaaaactatttcctggattccaccctggcatctatgctgagcaacacggtttaagtcagccaaatgctgaccctttggctgactatattcgagcgaaacgaccagcaggtgtttggaagtatgaaatactgactgaagaggcccctcgacgagtgttgccaaccggaacacgtgttgctctccacttacatgtgtactaccctgatttattgcctgatattcttgcagaattaaaaggcaaccacattaagcctgacttatttatcagtgttcctaatgataacgcttgtagcgaagttcaggtgttactgtcgcaagaataccccacttggaaggttaatctccaaatcgttcccaaccgcggacgcgacctcggccccttactcacaactttcagttccacttttacgcaagattacgatttggttggacacttacataccaaaaagacagttgacgttacggatgcaaacatgagccgtcgctggttttgctttttgctgaaaaacctattaggtggcaaatatgcaatggcagataaaatccttgcacattttgcttcggatccctctatagggatggtttttccagatgatccaaacattgtcggctggagcttgaatcgcccatatgctgaaaaaattgggcgacgcctttgtttgtcccctttgccacagcattttctcttcccaataggaactatgttctgggcacgcgttgaagctttaaaaccactttttgatttaaatctaacttgggatgactaccccgttgaaccattaccttacgatggttcctttttacatgcattggaacggattctaccgtttgttgtagcacatcaagggtttcgttgcgtattaactaatattaaaggtattaccagataattctatgaatattatcttattttcaggtaataaagtacttgactctctataagatatttctatgagcttatgcaataccgaacaaacttagaggagtccgaatgtgcaaacaggaaatgaagagggttttagagttttatgcctggttcacggcgatccatcatcaccacttgttgaaatacggctacgtatgcccttagaacactgggcatctatttatggtggctatatcagaataataagtctctatgaaagtagagtcgctgacctatcatgggccgatgtagtagtttttcaacgaatagcaagtaaatatgtttctgatcttgctcattatcttcagcaaactggaaggaagattgtttttgagattgatgatctgttgactaatcttccatcatttctttcacatcaccttgagtatattgaagaatcattaccccatatcaacaatcttcttatgaccgctaatgctgtatcagtctcgactgaagagttggccattagattcaggtcaaaaaataagaatatacatattacttctaattattcagaagcgattaatatatcagcctcacattacgctattcctccaacgggcatcaaattagttgttgcatcctctgatagagtgctagtagatatgctaatttctccattatttgaattgcagaacaaatttgatattcaagttatcgctattggtccccctggagaacggctagaaaattcagggataagaattgaaaagtattcaaattttggacatgctgaatttaagaattttgttgcatcaatcaataatgggattggattaataccacttgattcatccgaattcagcagttgcaagacagctgttaaatatttcgattattcagtatgtggcattccaagtatctgttcaaacgtattgccgtataaaaatgtggtagagaacggtgttacagggatattggttgaaaatacagccagagaatgggttagagccattgaacagcttattttttcacatgaactcagaacttcattagtaaacgcggcgaaaaagaatgtttttatgcaccataatcttggtgtgacagcgcgcaattggtgcaacttgtttaactcactcgatattcagcatgcacgatccatcaccgaaatatcagctgttccaagcttcaagcgtaattatcttgaggtcacaaaatttgctacttgccatgtattaaaacttgattcatatatcaaattattcagaattttgagtcgctatggagtaagtggcctttacgaaagaatagtacgccgctaactgctttagctaataaattacccagcattctcgatatgagtagtaataaaagaattaatagtatttgtgcaataacattctcaagaatagcaaaacataattacgttttattctttgaaagttgaaaatagtaagaatacgaagatttataagacaagaagattgaaatttggctaagaatagggtgcatagctgccatgtagctattctgatgtgtacatataatggcacttcttatttgcaggaacagcttgattcaatctacactcagaaatacagaaattggtatttatatgtatctgacgacggttcgcgagattccacacaagatattctgcatgcttttagggtaaaaacggatcgacttcgtatttttcgagggccaaaaaatgggttctgtcaaaatttcttgtcgctgatttgtaatagttcaattagggctgactactatgctttgtctgaccaggatgatatttggcacacaaacaagctttcgcgtgctgttaaggcgttatccgatatttcctgtgaaattccggcgctttattgctcccggacaaaactggttgatgaaagaaataatgaaacaggcttatcacccttatttaaacgtacgcccagttttcgtaacgcacttataaaaaatatagcgagtggtaatactatggtattcaaccatgcagcccggaaactcataatgaaagcagggccggatgttaatcctgttgtgcatgactggtttctttatatggtcgtcagtggttgtggtggtgttgtgatttacgatcctgttcccagcttgtgctatcgccagcatgccgctaacctgatcggagcaaatggtggttttattgccaggctcaggcgctttggcctgatgctgtccgggatgcatcgatggtggaatacacggaatatcgaagcactgtcaggtttacgtgaaaaactgaccccggaaaatcgttacatttatgatgaatttgctcgctttcgtaatgcttcattctggaaccggcttgcaggtttgtaccgcacgagactttatcgccagacttttgcaggaaatatcgccctgtggctggccgcgctatgcaagcgcctttagcagtgctgtcataaccgatgacagaaaccggcaactctgtatatctgctagtgtcgtctctgcattacttcaccccagggttcgcaaagacagcgaagagactctgtaattacaaaaataaccgtctttgcgactgcaggcgaagtaaggcaggaagtaatccagaaaatgattctaaaattttgaatgctctcgcatcattcgagtgggaatcttgtaccgaatcacgccgacgtagatgcttttggggcctggcatcctcactttggtggtggctgaaaccatccacaggaaacaatgatcaggccggtgtcccatgctcttgggtatttgcccacggcctgatcttcgccaatgtttcttccagtacaccgcgcgccatctcgatatcgtagtccacttgtaggcgcaaccaccatccgtctgacagaccaaaaaatcggcataggcgcaaatctgtatctgcggtaatggcgcgcttacccgctacgatttcaccgatgcgctgcgctgatacgccgatttcctttgccagccggtaattgctcatacccagcggaatcaagaattcctccgcaagcatctcaccgggggaaaccggcgttaatttattattcatggttaatctccatcagtggtaatccacaatctcaacatcttctgcatccgtgcctgtccagtggaagcacacacgccactggtcattgatgcggatactgtgctgtccggcacggtcgcctttcaagatctccagctgattcgcgggcggcacgcgtatatcctcaatgcaccgtgccaaatcaagttgcttgagcttgcgtaacgcaggacgctcagtgttgacaaatcgtgcaactcgcctcaacttggatagggttttagtatccgcgcaccgaaatgtcttgatcgtcatgagtacatagtattgcgttacgatattagcgtcaaacgacattacagattaatgccaacttggagaaacgctgatttattccgtcaccctacgcttttatgcctgcccggaataagcgtgttttgtgtaaaagaggaaaagagtggaggggcaggtttgtcatgaattgtcctgtggtgcatgactggtttttgttatatggtcgtcagcagttgtgggagtattgtgatttacgatcctgttttcagcctgcgctatcgccagcatgctgccaacttgatcggggcaaatggtggttttattgccaggctcaggcgctttggcttgatgctgtctgggatgcatcgacggtggaatacacggaatatcgaagcactgtcaggtttacgtgaaaaactgaccccggaaaatcgttacatttatgatgaatttgctcactttcgtaatgcttcattctggaaccggcttgcaggtttgtaccgcacgagactttatcgccagacttttgtaggaaatatcgccttgtgactggccgcgctatgcaagcgcctttagcagtgctgttataacgatgacagaaaccggcaactgcatatctgttagtgttgtttctggttgtttctgcattgcttcacctttgcagggttcgcaaagactacagaagttgaggtgatcatatcgtgcccgctttgtccttgcgaggaggcgtggccgacgtggcaatccaattcagcaggggtgctcatcctcaccgcacctgtcggacttatccgattttctggctgtgagatcttgcagtgagccggatatgtatttatgaataatgctggagacaagcgtttgatatgggatgccttcttcaattgctctggactgaatagcgacaagatccctgttcgatatgcgaatatttattctcttatccttcttgaaggtaaggttggccgcagcctcaagttcttttctgcgtgatttggttaacgtcgattcgtactcgccggactccaccgcatcaagcagcgttttctcttcctgtgatagtttttctttgttcatattttacctccgaggtatatcctggtgaattttctgctggggataatcgttttaagaaaaatctcatcctggctttccacgtagggcaccagatagacataatcatgaatctggatcacaaatattcgttgatttgggtaatccgtattattcggatggacgatgtcatccagcagtcctccgttcagaatactaaagacagcctcttcaaatgacttgccacgatcaactataagctgttgattcttgtcaggactccagttgaagattttcatgagcgtaatactagcatgtgtgcgttttgtcatcaaatcgggtggaaatggtatggctggattgtcgtagcctgcaaagacagaggtagtcaaaaggggcgattacgataatttctccactttactattgataatttgataggtggtatttcccgcgcaacattgaagcaatgtcgggcctacatgaaaaattacccccggaaaatcgttacatctatgatgaatttgctcgctttcgtaatgcttcattctggaaccggcttgcaggtttgtaccgcacgaactttatcgccagacttttgcaggaaatatcgctctgtggctggccgcgctatgcaagcgtctttagtagggctgctgtagggttacgatttttgttatcaatcatggctaatcaactttggttaagtatttagcaaaaacaaagatgccgatcagcatttggctacagctttccagaatcccagggcgccatcgccgacagctaattttggtgcatctttgcgaccgcgctgtttcaaatccatgctttacgcccggtctcatcagaaccgataatcaccaaaagacataatcggtcatccattcgtacagtgctgtagattccatcagcccagacataaacctaccgtgccactcagatcacgacgcgtccagttttgataatcctgctcctagttgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacacctagtcctgtttcaggcggctgatcgtggctgccgataatcccgttgcttctggcccgaatagatgtttcagcgcttcggaaaaatctcccgttgaaattcctctcagatataaccagggcaaaaactcctcaatgttccgggtgcgcttcaaatacggtgatatcagattgcttacccaacttggagcgatctcaaactttcggaactttgactgcaatgtctccaagtcccgtttgtatcgaacgtgcaggcaaatagccatttctggctaatatcatcttaccttcgccagtttttaaagtggcgtgctgctcgataaaagtggatacctccgcttcaataactgcagccagcattttgcgtgcgccttctcgaagtacttcctgcaatggatcattttgctctggtttgttcagctttaaaatattactatctgtcatacggtgtttttctttttattggttggtctgctcagatctttaccagcaggttacaccgcttttccctctactggcatacaccagaaatgatcatacctcgcagcttggagacatcaaaccagcaggtatcctttcccctggtaaaggacttgtatgaaacccttggcaacagcgttttgaacacaacagtgtgatttgacctgcgcttggccgggcactccagggcttatatcggcacccggaaaagagttcgattttttacgcgttaaacgttaaaaataaactactcaccacgcccaggtgcaaacaactgtagcgtatggggtttattttgttcagtggcctgtggttgcaaagtgtcagtgttgcagtaatcataattgggaaaatagggcacataaaatagtaaaataggagacagaccaagttttctactaagagtggtaattttgtcttggatagtggcgctttggtgaagagattgcggccactttggggcgacgggtgaccccgggaaaatccgggtgacctcggaaggtgatagcgccagagttaggaggattgtttgactaaacggtgaaaaccgtggtctgtccccatttttcttattaagtaaatttcttatgcccactcaagacgtacgctggctccagcgcctggctaactatcaaaaagcgcgccaacgcttggtgagtgcggtggagctggcagctacccgggagttatccgaattggaaaaacaggggctgattcagtccttcgagtttgtttttgagctggcgtggaatgtaatgaaagattactttatttatcagggtaatccagaaataaccggttcacgcgatgctatacgccaggcttttaaagccgggcttatcaccgacggtgagggttggatggagatgatcaaaagtcgcaaccaaacatcacatacttacaatgaagcggtagctaatgaaatctgtgagaaaattctgagtagctaccacctgctttttgcaaaatttgaagcagatatgcaaaccaggagcgcgtgaaatgccgaaaaaatttggtctgcctcaagctgctattaccaggctatgccatatttttagtcaatatccacaaatcgacagcgtaattctttatgggtcgcgcgccaaaggcaattaccgcccgggttctgatatagacttaagcattcagggtgaacagctagacctgacaactctgctggccatagaaaaccagatagacgatctgttgttgccctggatggtggatttatcattattccataagatagataatccagacctgattgagcatattcaaagaatcggtatccccttttatatccaagtcactccccgcaggccggatcagcgcagcgcatccggtatcaaggtacatctggcatgattcttaattgtgttgtagcctaaatagtgtagtcgtgagattgaaaatatgaaatccttttatcctttaaaaggacttcatatagcacaatcacatcgcagacatgatatctcggataaggcatgggtgttatttgaggagcctttaccaggacgcgaaagagcatggggtggagtagccagagataatcaccagtttattaatgctgttttctggattatacgaacaggagctccatggcaggatttgccgccagactacgggaactggagcgatacacatcgtcgttttatccgctggcgtgacaaagatatttgaaaaagctgctggaaatcctgattgatgattctgattatgaatgtcactttggagaccagggtaggcgacacatcagcgtcgtacatttccctgaacgcatcaacgatgtcgcgcgtgctcatgcccttggcgtaaagcgccagaatctggtcatctatctgcgttagacgtgtctggcccttgcgcacgatctgtggctcaaaagtaccagcccggtcacggggcacctcaataccaaccttgccatgagcgcccttcagttgcttggatgatgtgccgttgcggcgattatctgaaccacgcccggcaggatcatgcctggcataacagatgctcgtccagctcggctccaaagtctgcttcaacggtcattttaactagctgctgggtcaggctacccagatctgcttcagatttgatatttttcgccaagcagccaatatgggcttgcaactggttcaggtcgagttcgttcattgtgtcagtagtcatggaaaattccttcacaggggatgaaggctcgggcacttagatgtttagtcccacggtgtgctggtgtaacatataaccagttacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagacgccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacacttagaacctgttcaaagtctttgggagtatgagaaactcggaagatgagaaaaagttacccgagcgacatcagtcgtgaacaattcgagcttatcaagcctttgctggagagcgcgcgcaggaagaccagccctcgacgaaatagatctgtacgaggttttttgtgcggtgctgtatttgctcaagagcggctgccagtggcgagccctgcctaatgactttcccaagtggcgcactgtccactcatactgggccatctggagtgagccgcgcgaaggaggcagcctgctggagcaggcattaaaaaaatcaggttggcgcggttcgtaccagacaggggcgcaacgcctgcacgtcattcttgatcgtggacgcgcagagcgtgaagaacacggacacggcgagctagaagggctatgacgcaggcaagaaggtatcgggcatcaagcgtcatatcgcggtcgatacccagggtttgccgcatgccattgcggtgacgacagcggaagtgaccgatcgcaaaggtgcgttgcaggctttccggcgttgtcgttcaggcctgggccgggtggtggcggtgttggcggacagcggttatgtgggggagccgtttgctcaaggtgtacgcgatgtgctgagcgagactgtcgcggttcagatcgccaggcgcagtgagttgcataccttcgccgttatccccaagcgttgggtggtggaacgcagctttgcctggttggagaagaatcgacggctgtggaagaactgtgagcgcttactcaacaccagcttgcagtttattcacctggccttcctggccgttctactcaaaagactttgaacaggttcttacacaagatattttacaggctccattattcttcaaatatttcttcaacggtctgtgctgtcagaatccgctcaccccagtacagcagggtttgtgaatctgcagatttgatacgggtctggataatttcatctgctggaccaaattttcgctccagtaacctcaagaaaaattctgcttcaccttccaattttccttcctgccgcccttcctgccgcccttcctgccgtccttcctgccgtccttcctgccgtccttcctgccgtccttcctgccgtccttcctgaatacctatctgccgcccttcttgaatacctatctgctttccttcttcaattccctgctgtttccagtctttggtccaatctttgacgcgttctgaaagcatgctgtgtacctcctgtaaatcatgaatttcatcgaagctgatttttggcattctgcctggtaagaatacccgtttcagccagacagtaaatgcgcgtcgcaggctgtcttgttccggggtgtgcagccaagtgattaatgcctgtaacacttgttggacatcttctggggtgcggctgttctccagtcggaacaaagcggctgtcaggttacgcaatgctgccagttcgtgttcatggtaacgtccttcatccagcagcaggtagttgagctgtggccggtaacgatccagtccgccaggcgcagggaaaatcagctcggttatgtttgccggtgcctgccagcgattgtctccattgtacaaaactaccggtagtactggtggtagctgttcccccgttttaatggattcactgcggatgaggtcctgatacagcaggccgatgtaagtcatgattcgcaccgccatgaaccagtccacggtagattgaaattccagcaataaataaacgtacagccattcgtcttgcttgccttgcttacggcgcaagcgccagatgatgtcatcctgacgttctctcaaatcatcgctgatatagctaccgttgattttctccagtgtggaaaagtcgagttcattaacccagtcttctttaacaaagccgcgcagcaggtctgccaccatttcagcgtgggaaaatagcagtttatatccgtgatcgtgattcatctctcagatttttatcatgtcgcaaatactgtttcagtttgtcgtaaaagttctcgtacgtaccgatttgatagaagtcgatgatcatgaattcaataggtatgtttctggccgacgatcggtaagctattggatactcttgctggttgaaccgggacttgtaagcccgaacatcggccagatcccccgctttgagctcgccaatttctggtgtttcgcatatcatttctaccttatcttcaatcgccagttgcagtggcctgttagctttattgacatactgggcgaacgggtgcttgaaactggttctcatggaccgatattggatagcaatcgattccatgtcaaagcaaaaatgatctgccaaccgaaaagatagtattgtcaaatccgcgtggaaaattgcccctggaaaatcgcgacatctatgatatgacgaatcttcccgatttcaggatgcttcattatagaaccgacttgcgggcttgtatcgacagactcttacaggaaatattaccctgtggctggctatactatgtaagcgcctttagcagtgccgttgcatgatcacgatttctgttgttagtcacggtcaatcagctctggttgaggaattactcaaggatttagccaggctggatatgtctatgatcgccgaggtgttgattaccctcaatattcccgaagaaattttatttgaacctgatgattttccctatccggtcagtgtgttgagaaatactgcgccccggggatttggtgcgaatcataatgctgctttccagcaagcaaagggagaatggttctgtgttctgaatcccgatatccgtctggttgagaatccgttcccagttttgcttgaggagattactcggctatccgccgcagtaatcgcaccgatggtgatcacgccgaatggtgaggtcgaggacagtgttcggcgatttcccacccctttttctctagccatcaaatttttcggatgtggtgatggccgatatatcttcgctgccgaggatgtgacgttcagagcagactgggtgggtggaatgttcatgctgtttcgcgcaggagatttccgtgcgattgctggttttgacgagaagtattttctgtactacgaggatgtggacatctgtgcgcgcttgtggaaatctgggcggtcagtcctggcatgtccaaaggtccgggtaattcacgatgcgcaacgggccagccggagaagtttgcgctacatgaggtggcacatggtcagcatgttgcggtatctctggaagcattggtggcgtttaccaaggacgttggcaaattctgcagagtaagcacatggcaagatcatccctggtgctccaccagctttttcaagccttcgtctactgataacggcggctgccacccgagcagggtgcgggttttactgatatccacctgcaacgaacctagcaaacgctgcgctattgcacctttactcagcaagcgcgccgccaggtgtagcagccacaccggtatggcaagtaagtgtacttttttgcccatcgcttggcccagccgctgcaataaatcggcagtggatagatcttctccatcgcttaccagaaaagtctgattggctgcgtttgggtgattcacgcaggtgcagataagatccaccagattgtccagcgccaccagactacgacgatttttcaccaccgcacccaacggcagaggaaaaccacgccgcacccaacgcagcatggtcagaaaattacccttgacgccagggccataaaccaacacggggcgaatgatgaccagctccatgcccatctcctgagccagtttgtgcaagtccgcttcggcctcggccttggaaatgccataagcatcttctggcgcaggcgtgtcatctgctgaatagggtcgccccggctgcgtgccttcgccgttgaccttaattgagctgataaacacaaaacgccgcattccggcagcggcagcctgctgcgccaggcgcaacgtgccatccacgttcacgcggcgatattccgtgagtgggtcagtcacgttatcttgcattacatggacgcgggcagcgcaatgtactatcacatccactcctaccagggcttgtacccagtcggtggccgcatccaatgtgggtacgattactgcttcatcaaccggacaccctgctgtcaacgctgaggctgacgtgcgaaatacaggtcgtaccgttacctttcgctgacgcagtgtctgccagatggcaccgcctataaaaccgctggatccagtcagcaagatgttcatttcatgtcccttggcgtagtatctgtgcgcacaacaatgaacgggcacaattacattcatagccaggatgattttgtctgtcaattttctgatatttgttggtaggcatattagaaaatctgggtggcaaagtctttgaaattgatcaaatgttgttcgcgataagccacagttatgggacctctgcgcggatcctccatgagccgcgttgctggcaaaatcgcaatgatcgcaagcgcttcaaaaaggcataattgtagaatgatgatctatcttgctatacaggctcgtatcgttgaacttcaaatccagattacaacagcagcgatttcacgcacccagctgttcaaggactgttttcgcttcaatcaagtcgaggttgtctacgcgttcattgaatctggagtacaccgcatttaagatgcgtttggcatcgtctgctttattgtgttttctccaaagtttagctaggctcgtggcggctcgaagttcaaatatttttgcatactgatcctgcgcgatctttaaggcttcacacaaacactcctctgcttcttggactgattgctcggactgtccgagcaacagttcgcctttcaatcgaaacaactccgcttgccaaaacaattctcctccagtaacagcaagtttctgtgcctcctcaatggcgaccaatccttcgtcaattctatttctgcgtaaatagatttctgccagtaacgccaatgtagacgtgttgttggtaatcgcacctgtggcccgggtagcagcaatcccattaattaatttgacgaggccttcctcccgtccaatttcggccaatgcccaaccctgagaggctgtcgcccacgccaaccccaattcaaatgagtattgtgttgaaaccgtaattgcttcatcggtgagctccagcgttctcttcgcgttgtgggcgccggcatagatccaggcaagaaaaatgagcgtaaaaacacgagtgaatgggtgctccagcgccctcgccatacctatcgcctccaatgccaacgtttcggcttgctcaatctcacctaatatccataacgtcctggccagcagaatcctcgcgcttattcctgaatcttgcccgtagaaaaagacttgtgagcggtgttcatccggaacgtcaagggattttgcggcgaacagatgggttctggcttcgtcaaaccgaccagaaaataagttgattgcgcccaaagcatggtgagcttcaatcagcagttctgctatttgctcgcggtgagccagtgccaagagatcttcagccaggccgcgcgcacggacgaggtgccctctgagcataagaacgacccacaatccccgaataactcgaaattggtccacggaactgctttgctccgacaacaaatccttcgctcttcgataattacgttccatttcgtcggacgcatatcctttgacggccagcaatgggcctccgcgtgcaagcaggagttccaattccagggcatttcgctccgggccttgcggcagttcctttagcaaatccagtgctttgttaaaatgattaagcgattcgatattggctgattgtttcgcatctctacgggccgcgcgatgccaataatcaactgccgaaccaatcaaacctgcctgttccaagtgataagccaagagttccggttccatgtttacccgttctgggaaccggctctccagggttttggcaatgcgagcatgaagcatgcgccgaggtttcttgggtaacatgctgtaggccgcttcctggacgagtgcatgcttaaagtagtatgtcgcaagaggtatcttgccctcttgaagaacgagcccggaagcaacgaacaggtcgagtgcattccttaactcgctgtccggcacttcgacagtggctcgcaacagctcgtaggtaaattcgcgccctattgccgcaccggtttgcacaatttccctggccgaccctaaccgatccacccgttccatgagcaacgcttgcagactgtctggaatgggcaatccctttagtgggcccttcagagtaaatgaattgttgccctcgatcaggagcccagatccaagcacattttccgtcaatgtttcaatatagaggggtatgccatcggccttggccagaatagcctgctgcacctcgggcggaagcacttttcctcctgttattgccgcaatgagttcagcgctatgccgacgtggaagtcggttgagcgtcagggacgtcacgtaactatattccgaccacaacggcttgaagttggggcgagttgtgatcaacaacaacacgcgcatctgccgaatgcggccaatgattcgcgtcatgagttcctgcgttgttggatcaagccaatgggcgtcttccaccgtgaacaacagtggacaacgatcggccagcctttgtagatagtgcacaagtgcttccagtgtcatgtctttgcgtttttcggatggcacattgagaagcggataccgatgatctccctggatcgagagcagatctgccagcaatgaaaccgtttcctggctatcgattctgccttcgatagccagggcgtcgagcttgtccagttgtgcctgggcactgtcatgacttgcgagtcccgctgtttgccgcagaaaattgatggccggatagagcgccgtattggtatggtagggtgaacattgaaactgaatcgtctgataccgttcatctttgaggcgctcacataaactacagacgattctcgattttccgatgccggcctcaccggataggagcacgacttgtccttcaccgctgatggcctcgcgccagcgacccaacaggagcgagatctcctgttctctgcctacaaatttggctaagtggctggatcgataggactcaaaccggctgaccgacagcctggtactcagaacctgccaagcttggacaggtgtgtcgaaccctttcagcgaaaaggagccgagatccaggaattcgaattcatttccgacaagccgtttcgtcgctggatcaatgatcaattgattgggttttgccagcgtctggaggcgggcggcgagatttggggtttcaccaaacactgaccgttccttggcaaggtcctgtcctattagctcgccgactacgacttgaccagtagcgaccccgattcgtgcagcaatatcaaactgtaaatgggggttgtctcgattaagttcccccactgtatccagaatagccagtccagcatagaccgctcgttccgcatcattttcataggcatgggggtacccgaaataaaccagcatcccatcccccatgtattttgcgatatagccattgagccggtcaattgcttggctacaggcgtccaagaaccgtcggatcacatcctggaggtcttcagggtccaatcggcaggacagtgctgtcgaatccacaagatcacaaaacatcaccgtcaactgtcggcgttctgcttgatcccgttctggacggaatagttgctcctcctgaatgacgtcagcgggcataggcctcgaatccataacatcagtgttttgcgacaattgagcgatcgcgcgcaagatttttttccgatgtcccagcaaaacacccagcgcctccagatcgccctcattcagctcgggcaggacatcccaagtgatcgcattttgctgaaacgactcgcgatatatacctaggccaagattatccagccattctgatatgtgatcattcgtcatgaacaaagtcgatggtagatattccggcctgccatggacaggattaactgagttaagtgcaggaagttactcgttgcggatcgtaatcctttaatcgataatagatttgtgatgaacaacgcttccaaaaatatgattcctaaaggatctttcactcgaaaaatggaacgtcaactggtaggcatggtaatggcggtcatcgcctacgtgatcgagaaagccgtgttgcgttcgatcaagcgtagtggcacaaaatcttcggcactgaacagcccgccatcgtaaactatttttgtcttcaatgcctttgcagcagatcgataaccaggccaagggtcagcaggcctccgacgatcccgaatgttatcggcacccactcggcagtaaccgttgacgctgctgtgaatccactggccaggatacttgccgcagcggtcaggccgagcgctagtcgtcgtcccgtatggcgtactatatcctccagcgaattggcccggaaattcaccacaagctttgggccgccagggcgggcaccaacgaaattttcaactgcttcgatcatgcgcagggttcgtactttcaacttctgagattgatacagcaatgtcttcggattgaacgcggtacccatgcgtttggccatcaagcgcatcagatactttcccgctacgtcatacggatcgagtgctggatcaagctcggcagtcgccagctgtacctgcgcgagtgccttgatggcgagcgtgagcgaagctggtagcggtactccgtgccgtaacgaaaccgcgctcatttcttgtagaagcggcccgatctgcatctcggcaagcgaggtagtgcgatattttgccatcacttccccgatctcactctggaatcgggccacatcgagggtgctactattgtcggcgctcgtcatcatgaatgtgacatcggtgagaaacgccgcatcttcctgccatagagccatcaacattaacaagagatgctcacggagatcggttcctaccacaccgaccattccgaaatcaagaaaatagatgcaatccttccaccacatcagattgcctgggtggggatcggcatggaagaagccatcgacgatgatctgtttgtagtagctctccaacagttgacgagcagcctggatgcgcgctggaccagccagcgcctgcctgatcggtataccctggatctcttccattactaataaccgagacgtggacagatcccggtgtacgctgggtacggcaaggcgattatagtctgcgagcaccacttgcatgcgctcgatgttgtcggcctcctgacggaagtcgagttcactatggagcgaggtggagagatgtttgaacacggcttccatatcaatcacctgattgagcgcaggacgctttccgactttctccacaaacacctggaggagggcgagatcctgttcgatatccgtgcgagcagtcggtcgctgaaccttgactacgacccgttcaccgctttcgagcgttgcacgatggacctgagcgatcgtgccagcggcaagaggcttcgggtcaatcgacttgaatacatcctcccaggggactctcaattcctgctcggaaacttggaccacctcgctttccgtcatcggtggcacccgggactgcaacaaagaaagctcctcaatgtattcaattggaaggagatccgggcgagttgacaacacctgtccgagtttcgagaatatcgggccaagctcttccagggctgctcgtaagcgcttggcttgctgacggcggatagatatatctggttcgttagattggccgaacagcttgaggccatgtttcgccattacagctgcgatatgcgtagcgcgggctgccagtcgaggctcaaaaggcgggatttcacccgcggataggtgagttcgagccaaacccgatgtctgctcaccagtagaatgcgcggtatttacaataatcacggtgcaatgggcactatgactgatgcggttcggtatgttaccgagcaaaaacttttttcgacctgccatgccaaaattgccaaccaccaggacatcgactgccttctgttcagcggcgcggacgattgccaatgccggatccgtatcaatgacgaccaaagcatgcccgcgatccccggcaacctgccgcacaaagtgtgccaaatcgttgttggctgccgcagcgcgcgtttgttcggcttcgccgaattctgtggcggacggatactgcggcaccactacctcaaccgcgaacagctccgcattgtagcggtcggcaaatccagcggcccactggacagctcggtcggcggcttcagagcggtcggtgcctaccatcacgcgttttatgactttactctccagatgatttttcataaatgttgtagagtgatgagcagggatagcatcgatatgacaggatcagcctgggtggcagggtgtttaaacaccctgcccaaacgcttatcagcgtgctattgatctgaaacagccaatcgatgctggttacgtaacatcttttttctcagagttaccttacatgagtcaacgttcctggcctccggcaatctttgttatgcagaaacgtacaggtataatcaagtcgtatggaattcgttatattaaacgatgaacttcaagatgaagctagttttttggagttgctcgcgcgtgatttaaagccattttatgagccgcgtttaccctatcacaactgggatgaacatattgagcacggtcttggtatcatcgacgacctttgtaagcaggaaaaggccaaaggcaacctaatcaattctttcatggccaaaattgcttatatggggcatgacgctggtttcccccatgacctcatagcacctgtctgggaaaaatatggcagtaaagaggagtattcagctcatataatgaatgtcctcctgcaaaattacgggttcgaagaatcatatattcgagatgttcaaacatgcataatgtttacaaggatgggtgaacagctaccagaaaatgtagatgaagagcttggtaacacagctaaagctgtgcgcaccgctgatctttctcatgtctttgggccttacaagaacttcgttatcaatagcttcaagcttatggaagaaggtaaaatgtacggtcgagagccagtcctggcagaattcaaaaatagaaccagatttgtgctgacaaattacttgagtcccgattttattccttctggtacttacagtattgttgatggcatgaaaaatattgagcgtttttgtaaagattcaccaagccgtttattgaaagttgtcgggaaacaggccaaccgtttcgcaagtcttataaagaaagctgcttaaagacctttagatacgatactagctgtttagtcccacaatatgttggtatgaattgatcttgaacctttccggctctttagaacctgtttgtgctcttttgggcaatagcgttaaaagtatcaggtggataaattgcaggctggtattgagtttgcgcgcgcagttcttccataatcgccggtatttttccagccatgaaaaagttagtttcgcaattcaacacccgggaatgaccgcaaaagtgtgcggttcacttctcctggtgatctgcaccgtgatcacctcacccaaacacgacctgactacctcggtaaatggtcgacctgtatagccagaatccgcaagtatgctcacaatacgactggacagtcgggatgcttggcgttaatgcagcaatagtgcccttgcgatcggtaacgtccgcaaggttgtcgcagcaatggtgtgaggcaatcccaaggtgtcaacagcaatatgttgtctcgtttgattccggacactttcttacctgcattgtatgtttctgccagcccgaatacggggctctgatctcaaatcgaccaaatctattggtcggcccgtggattcggctcatccattgataagtgaaattttcttttggactgagggcagtttttttccaaaatagcaatatcaaggtcacttagtgttttatcaattacttgtgcttgtttgttacaaatttcccggattgatcgctcgctgatgtttctcgatttcgctgccctcgatactttacgtaaccatcatccggcatggcggttgttgcgctcggatcatgcaccgctggtggcgagcttcctgcatcgcgtgtttgtggtgcccaacgtgcgagtgatggcggcggcagatctggctgaagcactggaggatgagctgtatgccctgcgtcagcagttgggtgaggcggcttttcccaagtcggcactagattatctgaacgactggacagcgccggataaaggctggttgcgcaagttttataaaacaggcacggacgaagcgcaattcgatctcacaccggccactgaaaaagcgattgcctggttggagcagttgtctgagcgacggtttgtcgggactgaatcacgcttgctcacgctgtttgatctgcttaaacaaatgagtgaaggcagcgaagccgatccagccatccgtattaccgagctgcacaaaaaacgtgaggagattgatgccgagattgcacggataacgtcgggtgaggttccgctgttggatgacacggcaatcagggatcgttttcagcagtttatgcagggtgcgcgtgagctgctcaccgattttcgcgaggtggaacacaactttcgccagctcgaccggcgtgtacgcgaacgtatcgccctgtgggaaggtaacaagggcgaattactggaagaaatcatgggcaaacgtgatgccattgccgattctgatcagggcaaaagctttcgcgccttctgggattttctgctgtccagccgccggaaggaagagttgaccgaattactggaacgagtacttgcgcttccggccgtggccaccttgcaacctgatgtgcgtacgcatcgcgtgcattatgactggatggaagctggggaacatacccagcgtactgtggcggttttatcacagcagttgcgccgtttcctggatgatcaggcctggctggaaaatcgccgtatcatggatattctgcatggtatcgaaagtagggcattggcactgcgtgcccattggggtaaagattggccaccatcaggtgcgatgatggagatagcacaagcgcaggctgatattgagctggtcatggagcgtcccttgttcacccccgctgtaaaaccggttatcgccaaccttgctttgcaggcaggtgacgtggatatagatccttctatcttgttcgagcaggtaattgtggataaagcgcaattaactcgccatatccgccatgccttgcaggataaagctcagatcaccctgcgtgaactgattactgctcgacctttacagcatggtttggctgaactggtagcttatctgcagttggggagtgatcactttaacgcggtgattgatgaaaacactctggaatttattcactggcaatctctggcggtcaatggtgagcccattaaccgatgtacgcgattaccacgggttattttgatgcacctgtcatgaaaaataattagtgtattaccaaaaatcagtttgagaaaaacagggaagtgatggaagaagattttagtagcaatgacgacaatacaccagtcagagaaccggatctgtcagtgctgttaatcgggctgctcaagggtgttcagtatcgtgagcaggatgagcgccagtgggcagcgttgctgaacctgcaagcccgcgtgcgtgattatgtggcggtactcaatctggatctggtgctggacgaggctgaaggttacgctttcctgaaaagccgtgcagaaccttcagaggatgatccggcgccgcgtctgcctcgattgattgtacggcgcccattgtcgtttccggtcagtttgctgctggctttgctgcgcaaaaagctggctgaatttgatgctggaggcggtgacacacgcctggtgctttcccgcgatgaggctgtggagctggtgcgagtatttctgccggatggaactaatgaggccaggctgattgatcagatcgaagccacacttaataaggtggtggaattaggtttcctgcgcaagctcaagcctgtcggcggaagttcagcaggagagatcagctttgaagtacggcgcattctcaaggcttttgtcgatgcacaatggctggccgaattcgatacccggctggcggtataccagactgccttgtcgggaaccctctcggacgcggtatccgccaaggaggtgcatgatgagtgaaccacagaccttgaatctgaattttgtggtggacgatgctttgtcgggattccggcttacccggctggaggtattcaactggggtactttcgacgatcgcgtctggacgctgcagcttaatggcaaaaatggcctgcttactggcgacattggttctggcaaatccacgctggtagatgcgattactaccttgctggttcctgccaaccggatcgcctataacaaggcagcgggcgcggacagtaaggaacgcaccttgcgttcctatgtactcggacattacaagtccgagcgcaacgaagttactggtgcggccaagcctgttagtttgcgcggccataataactattccgtcatcctcggcgtgttccacaatgcgggctacgatcagacagtgacgctggcgcaggtgttctggatgaaggaagcacaggggcagcctgctcgtttttttctgggaactgaacgtgatttgtcgattgtggaggatttttccaattttggcaccgatattactgccctgcgcaagcggctgcgcggatcgggtgcagagctgcgtgacagctttccgccctatgccgcgtggttcaggcgccgttttgggattgagaatgatcaggcattggaattattccatcagacagtatcaatgaaatcagtcggcaatctgaccgattttgtgcgcagccacatgttagagccatttgaagtcgctccgcgtattcaggccttgattggccattttgatgatctcaatcgcgcacatcaggctgtactcaaggcacaacagcaggtggaactacttacaccactggtggctggttgtaagcagcatagcgagctggtagcggagatggctcatctgcgttattgtcgcgacagcctgcggggttactttggccggctgaagctggagttgctggacaaacgcctgggcttattacatgaagaatggaacagggcagatgcgcaggtgcggcggctggatacgatacgtgaagagcaaggtggtcagctcgatgagctgaagcaggcgatcaatgataacggtggagaccgtctggaacgattggcgcgcgatattcgtgaaaaggagcagcgccgggatgcgtgcaaggctaaagatgagcgttaccgcgaactgattgttgttctggatgatggggctgtggccgccgcagcagatgaagctgcttttgccgtacagtatgcccggttcaaggattggcgtgaagaaacccgcaaccgcgatgcagatctgcaaaacaccctgaccgagcagggagtgaccttgcgtcagggtaaacaggaacacgagttgctgaccgctgaaatcgacagttttaaacgtcggcgcagcaatatcgatgatcagcagatccagatccgtgctgctttgtgcaccgcactggggttggatattgatgccatgccttttgctggtgagctgattcaggtgcgtgaagatgaacgtgactgggaaggtgcagccgaacgtctgctgcgtggtttcgggctagccttgctggtgccggacatacactacaaggcagtggcggagtgggtggatggtagtcatttgcgcggccgtctggtctattttcatgtgcgcgcccgcaagccatccgatctgccagagctgaaccgcgattcattggtgagaaaactctcgatcaaacccgattcactctattacgattggctggaacgcgagctcgcgcatcgctttgatgtggcctgctgtgtaacgcaggagcagtttcgtcgtgaaacacgtgcgatcacccgtgccgggcagatcaaggatccgagtggtcggcacgaaaaagatgatcggcaccgcatcgacgatcgcagccgctatgtgctgggttggagcaacggtgccaagatcgcagcgctggaagccaaacaacgccagcttgaagttcgtctgagcgaagttggcagccagatcggcaagattgatgcagagcgtaaagtgttgcaggtgcgactggatgcactcacacgactggaggaatttacaagttttgaggaactcgattggatcagtgtggcaacagacatcgcggcactggaagatgagcaccgaaaactggaacaggcttccgacgttctcaaacaattgaatgaacgtctgcgggaattgcagcgaatgttcaaggaaaccgagggggagttgcatgctgcgcgcgaccgtcgcgccaaagtggaacaacgccttgcggatacaaaagagttgcgcgcacaaacggtgatactgattcaggatgtcgtcattgatgctgcttttgcggctacccttgaaattttgcgtgccgaggcgctggacgaacatcagctgacggtgggagcctgcgataaccgtgaacaggatatgcgcgcctggttgcaaggtaaaattgatgctgaggatcagaaagtcaaacgcctggccgagaagatcatcaagatgatgacctcatttaaggaggtctttaaacttgaaaccgctgaaatcgatgccagcctggaagcggcgtttgagtatgaaaatctgctcggtcagctgaatcgggatgatttgccgcgctttgttgctcgcttcaaggagctgctgaacgtcaataccattaatgagattgccaatttcaacgctcagctggcgcgtgaacgcgaaaccattaaggaccgtattgttcatatcaaccggtcattgggtgagatcgactataacccaggacgctacattgtgctggaatcgcagaccagccccgatgcagaggttcgtgatttccagcaggaattgcgcatttgtaccgagggcgcagtaaccggatctgatgatgcgcaatattccgaggctaaattcttgcaggttaaggcgattattgatcggttccgtggtcgcgaaggtttgtcggagcaggatcgacgctggacggccaaagtgacggatgtgcgcaactggtttctgtttgcggccagtgaacggtggcgtgcggataatagcgaatatgagcattattcggattccggtggtaaatctggtggccagaaggaaaagttggcctacactattctggccgccagcctggcttaccagttcggtctggaatggggtgcggtacgttcacgttctttccgctttgtggttattgatgaggcatttggacgcggctcggacgaatcggcccaatacggcttgaagctgttccggcagcttaatctgcaactactgatcgttacaccactgcagaaaatccacatcattgaacccttcgtttccagcgtgggttttgtacacaacgaaggtggccgcgcctctcgcctatgtaatctgtctatcgaggaataccgggcgcaaaaagacgaagacacaacgattgtgcaagcatccattgcccacaaatttccacagtgatgtggactcgctcgaaagatctgcaagcacagttggcacggttatgggtgcgtggtgagttgctgcgtgatgttgtcactggcaatacgcgctttccgttgcgcctgacgctcaaatcgccaggttcgacagacattaccgagcgatttgatgctgtccgcacatgggttgcggaactgaccaatgttaatcgcttgcgtgtggaatggcaggaagtccgccatcgggtgcagggtttacagaagctgcctgccagtgtctggatcgattcgatggatgatgcactgacctggcttggcaaacgcggtgattggctgcggttttccagattggttgaggcgacgcgacagcaatatccatccctgttgccctggctggaaagacgacccttgcaggcgctggaactggaggccgagtggttgcgcttactggcagtggtggactgggttgcaaatcatccccgcccggggatttatctgcgtcaggtggatgtgcctggcgtgcacagtaagtttattgaagcacaacgtgcagtgttgtctgagttgcttgatctggcattgcctgtcgacaacgtggatgccagtcagactggtattgcccgatttgctgcccgctatggctttgtagaaaagcctgccaggattcgttttcgtatcctggatcctgaaatacaaatcatcgtgggtatctattgtccggatattacgctggatgctggtagctttagccgattgaccattggtatccaacgggtgtttatcactgaaaatgaaatcaactttctggctttgcccaatgtccctgctgccatggctgttttcggctccggctacggttgggaagcgcttgctcggagccgttggttggatcgctgtgtgatccattactggggagatatcgacactcacggcttcgccattcttgatcaactgcgcagccattttccgcatgtttcatctctgctgatggatcgcgcgactcttgaggcgcacactgctttctggggccgggaagacaaaccacagcggaatgatttgcaccgattaactcaggaagaatcggatctatacgatgctctgcgtgacaaccgtatccgtgaggggctgaggctggaacaggagcatctgggctttggctgggtacgtgaacggattgatcagctgtgatgcgatatgatatttgggtggattttcaagtgaacctgtaaaccgggatatcatgttacgtttactggatattgtgctggcagtcttgggtattctggttaccctgccgctgttggcgattctttatgtggttgggttgttcgatacacgatcaccattatttcggcagataagggtaggaagacagcagaagccatttgtcctggttaaatttcgtactatgcggccaggtacggcttctgttgccacgcatctggcggatgtctcggcgattacttcttttggtaattttttgcgaaaaactaagctggatgagctgccgcaactatggaatgtactcaagggggagatgagcctggttggcccccggccttgcttgccaaatcagcttgagttgatcggagaacgagtgcaacggagagtctttgatgtgcgtccgggtattacagggttggcgcagattcggggtattgatatgtctacccctgtgctgctggcagaggttgataggcagatgatcaagacgttgtcggtggtgaattattttaagtacattgtgctgacagcgacaggtcgtggtgcaggggatcgtgtaagagaaaaatccggttgattaagttttatggttaaaaattacttcagacagtttgcaccctcagtgttgaccttgtcccgtacgatgaaacggctaattgccctttctgtagacttcagtttgtgtgttttgacagtctggctggcttattacctgcgtttgggtgagtttgtcagttttaccaggcagggtccatgggcagagggcgccatttgggcagcggtaacctccgttgtactggcgctgcctatttttattgttactggtctttatcgtgccattttcagatacagtggttggccggcgttattgacggtagcacgtgctatcagtatttatgggctgatctatgccaccatctttatggttatcgggctgtcaggtgttccacgaacaatcggtatcattcagccgattctgctactcctgtttgtcggtgcatcgcgtgcgctggcacgtgtgtggctaggagatcagtaccagaatattttgagacatatttcccggccccgggcacttatttatggtgttggccgaacaggtcgtcagttggcagtagccatggccaatagtccggaaatacagatagcggggtttctggatgatgatgatcgcttgcatggacatgtactcaatggtttgcctatctataacccgggtgatctgacggccctggtttccaccttgaatatcagcgatgtcttgttggcaatgccgggtgtttcacgccgtcgtcgtaatgaaattttatgccagattcgtgatgcgcgtgtttcggtacggacattgcccagtgtgactgatctgatccagggtaaggtgggtattacagatttgcgtgaactggatattgatgatctgctcgggcgtgaaccggtaacaccgaatcatattctgttagcgaagaatatcctgggtaaagtggtgttggtgacgggagcgggtggatcgattggtagtgagctttgccgccagattcttgttgtggggccgatcaggttactgttggtcgaacagaatgaatttgcgctttatatgattcacgaggaactggaggggaagcttgccggccgtgatattgtgttggtgcctctgctggcatcagtacaggatgagggccgtatgcgggagatcatatctacttggcacccggatactgtctatcataccgctgcctataagcatgtgccgctggtggagcataatccggcagaaggcattaagaacaatgtgtttggtacgctccatctggcacgggccgccgaggaaaatggtgtgatggattttgtgctgatcagcacagacaaggcagtgcgacctaccaatatcatgggtgcgagcaagcgcttggcagaactggtattacaggctctggccgataacaattccgctacccgattttccatggtgcgtttcggtaatgtactgggttcatcgggctcagtggtgccgaaattccgtcagcaaatccgggagggaggtccgattacgctgactcatccggagattacccgctatttcatgacaattccggaagcggctcaattggttatccaggcaggggcaatggccaggggcgggggggtgtttgtgctggatatgggagaatccgtgaagattatggatctggcacgccacatgattgagctttctggtttgactgtcagagatgagcagaatctggaaggtgacattgaaattgagatcaccggtttgcgccccggtgaaaagctttatgaggagctgttgattgggaataacccggaactgacctcccatccgaggattatgagagcgcatgaagattctgttccttgggcagagctggaaggtaagctgagtgctttggagatggctttaaatgtgaatgatgtcggtgtcatccggttgatgatggaacaactggttcctggttatatccccaatcaggagatcgtagattgggtgtatcttgcgcaggaagacgaagcacgggcaatggagttgggcagcaaggggacttccggataaaagtaagtactcgctgttcatttgtgtattccgcagcgtgcgttataaatcacgccgttgcaggcaacgtagtcgcgcaggagcgtgcaggtggtatcacgcaacagatcagttgtcacgatgataccgcgaatttccaattcatcaatccagttctctggtcgagggccttcgtcgaaaccgattgcctccacatcctcaccgcgtgcagcacagaccaaactgcgtacgccggaccagatcactgcaccaaagcacattacacaaggttcggcactggttaccagttcacaggcaggcagaccgtcagcgctcagatcgtggctgcccagttttgcctgcgccagcgataacgcaagtatttcggcgtgagcagtggaacagtggcttgataccacccggttggtaccggctgcaatcagcaagccgctgtcgcgctcgaataccgccgcagcaaaggggccaccatctgtagccatattgatacgcatgagttcaagcacataactcatgcgtgcttcaggtttaatcagcacgcgcggctccgtatttgcctgtacgaggaaagctggcagtttgatgtgcaatgtagtgcttatgctcatagggtaactttacactactgtcgatcaatgcgggtagcacttggtgtaagaacctgttcaaagtcttttgagtagaacggccaggaaggccaggtgaataaactgcaagctggtgttgagtaagcgctcacagttcttccacagccgtcgattcttctccaaccaggcaaagctgcgttccaccacccaacgcttggggataacggcgaaggtatgcaactcactgcgcctggcgatctgaaccgcgacagtctcgctcagcacatcgcgtacaccttgagcaaacggctcccccacataaccgctgtccgccaacaccgccaccacccggcccaggcctgaacgacaacgccggaaagcctgcaacgcacctttgcgatcggtcacttccgctgtcgtcaccgcaatggcatgcggcaaaccctgggtatcgaccgcgatatgacgcttgatgcccgataccttcttgcctgcgtcatagcccttctagctcgccgtgtccgtgttcttcacgctctgcgcgtccacgatcaagaatgacgtgcaggcgttgcgcccctgtctggtacgaaccgcgccaacctgatttttttaatgcctgctccagcaggctgcctccttcgcgcggctcactccagatggcccagtatgagtggacagtgcgccacttgggaaagtcattaggcagggctcgccactggcagccgctcttgagcaaatacagcaccgcacaaaaaacctcgtacagatctatttcgtcgagggctggtcttcctgcgcgcgctctccagcaaaggcttgataagctcgaattgttcacgactgatgtcgctcgggtaactttttctcatcttccgagtttctcatactcccaaagactttgaacaggttcttacttcggcacaatcgaatcttcattgttataaaaattgatttttttgtctgaaagccattggtactggcctgatatccagctggtgtggttacccgattaaagtcagcccgcaagcagccgataaagtctgaaattcataaaaggtttttcagtcatgttggtaactatcggatatcttattgtcattgtctccgtgtttggtggatttgctctggcgggcggccatctgggatcattatttcagccggtcgagctgctcatgattgcaggtgccgcgctgggtgcattcttcgtcggtaattccggcaaagcaatcaaggctactttcaaagcgcttcctggtgtttttcagggtgcccgatatactaaggtggtctacatggagctgatgacactgctctatgaagtgctcggcaaaatccgcaaggaagggctgatgtcgattgaggcggatgtggatgatcctgctaaaagtccgttgttcacaaaatatcccaaaatcctgtcggatcatcatgccatagaattcattaccgattatctgcggctgatggttggcggtaatcttaaccccctggaaattgaaaatctgatggatggtgaaatcgaaacgcatcaccaggaaggggaggtgcctgtgcatgttatcggcaagatgggggatgcactcccggctttcggaattgtggcagccgtgatgggtgtggtgcatactatggcgtcagtcggcattccaccggcagagctgggcaagttgattgctgcggcattggttgggacgtttcttgggattttgcttgcctatggttttgtcagccctctagccagtcgcctggaacagagattgcatgaatcaagcaagttgctggagtgcatcaaggttacgctgctggctaatctcaacggctatgcaccggctctggcagtggaatttggcaggaaagtactattctccaccgagcggccatcgttcatcgaactggaaaaacacgtcaaacagagtaaagctaaatgatgttgcttctccaagtttttctgttgctaagtgaggtcgtgaatggctgaggatttttcacaaaaaccaatcattatcaaacgtattaagaaggtgtcggggcagcatcacggtggtgcttggaaaattgcctatgctgatttcgtgacggctatgatggccttttttttgctgatgtggttgttgggttcaactacgcagggggataaggaaggtatttctgaatatttcaagatgcctttaaaagttgcgctgcttgggggagatggcagcggggacagcaccagtgtcattaaaggaggtggtgatgatctgagccggcgaatcggtcagatgaggcgatccgattttgatgacttgaagcaatctcttgatatggatgcgctgcagattctccaggatcgtgttgagcgggaacaactggaaaaactcaaagccaaaatagaagatgcaatcaacagtaatccggtacttaataaatttaagagccagctgttactcgatattacctcggaaggtttacgcatccagattgttgatgaaaaaaaccgtccgatgtttgctatcggaaaagcagaattgcagccgtatactaaaatgattctgcatgaaatcggcaagatgctgaatgatgtcggcaataaaatcagtctttctggccacactgatgcgactccctatccctccggtgaaaaaagctacagtaactgggaattatcggcggatcgtgccaatgcttcccggcgtgagctgatcgcgggtggaatgaatccggagaaaatgttgcgagtggtcgggctgtcttccgcggtgatgtttgataaagaagattcattcagtccgtttaaccggcggatcagcattatcgtcatgaataaaaaagccgaggatgccattacccgtgaaagcctgggtgaagtaaacatccatagtgaagaagaagtcagtccgcagattgtggatggaaacaatgccgtatccaactgagactgttcatcagtgtgctgcttccgaatcactgctgaaaaagatctttgtagtgctgccaggcagtattttgcttgtatgtctgcttggggtaattctgccgtggccgctcacgctgctgcacgcaatctggctgcagggagtgattgctgcgctcatgagtttctatctgttgcgcttgccagtctggcaggcggttattcatctgttcttttttccggcgctactgtcggcaatatcaacactggagctgtctgctgactggtatctggctggttttattacactcatgctagtttttggaagaatacatcacacacgggtgccgttgtttttgtctagccgggaagcggttgatacactggctggattgctgccgcaggattgcaacttcaaattgattgatctgggctcggggtgtggcgggctggtatgtaaattggcgcggatgttgccgcatggtagctatcacggcgttgagaccgccatgttgccctgctggatcagtaagttgagagcaatgctatccgggcaggattgccggtttcaatgggaaagcatctggcggcatgatctgtctgggtacgatgtagtatatgcctatctttcccctgtgcccatgcctcgtttatgggagaaagtatgccaggaaatgcgtccgggtagccttttcatcagtaacacctttactgttccaggcgtcatgcctgatcggtgtatccagctggatgattttagtggtgccgcactttatatctggcaaataccttgatgaaattctgcgttattgtcgtcgccaggttgttccttgcggaccgtcttccagaataatgccggcttcggccagttgctgacgcagtgcatcagcctgcgcaaaattcttctccttgcgcgcctgtaatcgctgctggatcatgcgttcaatttcttctatggaatggtggtcattctgtgggtgtgcgggatgttgcaaatattgccttggtgattgctgtaacagacccagtattccacctagagccttgagcaaactggcatagtgtgaattacccgtccggtttgcttcgcttgccagatcgaacagcaccgcaaccgcctctggtgtgttgaaatcatcattcatcgccgccatgaaacgctgagcgtagccatcatttacccagtcaatcgtagcagttgcttcttcagctgcctgtgcctgtgatggcgcgtgattcttcagcgctgtgtagagacgttccagtgcgtttctggcatcgttgaggtgggcatcagaataattgagcgggctgcgatagtgtgcccgcacaatgaaaaaacgaactacctcgggctggtagcgtgccagcacttcccgcacagtgaaaaaattacccagcgatttggacattttttcattgtctacgcgcacaaatccgttgtgcatccagtaattaacatgggggtggccgtggacgccttcactttgcgcgatttcgttctcgtgatgcgggaattgtaaatcctgaccgcccccatggatgtcaaaccgctcacccaggtagtgcccgctcatggcggagcattcaatatgccagcccggacgtcctttgccccacggcgaatcccagctgggttcatcgggtttggcagctttccataacacaaaatccaagggatcccgcttgttggtatcgatctccacgcgctcaccggcacgcaaatcatcgagtgatttacccgagagcttgccatagccggggaaacggcgtacgtcgtaaaatacatcgccgttgtttgctacgtaggcgagccctttgctcagtaatgattcgatcattgtgaccatactctcgatgcattcagttgcgcgcggctcgaaagaaggactgatgatgcccaatgccgcagcgtcttcttccattgcttgaatgtagcgggcagtcagtgctccaaacggctcatggttttccagcgcgcggcgaataatcttgtcgtcgatgtcagtgatattgcggacataagtcacctcgtagtcaagagtctgtagccagcgtactacgctgtcaaatacgaccaatacacgagcgtgtccaagatggcagtgatcataaacagtcatgccacacacatacattttgactttcccgggtgtaagagggataaattcgcgcctggagcgggtgagcgtatcgtaaattttgagcatcggaggcgtatgcaagagagatagttgtgagaagtgcttattttattgataaaatcagggacttttctttataaccgtccgcccggcagaaccaggggcaaaaccgtgtgagtatagcataatgataatcttctcctttgagcggcatactgctcgttcaataaaaatagttacctccactacgcttttctttaccttatgcctgacgatgttggcaacatccgtttttgcagctaatcctaaggttgaaattaaaaccaatcttggcgcgatacagatagagctttatgccgatcaggcgccaaagactgtcaagaattttctgaactatgttaatgatgattactataccggcacgatttttcatcgggttattgccaagttcatgattcaagggggtggattcgatcagaattacgtacagaagcctacccggcagcctgtcgaaaatgaagctgccaacgggcttaaaaatacacttggtacgattgcgatggcgcgcaccaatgaaccacattctgcctcgtcacagttttttattaatgtcgcaaacaataattttcttgactacaccgctcctaccatgcaggggtatggttacgcagtctttggtaaagttacagccggcatggatgttgttaatgctattgccgggacgccaaccggagcaaatgggccttttaacagagatgtaccacaaaacatgatcgttattgaaagtgtcaaattgctcccggcttctgccaattccgaaaatccgtaaactcaggacaaaattaaaatggttaaaatacatacaaattacggcgccattactttggaacttgacagcgataaaacgcctgtcactgtcgaaaatttcctgcgttatgttgatagcggacattacgacaacactttgtttcatcgtgttatcgatggttttatgattcaaggtggtggttatgcaccaggaatgaaagaaaaatcaactttggcacctattcagaatgaagctgctttgggttctggtaacgagacctatacaattgccatggctcgcacttccgatgtgcattctgccactgcacagtttttcattaacgttgccaataacggttttttgaatcacactggcatgacgccacaaggttttggttactgtgtatttggccgggttgtggaaggcaaggaagtggtggatgcaatcaagaaagtgaaaacaggtcgttctgccggacaccaggatgtaccgctggaagatgtcatcattgaaaaagctgagcgggcttgagctaaaattctgataaataatttgtctggcaccaaaaataatttggcctgtgttttacaaatggaaattcagtagaaatgatggagatcaataaaattctggaaacagctcaaaatcgggcgcaagagttgggtgtttgctacaggggagcactgttgccatcagaggcgcataaggtgctgcaatccatgccggaagccagagttgtggatgtgcgctgtcgagctgaactggactgggttgggcgtattcccggggcaattgaagtcgagttgctgacttacccgggaatgcagcccaatcctgattttctggaacagcttactggtcaggttgcagatgatgccatcctgctgttcatctgccgcagtggtggccggtctgaccaggcagcaacccttctgagccagaatggttttacggagtgttataacattctggaaggttttgaaggcgataaggatgaaagtggtcaccgcgggcgacaatccggctggaaagccggtggattgccgtggattcagggctaaagagggctttaatattaacctgcagaccagttaatcaggccaaaatgggctgtaagcaatacaatcaggccaaaaccaatgcggtaccaggcaaacagggtgaaatcatgatggctgacatagcgtataaacccgcgtatcgcaattaacgcgctaatgaaagctgcgattgatcccaccacaaacattcccagatcatcgctatgtaaaaattcccggtgtttgtagacatcatagaaggttgcagcaaacatgattgggattgccagaaagaaagaaaattctgcagcagctttacgtgataatccggacaataatccaccgataatcgttgcgccggaacgggaggtgccagggatcagtgccagacactgtgcgcagccaattttcagcgcatgcttccagttcatatcatctacattttcaacctcaattctgtgttcccgacgctcggcccagagtatcagcacgccgccagtcaccaatgcaatagcaaccggcagcgggtggaataagtaatactttatcgttttgatgaatagcaagcccagtattgcggctggtaagaaagcaacgcacagattcagtacgaaacgatttgcccgtcgggtgccccaccccctggccacatttattagccgtgcacgatattcccaacaaacggagagaatcgcccccagctgtattgctaccgtaaaaacctgagctttatcgtcattaaaatccagtaaatcgcccgccagtattaggtgtccggtagatgagattggcaaaaactcggtcagtccttcaacaataccaagcagaaatgctttgatgagaatcagccagtccatagcggcctaatgtgaattgtttaagcaaatgaaatcaccaggaaagatcatagttttctataaatctcaccgcctttttcaatgaattcatccgcttttttggccatgccttcctgtaacgcctcattttcagaaataccctgttgtgcagcataatcacgcacatcctgggtaattttcattgagcagaaattgggcccgcacattgagcagaagtgggcaagcttggcaccttcctgcggcagggtttcgtcatgaaattgcctggccttatctggatccaggcttaaattgaattgatcgttccagcggaactcaaaacgcgccttggacagtgcattgtcacgaatctgtgcgcctgggtgtcctttagccagatcagcagcatgtgcggcgattttataggtaatgatcccgtccttgacgtcatccttgtccggtagaccaagatgttctttgggcgtgacgtagcacagcatggcagttccataccagccgatcatggctgcgccgattgccgaggtgatgtgatcataaccaggtgcgatatcggtggtgagtggccccaatgtatagaaaggtgcttcatgacaatgttcgagttgcagatccatgttttcccggatcaggtgcatgggcacatgccccggtccttcaatcatggtttgtatatcgtgtttccacgcaatttttgtcagttcacccagcgtttttaattctgcgaattgtgcctcatcattggcatcataaattgagccaggacgtaagccgtctcctagggaaaagctgacgtcataggccttcatgatttcgcagatatcttcgaaatgtgtatacaggaaactttccttgtgatgtgccaggcaccatttggccatgatggaaccgccacgagagacgataccggtcatgcgtttggctgtcattggaacgaaaggcaaacgtaccccggcgtgaatggtgaagtaatccacgccttgttctgcctgttcaatcaacgtatcgcggaaaatttcccaggttagttcttcggccttgccatccactttttccagtgcctgataaattggtacagtaccaattggaactggactgttgcgaataatccattcgcgtgtttcatggatattttttccagtggagagatccatgaccgtatcaccgccccagcgaatcgcccaggtcattttttccacctcgtcctgaatgctggaacccagtgcggaattaccaatattggcattgattttgaccagaaaattacggccgataatcatgggttctgcttccggatgattgatgttggctggaataatggcacgcccgcgtgctacttcatcacgaacaaattctggggtgatccattcctgaatcgcagcaccaaaactttgtccggggtgttgtcgagttagtaactcgcttttcgccagatcggtgacacgctctctgcgctgattctcccgaattgcgatgaattccatttccggtgtaataatgccgcgcctagcgtaatgcatttgagtaacattgctgccccctttggcgcgacgaaccgggcgtgtgagattaaaacgcattgctgtcaaagcgggatcttgcaaccgttttaaactgtaacttgaggataatcccgagagaacttctgtatcttcgcgctcttcaatccatttttcacgcaaagggagcagaccgtggcggatatctatattggtgtcaggatccgagtaggggcccgaagtatcgtagacgcagatgggcgggtttttttcgattccctggctggtgttggtatcagactggctgatttcccgcatcggtacccggatatctgcgcgggagccttgaatataaatcttgcgtgaattggggagagattgtattgcagctgtatctacccgtgcattgtcactggtgaatttttccagtctggaaacaggtattttcatgctatgctccttaagaaagccgcaaggagcagggaaattactcccagcttccctccggcggcgttatccgcatcaggtattaagggactgtctcaccgacattccagttttctgcgaatgcggacccctagccaaagctgccaagctaaagtaaatatggaataattgcaagcccgattctttcgttgataacagaattagatctatgatgaacctcgaacaaagtcgtttcaatatggtggaacaacaagtccggacctggaatgttctgaatcaggatattcttgacttgttatatcagataaagcgtgaagaatttgtacctgcagcttatcgttttatggcattcacggatatggaaattccgctggagcatgatgcggtaatgctaacgcccaaaatggaggcacgtattctgcaggaattgaacatcaataaaactgataagatccttgaggttggtaccggaacggggtatatgactgcgctgttggctaaacttggtgcacatgtttatagtgtggaaatcgtaccggaactgcatgccatggcgcgtattaatctgcaggcacatgatatcaccaacataacactggagcagggtgatgctgcacgcggctggcctgatcacggtccgtatgacgtaattgtcctgacagcttctacaccagtgctgcccgaggcatttcagcaaagtctggcaccgggaggccggttgttcgccatagttggtgaggagcctgttatggaggcaatgttggtaacctgtaccacaccaggtaactatagttcgacccgcttgtttgaaacctgtactgcgccattcagaaatgcattgcagcgcgagcaatttcatttttgaagccctgtgtccgctaaccgcttcataaaagccaatgtactgataacttcagtggcaatcatcaaaccacgaaaatacgaagataatgaaatcagccggctaatgatgaaaagcttacgaggtttagcgtgtctattatgcttgagcatgtttgtttgtgttcagttagaagctgccgatctgatgcagatttaccgtgaagcgctggaagaggatgcacaatacggcgcggcgcgcgctgcctatgtggctgcacaagaacggatgcctcagggaagggcagggttgttgcccgatattcgcctgactggagttggccaaaatcaatatattgaaacaagtggtttgccaagccgagagatcaaaaatcggggaattaccgcgactctgactcaaccgctcattcgttttgagaattttattatttatcagcaatctaaaaatgaggtggcgcaggcagatgcgcaattcattatcgcagcgcaggatttgatcttgcgggttgcacaaacctattttgatatactcaaggcaaaaattgaccttgaggtagtcgagtcgcagaaaaaagcgattcatgaacagctagaacaggctagacgaaattttgaagttggtgtttcgaccatagtcgatacacacgaagccgaagcgcgttacgatttaaccttgtcacaggaaatcgctgccagaaacaaactggaaattagtcagcatgcattagaagttctaatcaatcgactcccgaatgatctgcaggatgcaagcctggacaagattatcgccgatccactttctttgcctcacgatggtatggatgagtgggtcgggctagcggaagaaaagaatttccagctgaaagtacagcgtattgcttacgagatttccgagcaagacattgaccgtgccaaagctggtcactatccaactcttgatctggttgcacaatatagtgatcagcatggtgtcggcggtgctttcaccgggcgagggctggatatcgtcaataaatctgttggattacaattgacggttcctattttccagggattgtcagtgcaatctcgtgttagagaagctttagctaaccgggacaaggctcgtaaagatatggaaaatgtgcagcgcacgatcgcattgcaggttcgccagaattatctcaatgtaactaatggtattgctcagatcaaagcgctgaagcaggcattaacatccagccgcagccagcttgattcaaccacgttgggtcaggaggtaggtgtacggatggaaatagatgtactcaatgcgcagcagcaatatttttcggcgcgcagagatcttgctcaggcctattatgattatctgatggcccggctccagcttaaagctgaagtgggtgatctggatgaagatgatttgctggaaattaatgcattactttgattcttcttgtttatttttagtaaaaaagccgaaaaattagtgtaatcaaggtagtagaagaattatttttctggatgttcgcttggtcgtttagaggatatttttgtgcgttgtggttgctgatggcaagccatgcggtaagcgcgtaatgctttttgtgcgtggctcagaacggtatcctgtggataattgataatttcgcgtggctcgacatcatcactgattccggcaggaaagccggatagtaattccaggccatcatacatatgatcgatagcgtaaatgtggaacatacctttggataccgcattaattacactatcatccagtatcaggtgacggcaattgcgatccgggatcagcactccttgagtaccatcaagaccggcagtttcacaaaccctgaaaaatccttctattttttcattaatgcctcctaccgggagcatttcaccaaattgattgatcgcaccagtgactgcgataccttgtttgaacggtaatcccgacaaggctgaaagtagtgcatacaattccgcgcatgaagcagaatcgccttctacgccatagtattcctgttcaaacacgatagatgcattgagtgcgagcggtgcattatggtgaaacaaagcggatagaaaattttgtaggatgaatacgcctttatcgtggatcggcccggacatgccgacttcacgttcaatattgagcagaccgtcttctccagcgaaggtgtgcgcagtaatgcgtgtaggaataccgaaactgtgatcacccatctcgatcaagctcaaaccattgatctgcccgactttttcaccatgtacggtgatgactatatctccgtcagcaatagcttcttgtgcacattggtccgggtaattatgtcgcagtgtccgagcctggcgggcagttgtaacatctcgctcctcaacaatagtatttccgcgcgctttgcattgcagggcgctttccacaaccagcatttctgtataactgaagtttgcacttaatcgcttctggtcttctgtggttctgtggcaggtttttagcacacaagcaaccgctccgcgtgaaaaatgtggcagagaggattgtttacagagatgggatataaaaatagacagagcccggtaggcttgtatactggccaggaatgagactgcaaaatcaacttttacccggaatcgccgcgctagttcgggattttcttcctgaattgtgtaatattgctcacgcgagccaatcaggatgattctgacatcaatcttgacagattcaggttcaatgggtatgaccggtgttgcggcattagcagtccaggattcttcaatctgcaatatgtggttacgcagaaagcgacaaattttttcccacaagaaagtatcaaccagtaaatcatccaaatgtaacatcaggaagccaccatgcgccttcaacaaactgcctgcgcggatacgcgtaaaatctgtcaccagcataccttcaatggattggtacccgatactgccaatcatcgatttaaaagatggattgtcatcgaccacaaccggtgcgctgattgaatctcggttgtctactacgatatttacccggtagcgctcaaacaactcctttagatcttccgggctcttttcttcatctaaatcagctggctggaatatatccaggttttcaagaatatcgtgtttgatcccgttcaagtggtgttcaagcctggcataatctttaaaggatcggtccagttcgcccggtacggcatccaatacctgatttagcagaggttcaatccaattccgacataatgtggagagctccttatcccggttttggccaagcatacgaattttttggagataagatgcaatttcatggcgtagtgcttgttcgtcctgatcgagagcagctctccggtctctcggtagcgtcaagatttcttcttcggtcagtggctttccggattcatttaaaagcgtaaaaaccaggcgtccagattcacgccgaattgcaaattttaatgattctgcatatatattgagtttttcaaaataattgctttcttccagcttgaagcggttttcaatgtgctccgcttctgccttgaaatcatctctattcagccgttccggtatttcctgcaataaatcgctcatggattgtgcaagttgttgccgtagccagctacctttgcctgctggtaagcgtaatgtcagaggtcgttccggcacatcaaagttgtagacgtagcataaatcagatggtacaggcttccctgctgcaacttctgtcatcgcctgtcgcagcagggaagatctgccactgcccgtttcgcccaatacaaaaaggttgtagtccgggtgttccatttcgaggccaaaataagttgcccgcctggcacgttcctgaccaatccagtcaagtggttgatcaatcaaagtagatgtatctgagaattccagagaaccgggatcaatcgttaaactgagtgcatacggctctaatctggttattggcatatgggctattgtaggactaggggaatttgaagattaccggatattctcagtattgttcgatactggaagctggtaaggatacgtgcttcaggcagggcgaatagatagtattttgagatcctgattgggcagagtacctggatactaatcttgtccaaatgagtttgattactcgatcatctgttatcgcatgtgttctaaaggtcatgatggaaaatcacttggcgattgttcataagtcaagtggaattaggtggtgatgccaagttttcgcagggtgatggcaagagcatttccggtattgcacaaacaagtatcaaaaatgatacaggggcgctgaaaaaaatactttgtaacggtgaatgatgacacttcagttctggtttttgtcagaaaattaatagctggattactgtttttgctgtggcactaattagggaaataacagaaaatgcgagcaaaaatttagtttttcgccggagcagtaaatttctcctgttacaaaatggagaaatttactttttagcagcagctctaccagtcacctatacagcgggattatttgcataatattgatgcgcagcagatgatgctgcacctttatcgactttcgtgcccaaatcggccaatacatgctctaatgcatccaggcagaatatgacgttttccagtttgcttgaattacccatcaagccgatgcgccagatttttccggcaaaatcacctaaaccagcaccaatttctagattgtaatcagccaagagcctgcggcgtacttctttttcatctacgcccgtcgggacatgcacagagttcaactgtggcagacgatatgcttcatccacgacatatccgatacccagtgttttcaatccagcttttaatgcttcgtgattacgacgatgccgggtccaggaatgctcaagcccttcttcatacaatataatcagtgattcatgcaagccatatagagaattggttggtgcggtgtgatgataggtgcgggaagatccccagtaaccgagtaacaaactgatatccatgaaccagctgtgtactttttcagtacgattcctgaccagatctactactctttctgaaaaactgacgggagacaatcccggtggacaggataaacatttctggctgccggaataaatggcatcaatatcccatccatccatataaacaggtgtcccgcctaatgacgtgacagtgtccataattgttaggcaatcgtactttcttgctatttggccgatggtcttggcatccgactgaacacctgtagaagtttcggcatgtacaaacgccacaattttagcatccggattctttttcagtatatcttccactttttgaggatcaaccggatcgccccatttatcctccactaccaatggaattccgccacagcgttcgacattctcgatcatccgtccgccaaagacaccatttctgcaaacaacaactttgtctccaggcacaatcatgttaacaaaacacatttccattccgaccgaacccggtccggaaactggaaaagtcaataaattggtcgtttgaaatacatatcgcagcaagcctttcaattcttccatcatttcggtgaaaaccggatcaaggtgacccagtgtcgggcgagccatagcggataaaacacgcgcgtgtgtatcggatggtcccggaccaagcaaggtgcgctgaggcggatagaaagtggttatttttttttctgggcgaaagctatcaatggtcatcgatattcctaatatgagtgaatgaaaatgttgttctctagaatccggtttctatcagtaaccagaatcttcagggaaatatcaaatagcctaccggtggaaaccaataggctatttactttgacttcagattaagtcaaatagtacttccttgggattcatcttaaggattcaagcaaagattctatcaagtgatcgtgaaatttactattcgcttgtctgcggaaaataaagccgaatctatttataaaatagcagctttaaaggaagatactttaaaattttattgaagctctcccgttatgtgtatccaaataatcaatgcttgattgaagaagctcttgtaacgctatctttaggtgtggatgcaatgacttgaccagggatagctgacggtatcgcatcaggcttatattccagagcaatttctagcacctggtcaatccattttactggcttgatatccagtttgtttttaatgtttccaggaatctcactcaaatccttgacattatcttccgggatcaacactgtgcttattccaccacgatgagcagccaggagtttctccttgagcccaccgattggaagaatttcgcctcttagtgtaatttccccggtcatcgcaacggatgctcgcactgggactccggtcaatgcagaaaccatagccagacaaataccaatacctgcactcggcccatctttaggcgtggccccttcaggcaagtgaatatgaatatcgttcttcagataaaaatcatctgatattcccagaacgattgagcggcttcgaacaacagacagggctgcctgaatggattcctgcatgacttcacccagtttaccggtcgtaatcgtcttccctttgcctagtagcactactgcctcaattctcagcaactcaccgcctacctccgtccaagccagtcccgtaacctgtccaacctgatttttttcgtcagccatgccataagcgtaacggcgcactccaagatatttatcgaggttgcgggagttgataataatcttttccttattttttttaaccagcaaaattttgacgactttcctgcaaatcttggagatttctctttccattgaacgcactcccgcttctcgggtgtagtagcggacaatgtcacgtaatgcagattcagaaacagacaactccccctcgcttaaaccatgatccttcatttgcttgggtagaagatatcgttttgcaatatttagtttctcatcttcggtatagcctgaaagtcgaataacttccattcgatcaaggagtgcgggaggaatgttcagtgtgtttgcggtagcaacaaacatgacatccgataagtcgtattcaacttcgatgtagtgatcaacaaatgtattgttttgctccggatcaagtacttccagcaaggcagaagaagggtcgccacgaaaatccattcccattttgtcaacttcatctaacagaaacagtgggtttttgacaccgatttttgtcatactttgcaaaatctttccgggcatcgaaccgatgtaagttcgacgatgcccacggatctcagcttcgtctcgcatgcctccgagagacatacgaacaaatttacggtttgtcgcgcgagctatagatcgacctagtgaagttttacctaccccaggcgggccgacaaggcaaagaatgggagccttggatttggcaacccgctgttgtactgcaaggtattcaactatcctttcctttactttctccaaaccataatgatcttcattcaggatggattcggcaatctttaattctttgctgattttggttttctgcttccagggcaatgcaactagcgtgtcaatataatttcgtacaacagttgcttcggctgacataggagacatcaggcgcagttttttcagctcagactctgccttggctaatgcttctttaggcaaggaagctgcctttatttttctttcgatttcttcaaggtcagtgccatcttcgccttcgcccagttctttctgaatagctttaacctgttcattcaggtaatagtcccgctggcttttttccatctggcgcttgactctaccgcgaatgcgcttttctacctggaggatatccagttcggcttccagaaggccaagtaaacgttctaaacgtggctgaacttcaaaaatttccagaatttcctgtttttgctccagtctcaagggaagataagcagcgatcgtatcagctaatcgtccgacctcatcaattcctgtcagggaagcaagaatttctgatgggatttttttgtttaatttgacatattggtcaaattgggaaagaagagcgcgtcgtaatgcttcaatttctgacgtgtcgatctcatcaatcgtgactggtatagcctttccagaaaaataggtttcggaatcattaaaagattcaatttctgcccgataacttccttctaccaataccttgactgttccatcggggagtttcagcatttgcaaaatgcttgaaacacagcaaactttataaaggtcttggggagaagggtcatctttagaggctgatttctgagcaactagcagaatattttttccagcttctgtcgcagcttctaaagccttgatagactttggacgtcccacaaataatggaataaccatgtgtggaaagaccaccacatcacgcagtgggagcagtggtaaatcaagctcgttttttggttcttgggtgtcgagaatatctgatgtcatgtcatttacatcctgcagaaaacatggataggataagatatggtgacacctgtgaaaaacaggtacccgcagtgtgctaaaaacaaactcttaaaagaatttgtactatttcgagcttctggccagcttgggcttttcagcataaattatgataggttgaagatcatcatttgtagagctgctttcgatcactacttttgagacgtttttgattgaaggcagatcatacataatatccagcagtgtttcctcaagaatagaacgtaatccacgtgctccagttttccgtgcaagcgcttttctggcaattgttacaagagcctgttcgcggaattccaattcaactcccccttccatgctgaatagcttgctgtattgtttaaccagtgcatttttgggttcaatcaaaatttggatcagtgctgcctcgttcaattcacgcaacgttgccacgactggtaaacgcccgataaactccggaatcaagccatatttaattagatcttctggttcaatgtcacccaatatcttgtttaattccttgcgatcgttctggttgatgacatccgcaccaaagcctatgccacttttttcagatcgtgcacgtatgattttatcgataccatcaaatgccccaccgcaaatgaacagaatatttgtggtatcaacctgaataaattcctgattgggatgtttgcgcccaccttgaggaggtaccaaggctgctgtaccctcaatcagtttgagtagtgcctgttgtacaccttctcctgaaacatcccgagtgatggaagggttgtctgatttacgcgaaattttatctatctcgtcgatgtatacgattccgcgctgggccttttcaacatcgtggttgcttgcttgcagcaacttctgaataatattttctacatcctcaccgacatatcctgcttctgtcagcgtcgttgcatcagcaataacaaacggtacatctagcaatcttgccagtgtctgtgccagtaaggtcttgccagatccggtaggaccaatcagcaatatgttgcttttggcaagttcaatgtcatcgctaccagcattaacttttgatagatttcttaatcgcttatagtggttgtaaactgcaacagacagtattttttttgcagattcctgtccaatgacatattgatccagtgtttcacaaatttcatgtggggtcggcaaacttgttttagatagtttggccgtttcatcaacctgtatttcttcgcgaataatgtcattacaaaggtcgatacactcatcgcaaatgaatacagatggcccggcaattaacttccggacctctcgctgactctttccgcaaaaagaacaatacaaaagtttttcgtcatttgttttttcagacattattccaccccacaatcatcaaacgaatattgctcttgttcaacaggaacaatttgattttactcgtgttttactttcctgctcgttaatactgcatccactaaactatactttacggctgcttctgcgccgagaaaattgtcacgatcagtatctttctcaatagttctaatcgtttgactggtatgtttagccaaaatttcatttaaacgacctttcagtgccaaaatttccttagcgtgtatttctatgtcggatgcttgtccctgaaatccgcccagtggctgatggatcataacgcgtgaattgggtaggcaataacgcttgcctttggcgcccgcagtaagcagcaaggcacccatgctggcagcttgtcctatgcaaagtgtgctgacatccggtttaatgaattgcatggtgtcatacacagctagtcctgccgtgacaagcccgccgggcgaattgatatataaggaaatatctttctctgaattttcggattctagaaataagagctgcgcaattaccaagttggcagatgtttctgtaaccgggcccactaaaaaaatgattctttctctgagcagccttgaataaatatcgtaggcgcgctctccgcgaccactggactcgattaccatgggaatcaaacccagtcctgtagtattcaattcgtttttctcccaatcaagtattggttgcatgtgaatatcccattagttcatcgaaagtgacattctgatcaacgatattggctctgtccagtatccatgatacggcgttatcctccagaacaagcggttctatttccttgattcgttcaggtgaagcgaagtgccatttgacgacctgttcaggattttcgtaactttgagcatgttcttcaataaaacttttgatttgctcaggctttacacctaatccgtgtgtttcgatcaacctggataaaatgagtcccagcctgacgcgccgctcagctctttccagaaaggtatctctttgcaaattggaggctttaggaaaaccacgtgctgtccgggtatcttgtacttcttctattagccgatctatttcctgttgaaccaaaattttggggatatctactgaaatcttatccagtagggattgcatgacttgttctttgagttttacccggatacgctgggttgtttcacgctgaagattagccttgatttctgattgcattttttcaacattaccatcttcaatccctagcgacttggcaaattcaccatccacgtccggtagcttaggagcttcaaccttattgagtgtaattgtaaaagttactttctttccggcaacttcttttcctgaatagtcttcaggaaaagtcatatcaaacgttttctcctgtcctgtactcatgcccaggatagatgcctcgaaatcttccagaagatgcccgtttccaagaatgacactgtaattatctgcctggccaccagcaaagttctttccgtccagggatccccggtaattgatattaacccggtcacccgtttgtgccggacgatctaccgactcatagtttgttcgctgtttacgcagaacttccagtgttttctggatttccacgtcgccaatctgtaaaacaggtttgttgattgtaatcgaatttaaatcacccagttcgatattaggatagatttcaaatgttgcgcggaattcatagtttgaattatctgttccgggatttctggattcaaagtttggaacacctgcaatgcgatagttttctcgattaatactttcgctaaactgttgttgcaacaactctcccagcacttcgtgctcaatctgatggccgtattgctgtgcaactattttcataggaactttgcccggacggaatccctgtatcttgatttttggagccaggcgcttcaggcgctgacccacttcggcttcgactttttcccgtgaaacagagagttcaatattgcgctccagtggattggaggcttcctcttgtgtctgcatctattttcctgagctgatacgtaacattgattaaacaagtggtatgatcgtgctaggttggccaagcctgaatattccgtggtgcgaaaggggggactcgaacccccacacctcatcggcgccagaacctaaatctggtgcgtctaccaattccgccactttcgcgcgccgggctattcaaaaattagcgggattcagaattcccaaaaacaagatgatttttgctcacacagttgtgccgcagcttgtttttcagcgaatcacaccacacccctttatagccaattatactcgcttctaacaaccggggcagatttcctgtccgttgtgcggttaatctttttggcaattgaacgttttgccagttactccagtactatttggtcccatcaggaagagataagtccccatcagatctgccggtttgggtaataaacggttattgctgcccggatgagttttggtacgttgtggcgtgtctgtagctccaggaatcagtgcgttaatgcgtaaatttggataaatctcccactcctcagactgaattttgaccaatgcttccacccctgctttcgctactgcaaaagcaccccagtaggctgtgggtacttggccgtgggtgtctcccgtcatgattacactggcatcctgggcggtcttgagcaacggaaaacaggcgcgagtcagcattgcagggatgagaagattgatctgcatggtggtttgccagtgctcaagtgtatggaattcaagtggcattgggccggtggtccaggcgacattgtgcaaaataccatccagccgaccaatttgggaggctattgccccagctagttccacaatgccagtttcagtagcctgttcgaaatcaaatggcagaatgattgctgatgctctgtcgagcgtctcgatttcatcataaacctgctcaagcttctcggttttacggccatgtaaaataatcgtggcgccatattttgcgaaagtgagtgctgcagtgcgcccaataccttgtcctgcacctgtaaccaggataacccggtctgcaagcaaattccggtcatccggataagtttttaaagtatccaatatatttatctcagcacgaccgatagaagttaaaaaccacaacgtccggttttttgcataccgatccgttgtggttcattattgttaacagatagaccgattggagtcggttacatgtccataccgcccatgccacccataccgcccatgccggcacctgccccaggcgaatcttcttttggaagctctgcaaccattgcgtccgtcgtcagaatcaatcctgcaactgatgaggcgttttgcagagccgagcgggttactttggtagggtccagcacgcccatagcaactagatcgccatattcacccgttgcagcattgtaaccaaagttacctttaccttccttaactttgttgacgactacagaagcttcatctccgcagttggttacgatctggcgtagtggctcttccagtgcacgcaaaacaattttgatgccggaatcctgatcatggttgtcgcctttggccttgctcacagcatcaattgtacgcagcagggcgacgccaccaccaggaacaataccttcttcaaccgcagcgcgtgttgcgtgaaaggcatcttcaacgcgagcttttttctctttcatctccatttccgtggcagcgccaaccttgattagagctacacccccagccagtttggctacgcgttcttgaagcttctcgcgatcatagtcactggttgcttcttcgatttgtttgcgaatctgtgtaacgcgtgcttcaatggctttggtatctccggcaccatcaataatggtggtgttttccttgccaacttcaacgcgtttagcctggcccagatcttccagtttagctttttccagggataaaccgacttcttcggcaatcaccgtaccacccgtcaggatcgcgatatcttccagcatagccttacgacgatcaccaaaaccaggtgccttgactgcgcatgttttgaggatgccgcgaatattgttcacgaccagtgttgccagggcttcaccatcaacatcttcagcaatgatcagcagtggtttacctgctttggctacttgttcgagtattggcagaaggtcacgaatattggatatttttttgtcgtgcaacagaatgaaagggttttcgagtgccgcaatctgtttctcagcgctgctgacaaaatagggagagagataacctcggtcaaactgcatgccttccacgacatccagctcattttccaggccggaaccatcttcaaccgtaatgacgccttccttgccgactttatccattgcttcagcaatgattctgccgatttcggcatcggaattggcagaaatgctgccaacttgagcgatttccttgctggtggaacatggcttggaaagttttttcaattcttcaacagcggcgctaactgccttttcgatcccgcgcttcagatccattggattcattccggctgcgacataacgcataccttccttgacgatggcttgtgctaaaacagttgccgtcgttgtgccatctcctgctgtatccgaggttttgctggcgacttccttgaccatttgtgcgcccatgttttcgaacttgtcttttagttcaatttctttcgcaaccgatacgccatccttggtgatggtgggggcgccgtatgaacgctccagtacaacattgcgtcctttagggcccaacgtcactttaaccgcatctgccagtacatttacgccagtgattacggcgctgcgcgctgcatctccaaatcttacttctttagctgccatatctttactcctgatttcagttggttattcaacgatcaattaaccttcaatcacacccatgatgtcttcttcacgcattacgaggaactcttcgcccttaattttgacagcctgaccggcatatttgccgaagagtaccttgtctccgactttaacttccaatgcgcggattttgccgtcttcgcccgcctttcctttacctacagcgatgatctcaccctgatccggtttttctgcggcggtatcgggaattacgataccggacgcggtcttgcgttcttcttccagccgtttaacaattacacggtcatgcaaagggcgaatattcatagtccttttctcctacaatggttaacaaaaacgaaaaatctggtcatttgaatctgactcaatgagtttcatcaacaatcgctgaatctcgtaacaacctattattagcactcaacgacgtcgagtgctaataatagaggctattataaggaatttcaagacagtgaatgataaaaaagtaactttgcacacccatcagagtgtctggcatccctgcacccagatgaagcatcacgaagtatttcccccgatattaattaccaggggagagggtgtgtggctgtatggtgcagatggtaagcgctatctggatacaatcagttcatggtgggtcaatttatttgggcactgcaatcctcgtatcaatgctgccatcattgaccaactgggcaagctggaacacgcgatgctggctggattgattcatgagccagtagtagagctgtcagaacgattgagtgccatagcgccaggaaacctgagtcattgtttctatgccagcgatggttcgtcagccaatgagattgcgctgaaaatgagttttcactactggcagcaatgtggtttccccgataaaacccaattcgttaatctgcagaatggttatcatggagaaaccctgggggcgttgtcggtcaccgatgtcccgctttttagacaaatttatgcaccgctgttacgtcctgcgcatccggtacctactcctgattggcgttttgctgaaactggaacaaccccggaaactcatgcgctgaaggctgccgctgaattggagagttatctcgcacagcatcatgccagtacagcggctctgattctggagcctcttatccagggagcgggcggaatgggaatgtaccatccggtttatctgcaacgggcacgggaaatctgcgatacctaccgggttcatttaatcgcagatgagattgcggttggatttggtcgaacaggcactctgtttgcatgtgaacaagctgaaatcacaccggatttcatgtgccttgccaaagggttaagtgggggctatttgccgctttcagtggtcatgactaatgacgcagtctatcgtgcattttaccgtgatgaaactaaccaggcttttctccattcgcactcccattccggcaatattcttgcctgtcgggcagcactggcaacgctcgatatcattgagcaggataatgtgatcgaaacaaaccgtaaaaaaactgattttctcaatcaatgtttacagcctgttcgggagcacccggatgtcaagaatttccgcaactgcggtatgatttgggcgtttgaagtggataacccccaaccggatttcacacaccgctttgcgcaaaagggactggaacaacaacttctgattcgtcccatgggcaactcggtctacatcatgccgccgtacattattaatgaagaggaaatggaattgatggcccggggtattctgcacattctcaatagaatataaatacccatgcagattacctttctgggcggtgttggagaagtcaccggatcatgttacctggttgaaacggatgatgtgcgctttctggtggattgcggtatgttccagggcgggcgggatgcaagtcgtaaaaatcataccgcaatcaattttaatccggaatcaattgattttgttttgctaacacatgcccatgtggatcattctgggttattgccgcgcttgagtgtgctcgggttcagagggcctgtctacatgaccccggccacggcggatctgatttcaatcatcctgaaagatagtgctcatattcaggaaaaagaagcggagtggcatacaaaaacggcattgcgtaataaacgttcgctacgttatgaaaatgtcccgctctacactgttacccaggcagaagcatttcttaaacaaatgcgaggtgtcaattatgacgaaacatgtcagccgcatccattagtgcagtgtcgatttcgtgatgccggacacattattggatcagccatcattgaggtctggctgaagtccggttccaggcagagaaaaattgttttctcgggtgatctggggcagccgggccatcctatcgtgcgcgatccgacatttatcaaagaagctgattatctgttggttgaatccacttatggcaaccgttgccatcgcagcatgcaagacacacgcgatgaaatggtggaaatcatttgtcagacactgatccataaacgcggcaatatcatcgtaccggcgtttactgttggccgtactcaggatttgttatttctgctgacggatctgcagcgtcaggggcgcctgggagtgatggatatttacgtggattcacctatggcgttggctgctacggaaatcacactcagacatagagaattatttgataaggaaactatcgacatcatgaactggcacaaccagcataataagaacctgcggattcattttgtgcaggaagtcgaggattcaatcaggctcaatcacatacaatccggcgcaatcgttatttctgccagtggtatgtgcgatgccgggcgcattaaatatcacctgaaatataacttgcctagacctgaatgcagcattttgtttaccggctttcaggctgcaggtaccttggggcgcagattagtggatggtagtaaaaatgttcgtatttttggtgaacaaattcctgtgcacgcatctattcatacggttggcgggctttctgcccatgctgatcaggagaatctgcttgattggttaagaggattcagccagcctccgcgaaaaactttcatcgtgcatggcgaaccgggtagtgccgaagcttttgcctgtgcaatccgggaacaattacagtggccggtgagtattcctcagcgtatggattcagaacgactgggctgattctattttcagctgaaagtagaatcagcaattttcaaacttcttcccgaatcattattgcgttgtatcaaccagaaaacagcattagcagcagtcgattatttggttttgctgtttgtcagaacgaattcagccagacgttgcgcgggttcgccggtaatgttggggaaggctgtcattgtcatgccgcctttttgaactttctcgataatggcttctttggtattcatcttggcgctcaagagcatgaccttgccatctgtttcaggtttgtgacattgagtgcagcttgcgaaaaaaatatcttcgccactagcattttctgccggggtataagtgtcggtcttcgcacatcctgtcaagctgattactgcagaaaccaccaacaatccaatcgttcttttcatttttctctccgtttaacaagggcggacattatagccgctatccatcttaatttaattattgctgcaagctcatgtggtgtgcttgtaaaaatgtttgatgttagtatcttcagcccggttaaacagttggaaaacaaacctctcttgctacggaatagatcatgaaaattgccacctggaatgtcaactcactcaaagttcgattacagcaggtaatcgactggctgaacgtcaatcaaccagatgtattgtgtttgcaggaaaccaagcttcaggatgaattcttcccggtggatgaactggcacaggcgggttaccagtcagtctatgctggtcaaaagacatataacggcgttgctttgctgagtaaagtaacaggagtggatgtttgcgcggccttgcccgattttgatgatccacagaaaaggctgattgcagcaacctatggagatttgcgtattatttgtgtgtatgtgccgaatggggagcgtgttgattcagaaaaatatgcctataaactgaggtggttgtcgatactcaattcttttttgcaacaggagcggacacgttacggcaaggtggcattactaggagatttcaatattgctccggaggatcgtgatgtttatgatcctgaggcctggaagggacaggtgttgtgcagcgaggctgagcggcaagcctttcgcgaattgttagatacaggatttattgacagttttcacctgttcgagcagcctgaaaaaatatatacctggtgggattatcgtatgatggctttccgccggaacagagggttgcgtattgatcatattttgctgagtcatgaaacggcagacagttgcgctacctggcaagtggacaagacacccaggaaactggaacggccgtcagatcatgcaccggtttgggtggagctggcgtaagcagcaagaaatctgaattttatgtgtgaaaagcttgagggcgtgaatgattatcggattacccaaagagacgaaagaggatgaataccgggtcggacttactccgggcagcgtacatacactgactgagcgagggcaccgggtgctggttgaaaccggagcaggtgcgggcagtattatttccgatcaggattaccgggaagccggtgcagaaattgtgatgcgcgccgcagatgcctgggcagctgaattggtcgtcaaggtaaaagagccaactgaagtggaatatcagtatttgcgaaaagatttactgctgtttgcttatctacatctggcttcaaatagagtcctagcagaaaaactgctcgccagcggcgtcagtgcaattgcctatgaaacagtgcagacggcattcggcgcattaccgttattgacacccatgagcgaggtagcggggcgcatggcggtgcagattggcgcaacctatctgttaaaaacccaaggggggcggggggtgctgatgggtggggtgccaggcgttgccccagccaatgtagtcattctgggcgcaggggtagtgggcaccaatgctgcggtagtagcaaccggaatgggggcgatggtgacagtgctggatatcaatcatgatcgtttgaaagcgctggatgaccgtttttccggacggctgcaaactcgatattgtgatgcggtcaatgtgcgtcaggcagtttacgaggcagatcttgtcatcggtgccgtattgatccccggtgggcgctcaccttggctagtaactcgggaaatgttgccgcaaatgcgtgtgggttcagtgattgttgatgtggcagttgatcagggagggtgtgtggaaacaacccaaccgaccacacacagccatcctgtttttgaagtggatggtgtgctgcattactgtgtgacgaacatgccgggcgcagttccgcgtaccagcacctttgcgttgaacaaccagactgccagctatgttgcctgtctggcagatgaagggctgtcagccttgcagagcaatcaggcgttgatgaatggccttaatatctatcgtggacaagtcatgcatccggcagtagctgaggctttcggtttgccgtatacatcaccgctggaaatactggttgcttaaagatggtctgtataactttcatatcgtcctgcggtattgaaaacaggctcaaagtactctttatcgtatgtaaactgcgttttttcacctattttcatcttaccttgacgatcttgttgatgcttttcaacaccttgttaatgccagggcgtaaccgggattacagatatgctgttttgtggtgatccttcaatgactcgatcgctatagctgagatagatcagcacgttacgcctggcatcatagaaacgtaccacttgtaatgttttaaacagcagcgaggtacttttcttgaatacttcgtctccatccgccttaccattttttattttctccggcaatgcaattggccctgtctgacggcaggcgatagaagcctccgatctatcttcagccacacctactgtgccgcttattccccctgtttttgctcggctcagataacacgtagcgcctgctacatccggatcatcaaatgcctctactactattttatcgttggcacccagcaacttgaatcgtgtcgatacactgccgatatcctctgccagtagcggcagcgaatatgaaccgataatagttgccgtccagatcagtattccccgtttgatccagcctggcaggttggtctggctgactcttttctgatggtgtttcatggaaatcctccttttttacgatagcgctatgacaatccggatgacagaattgattatagctttccggagtatctgctacagccgaaactttttgtaccaggatacgtttgtattgatcactttactatccacagttatcctcgcttgaccagtgcaattaatgtaataccgcagaacccggcgctggcatagaacgtgaaggacgctcccatctgatcccaaagcagaccggcgaccacactggcgatgagcatggcaatgccgctgataaggttaaagaatccatatgctgtaccgcgtaaatcaaccggtgcggcattagcaaccattgttgccaacagcccctgcgtcatgcccatgtgaattccccataacacaacacctacgagtactgtcatccaatgagcatcgatagccaataccagatcagcgacaatcagaacaaacagccctagtgccagcaatatcttgtgacttatgcgatcggataacttgccaaaagggtaggccgatgctgcataaaccaagttcatggcaaccattaccagtggaaccagtgcaagtgggatgccaccttgttgagcgcgaagcaccagaaatgcttcactgaaccgtgccagtgtgaatacggcaccgataccgacaacccaccagtacgtggcatgcaaacgcatcagattctctttgcagattggattgatacgtttgttactaacgttttgctttggctcatgaacaccgaagaatagcaacgcgaccgctaacaacccagggataacagcaacccaaaacactgcccggaagtcgtttgcccacagtagcatcaggccggttgccaataacgggccaaggaatgcaccgactgtatccagcgattgtctgaggccaaatgccgcaccgcgcacctctatgggggtgatatccgctaccagcgcgtcacgtggagcaccccggacacctttacccacccgatccaacaatcgagccgcgagtacaacactggtgactggggcaatggcaaacaacggtttggtcagtgctcctagggcataaccgaacagagccagtgctttgcgtttgcctagatagtcgctgagtgcgcccgagaataccttgacaatgagtgccgtggattcggccagcccttcgatcaagccaaccataagagcacttgcacccagagtaccggccaggaataacggcagcagactgtgaattatctcggaggagatgtccatcagcatgctaacgaagcccagtacccagacgccggaaggaatcttgctgagaattgttttttttgtcatgatgacactttgcttttacagtcttatcttagaatccaagctgctccgctccccccagcagcgttgcaagaccaagcagggcgaagatgcctgccgcgattgagtgcacaagtctcataggaatcctgtttgcaaacctgtcaccgatgaataccgctggtatatcagcgatgagcataccaagagtcgtaccaatcacaactaaaaatggagaggcatagtgagcggccaatgtgatagttgcaatctgcgtcttatcccccatttcggccagaaaaaaagtgaccagagtcgctccaaacacgctgaatcgtctggcaatccgtgtttcttcctcctcaatcttatcgggaatcattgtccagatggccatgccaatgaacgataggccgagtacccaacgcaatccctcgggattgacaatttcagtaatccaggcccctagcattcctgccaggctatgattcacgatggtggccaccaggattcccaggatgataggaacaggttttttgaagcgtgcggcgagaatgaatgcgaggagttgggttttgtcgccgatttcagcgagggcaatgatcccggttgatacgaagaacgattccatgagaatttcctggccggaaaagacgattgaccacgatacatctccggcctagtggaagcatcgcagtcaaaggtcttgccaggcgaagggctacctacaccatgacctgtgggtcaagtatgttgatgtaagcctctttgtgataaagagtggctactccccaatgacctgaaaattgtaccagctggctttctgaaagtcatgagatgataggtttcgacaagccgccggtaagtcagaaactggtgatggccagtagggtgcccgtacagctctgtagatgtgcgtttgcacgtgcggcagcagaaacatgcacctgcttgatatatcttcagtgataaaggtaattcgactggcaaaccagctcaagacaacgcttaagttacttgacaatctcgaccaaggcagcattccccaccaaggccatccttggttgcactatttttcaacctgttttcgagaatcggaggctttcataattcatgcctccctctatttttttgatgtttcgattctgttgggcagaaaaatttttcaatgttgatgcagacatagtcgatttttatcgtgatctcaagcaaccgggcggctggtagcaaatctacagaccctgggaagcaagcgaggttaagctgccctttcatcgaacgtttgagagccacgtcagagctaatgtagattatgcttgatttctatcgggttttgcttgcaaccacgaaagaaatacggaaaattgcactggtaataacaatgaagtttctttgtggaaaagagggggattccggcttatgagtggtgaaacgtttgatcttgacaagcagcagttgatgcaacgtgaattcgatcagatggagaataagctgccgggggcaatttattctctgcgccagaaggtagctttgacttgtcgtattttatttgataatggccatgattccgggctggccggacaaattaccgcgcgcggggaggtgtcgggcacgtttttgacgcagcggctgggattcggttttgatgagatcagtgccgggaatttgttgctggttgatgaggatttgctggtgctggaaggggagggtatgcctaatcccgcgaatcgttttcattcctgggtatatcgtgcacgccccgatgtacattgcattgtccactcccatgcattgcatacagcggcactgagtatgctggaaacaccactcatcatttcgcacatggataactgtgtgctgtatggtgatgtggcttttttaccgaaatggccgggtgttccggtgggtaacgaagaaggtgggttgattgccgaggcattgggtagtaaacgcgcattgatgcttgctcatcacggactgctggtggcttgcagtaatgttgaggaagcctgtttgatcgcgctggcatttgagcgggctgcacgcatgcagttgctggcaagtgcggttggcgaaattcagccgatcgatccgacgctgggacgagaggcgcatgactggattttacatgcgcaacgcagtgcgagcgcctttgcctattacgcccgacgttctctgaaacattgttctgattgtctgtgagagtgatgattcttacgtcgctcactcagcggtttgccatctggtttgcgctggtggcgttattgccgattgcgttggtcggctatggtttgctgcacatctttgagggagaaatcagcaagtcggccattcagcaggtttcgtcgattgctgacaaaaaagttgaacagattgattcttacttgcatgaacggatactggacgcagatcttatccagacaagtgacacgacgcgtcaggcaatagacgaattttcacaggtattcagccggcatggtgcagattccgatgtctatcgatctctggatgctcgctaccgggcgcattacgagcgctaccttgcaggcacaggctactatgatctgttcctgatatcttctgatggctggattgttttttctgttggccatgaatccgattttgccaccaatttattaacaggtccttatcgagatactgggttgggtgaggtatttcaacaaataaaagagacacatcaaagcgatctatctagttttgaatactatccgccatcacacggtgcaattgcggcgtttgtcgccgtgcccatattgattgatggagattttcacggagtgctggcgctgcagatatacagcgagcatgtattcaatgtgctgaccaataacgtcggactgggtgaaagtggcgaaacaattgttactcatagagaaaacaaagacactgcccgaatcgtggcgcctctgcgggaagatcctaatgctgctctgaaacgcaccatatctctgagtgagccgttgcttgcattggcgatcagaaacagtctgaatggcgaacatggaggaggagtagtcactgattttaatggccagccggtgattgccgcctggcggtatttatcacgtatgggctgggggatagtcgtacagattgataccgaggaagcatttgcttcggtgacgaaaatgcgcatcatggggttggtggtgcttggcctgactttcttgatggcgattctgggggcgctattgttcaaccggcgggttgtgatcccgctgaaaaatctcaatgaatgcgctcaagcaattactgccgggaatcttcagcatcatattcccagtgaagggtgggatgagatcgggcaactagccggtgctttcgatatgatgactgagcgcttggcgatcagctaccggcatctggaggcgcgtgtggctgagcgtactgcccaacttgagcgactcaacgccgagctggcaatcaaggaagaggaaacacgttcagtcgttgaacacatggtggattgtgtggtgtcaaccgatgatcgaggcgtgatgctctcagtgaatcccgtcatggaaaaactgtttggctataccgtggaagaggcgatcgggcagaacgtttccattctggtgccagagccagatagaagcatgcatgaatactatatgcagcggtattgtgaaactggatatggtcagcaatatgtggggcgtccacaattgccaggcgggcataatgtcgggctggggcgtgaagtcgagggggtacgcaaggatggaacggttattcctttgtatcttgcagttagtgagtatttcgtaggagatgaacggcatttcactggaattatgcgtgatatgcgcgagcatgtgaaaatccgacaggatctggaacaggcgcggcacgaggccgagctggccaatcaggcaaaatctgcttttcttgccgccatgagccatgaaattcgcacgccgatgaatggtgtgattggcatgatcgatgtactggatcagaccagcttgagtacgtatcagagagaaatgactgatctcattcgggaatctgccttcgcgttgcttgagatcattgaggatattctcgatttttccaagattgaggcgggcaggctggagatcgagcaaacgccgatatctttggagaaagtggtggagcgtgcatgtgggacgctgacacatatggctgccagcaaggaagttgagttgaccttgttcgtagatccggctttaccggaaggtgtactgggagatgcgttgcgtttgcggcagatattaatcaacctgattaacaatgccatcaaattttccagtggcatgtcgcggtcagggcgtgttgcggtcagggccagtccggcggaagaggtggatggcgatgttgtaacggttatgttccaggttatcgataatggtatcggtatggatgatgctgctcgggagcatttgtttacacctttttcccagggagatgcttccaccacccgccgctttggtggaaccggcttgggtttgatcatctgccgtcggctggttgagttgatgaaaggtgagatctctgtagaaagtaaacctgatgtaggctctgtgtttaccgtgcgtatcccgtttggaataactcagagagaagtcattcaagaggaggaattggaaacagatctcacggggttgtcatgtgtggttatgggaagtaaagacggattgagccttgatcttgcaacctatctgaaatatgcaggtgttgtagttgagtgtgtaccgggattgcttgctgcacgtgaacgaattaaacagcttccgacgggtcaatggttattagtggtagatatgagggatgaggagttgcccattgaagagttgcgtgcggtatttcgcgatcggcccaattcgagtgtaaatgacaagcttcagtttgtaattattagacgtggccgccgccatcgcggccgtatggaagaggagggtgtagtgacgctcgatggaaatgtactttatcgtcgggtatttctccgtgcggtagcggttgcagccggccgggcaaagctagaggaagatcaggatatttctgtagtagttgtcgataaagttgttccattatcccgggaagaggcgctgcagcgggataatctgattctggttgctgaagacaatgagattaaccagaaagttattcgccagcagcttactttgctggggtttgctgcagacattgtcgtcaatgggcgtgaggcactgcagaaatggaaaagtggagagtatgcgctgatactgactgatctgcatatgccggaaatggatgggtatcagttaacgcaatcgattcgcgctgaaaaaacgggccgttatcagattccaatcatcgctttgacagcgaatgcactgaagggtgaagcggaaaggtgtcgtgcactaggaatggatgattatctgagtaagccggtgcaactagaacagcttaaatcggtactggagaaatggttacaagggtcgaaacgggtggagcaacaggaggaaaatattcatcggcctttagttgccgctgaaaaaatcacagtggatactaatatacttaaatcgttggtcggaaatgatcaggtcattatcaaagaatttttgcaagattttctccgtgacgctcgaaagattgctgaacagttgcaaagtaccgtagcagatggcaaggcagatgaggcgaaatttgccgtacataagcttaaatcttcagcgcgttcgattggtgcgctggctctgggtgagtggtgtgcgcaaatggaggtggctgcaaaagaaggtgatgtggaaaaactggctaggctattgcctggctttaaacaagagctggccgaagtggggagttatattaagaaggtattggcacaacccgatgtgtgagcgcaaaaggatgaaatatgaaaattcatgaataccaggctaaagcaattcttagccgttatgcgattagtgtgccggccggtattgcttgttttagcgtggaggaagcgattctggctgctgaaaagctggggggtgataaatgggtggtcaaggcacaaatttatgctggagggcgtggcaaggcagggggggtaaagctggcaaagtccattgtggaggtccggcagttttctgaggcgatgttgtttgctccgctggtcacgcatcaaaccggcccacagggacagattgttcgccggctctatattgaacaggggatcgatatcagtcatgagtattacgtggcactggttgttgatcgtgcttcgcagtgtgtcagtttaattgcgagtgatgcgggtggcatggatattgagggggtggcagccagtacaccagaaaaaatacataaaactcagattgatccgcttgagggattgaatcttcaagatgcagagagagttgtgcgccagatcaatttgcctgaatcatgccgatcagcggcggtgtctatgctgggggcgctatatcaggcattcgatgagaacgatatttcattacttgaaatcaatccgttgattgttacaccagataaccgtctgattgctttggacgccaaaatgaatttcgatgataacgccttgtttcgtcatccggaaatcgttgccctgcgggatctggatgaagatgatccgcttgaggttgaagcagcgcggcatgggctttcctatattccgcttgatggtgatattggctgtctagtcaacggtgctggtttggctatggcaaccatggacattattaaactctatggtggcaatccagccaattttctggatgtgggaggcggagcgacggtggaaaaagtaactgaggcattcaagctgatgctgagaaatcccgatttgcaggcaatactggtcaatatttttggtgggattatgcgctgcgatgtaattgctgatggggtggtgtcagcggtgcgcgaggtgaagctagctgttccattgattgttcgattggagggaaccaatgtggagttggggaaaaagattctggcagattcgggattaacgattattgctggcagcaacatggctgatgctgccagaaaggcggtggatgcagcagctcggcatcgatctgaagctgcaaccagaggagcataacagatggctattctgattgatcgtcatacgcgtgtcatgacacagggtattacaggtaaaaccgggcagtttcatactcgccagtgccgagaatatgcttttggcagggattgttttgtggctggagtcaatcctaaaaaggcaggagaggattttgaaggtattccggtgtttgcaacagtggaagcagcaaggcagacgacgggtgcgactgtatcggtgatttatgtgccgcctgcttatgcagctgcagcaattgatgaggcggtggaggccgaactggatctggtcatctgcattactgaaggtattcctgttcgagatatgttgcggacacgcgcccgtatgcgtggaaaaaagacacggttgatcggtcctaattgtccgggagttatcacgccaggtgagttgaaaattggcattatgccaggcgccattcatcaacaaggaaggattggggtggtttcaagatcaggtacgttaacttatgaggcagtggcgcagctgagtgagctgggattagggcaatctacttgcatcggaattggtggtgatccgatcaatggtcttaaacatattgatatcctaaagttgttcaatgaggatgacggaactgatgcggtgttgatggtgggtgaaattggtggtactgatgaggaagaatctgctcattgggttaaagatcatatgaagaagccggtggtggggtttgttgccggaatgacagcgcctcccggcaaacggatggggcatgcaggtgcaattattgctggaggcaaaggaacagcacaggaaaaaattgaagtaatggaggcatgtggtattcatgttgcccgcaatccagctgaaatgggcaagctattgaaaacagtgatatagcaaaaaataaaatataacgaataaaagggagtgaaaaatgctgcgagtaaatgttgttgcgatagtaattgctttattggcaggctgtacgatggctaagcgcccgatgcctggccccgttctcccggctccggatcctgttgtgcagcaaagaccgtccggtccgttgccgcttagtacgcgcccaacctacaatcttgctggctaccccaaagcagctcaggaaggatatgtggatggatgtgaaaccgcaaaacaatcagcttatgggtttaaggataaaaaacgctacgcggccgatatgcagtaccggatgggttgggatgacgggttatctatttgtcgtggtacacgttgatcaaaataaactgatccgctgactgttatgaaaagtttgctgaaaataacgtggttattatggggtgcgttgacttttccggcttatgccgttgatttgccagataccgtcaggcaggcactaaaaaaaacaggcattcccgaagcagctgtcgggatttatgtcagggaagtcggtgctgagcggccgctagtgtcagtcaatgctgatgtgccaatgaatcctgcttcagtcatgaaggttgtaacaacgtatgccggactggaaatgcttgggccatcatacacgtggcgtactaaggtgtatgcaaatggcaatctggaaaatggcagattgcaaggtgacttgatcatcaagggttatggcgatcccagtcttaatctggaaaatttctggctgttgctccgtcagcttcgccagtctgggctaaaagatatcagcggggatctggtactggattacagctactatagttttccgacggaaaatcctggtgcttttgatggtaaacgctataaaacttacaatgtggccccggaagcgctgctggtgaattaccacacatcaacactacatctatttcccgaatcgcagcatggtggagtgcgggttacggccgatccggaaagccaattgctgaatgtgcaaaaccacctcaaactgactcagaaaaaatgtagcaccagtggagttcgcgtgaatattcgtgacgatgttctgcgaccaggccatgtgacagtaatgcttgaaggtgattactcggctcattgtggccaaaccgcttactacctgagtttgcacgagagctcgacgtacattcatcagctgtttagtgggctatggaagcaactggatggtacatttaatggcagcgtacggcatggagtaacatcaaaaacgctgaatccgattagtgtctaccattctccgccactggccgaagtcattcggggtattaacaaattcagtaataacgtagcagcaaaacagttgtttttatcactgggtgaaacagaatctaacggcggcgaatttgtttcacccaatcttgcgcgatctggaatacgacagtggctattttcaaaaaatatggattttccagaattggtgctggaaaatggatcggggttgtcacgcatagaacgaatcagtgcgcggcatttaaatgacttgctgaatgcggcttatttttcgcccacgatgcctgaattcatggcctccctggcagtggtcggggtggatggaacagctcgaaagcgcttaaagaaatccgttgttgctcaaaaggcgcatattaaaacaggcacattgaaagatgtatctgcgatagcagggtatgtgctgaaccataaaaaaaagcgttatgtaatagtattcatcgtgaatcatccgaagtcaggcggtgcaagagtggctatggatgcgctattagaatggttgtatataaaaacataaaacatgaggaaagtgtagatagcgggctaggtgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacagctagggcctgtttccgtttgatctcaagcttttgatttaaagaagcaagctcaatcgttgtagctcccacacaatagtaatacgagtttgctcttataaagcaagaagatagcctgaaacgccaacagaccctaggtataaaattaaaaatgttttttaagcaaaaatagatgatccgcaaggtaccttgtcgcagaatcacgaaggtgtttgttctaaaatactaaataaaatcaaatgattacatttatcagcaaaacaaaatgaaaaatgatggctaacatcgcttgacttgggttatttaatctatataatgcgcatctctatagcgatgacgcaagtcaaagcaaagatctttaaaaaaacaaataaccaataagtgtggacgcttggcaatacaaaagttgtaaggcccaataaaattgggctggtaaatgattaagcgtctgcgaagatagcctgtcaaataggcttgagtcagatgaaaagaaataaaactgaagagtttgatcctggctcagattgaacgctggcggcatgctttacacatgcaagtcgaacggcagcgggggcttcggcctgccggcgagtggcgaacgggtgagtaatgcatcggaacgtgtccttaagtggggaataacgcatcgaaagatgtgctaataccgcatatctctcaggaggaaagcaggggatcgaaagaccttgcgctaaaggagcggctgatgtctgattagctagttggtggggtaaaggcttaccaaggcaacgatcagtagctggtctgagaggacgaccagccacactgggactgagacacggcccagactcctacgggaggcagcagtggggaattttggacaatgggcgaaagcctgatccagccatgccgcgtgagtgaagaaggccttcgggttgtaaagctcttttagtcggaaagaaagagtcatagtaaatagctatggtttatgacggtaccgacagaaaaagcaccggctaactacgtgccagcagccgcggtaatacgtagggtgcgagcgttaatcggaattactgggcgtaaagggtgcgcaggcggccttgtaagtcagatgtgaaagccccgggcttaacctgggaattgcgtttgaaactacaaagctagagtgcagcagaggggagtggaattccatgtgtagcagtgaaatgcgtagagatgtggaagaacaccgatggcgaaggcagctccctgggttgacactgacgctcatgcacgaaagcgtggggagcaaacaggattagataccctggtagtccacgccctaaactatgtcaactagttgtcggatctaattaaggatttggtaacgtagctaacgcgtgaagttgaccgcctggggagtacgatcgcaagattaaaactcaaaggaattgacggggacccgcacaagcggtggattatgtggattaattcgatgcaacgcgaaaaaccttacctacccttgacatgcttggaatctaatggagacataagagtgcccgaaagggagccaagacacaggtgctgcatggctgtcgtcagctcgtgtcgtgagatgttgggttaagtcccgcaacgagcgcaacccttgtcgctaattgctatcattttaatgagcactttagcgagactgccggtgacaaaccggaggaaggtggggatgacgtcaagtcctcatggcccttatgggtagggcttcacacgtaatacaatggcgcgtacagagggttgccaatccgcgaggaggagccaatctcagaaagcgcgtcgtagtccggatcggagtctgcaactcgactccgtgaagtcggaatcgctagtaatcgcggatcagcatgccgcggtgaatacgttcccgggtcttgtacacaccgcccgtcacaccatgggagtgattttcaccagaagcaggtagtttaaccgcaaggagggcgcttgccacggtgggggtcatgactggggtgaagtcgtaacaaggtagccgtaggggaacctgcggctggatcacctcctttcataaattattgtcaagtgttcacacttattggttatttgaataaataaatataaatttgggtttgaggtgtggggttaaacttggactcgtaagggtctgtagctcagttggttagagcacacgcttgataagcgtggggtcggtggttcaagtccacccagacccaccatagggggtgtagctcagctgggagagcacctgctttgcaagcagggggtcatcggttcgatcccgttcacctccaccattaagaatggaaatttaatttatttattgctctttaaaaataaaaattgggtaagattgtgcttaaagcataattaaagtaactataagagtgatgacaaagcaccaatcttttttgtgagggtggtggtaagttttcaagattataggatcaagcgaacaagtgcatgtggtggatgccttggcgattacaggcgatgaaggacgtgaaagcctgcgaaaagcttcggggagctggcaataagctttgatccggagatgtccgaatggggaaacccacccgtaagggtaatcattcctgaatatatagggagttgatggctaacctggtgaactgaaacatctaagtagccagaggaaaagaaatcaaaagagattcccagagtagcggcgagcgaaatgggagcagccggtaatatttagtatttgaattaatcgaattatatggaaagttaaaccgtagtgggtgatagtcccgtagataaaaattcaagtatggaactaagattacataaagtagggcggggcacgtgaaaccctgtctgaatatagggggaccatcctctaaggctaaatactcgtaatcgaccgatagtgaaccagtaccgtgagggaaaggcgaaaagaaccccgggaggggagtgaaatagatcctgaaaccgcatgcatacaaacagtgggagcctcgcaaggggtgaccgcgtaccttttgtataatgggtcagcgacttacattcagtagcaagcttaaccgataggggaggcgtagtgaaaacgagtcttaatagggcgataagttgctgggtgtagacccgaaaccagatgatctacccatggccaggatgaagcgagggtaatgcttcgtggaggtccgaacccactaatgttgaaaaattaggggatgagctgtgggtaggggtgaaaggctaaacaaatctggaaatagctggttctctccgaaaactatttaggtagtgcctcatatatcatttttgggggtagagcactgttatggctagggggtcgtcaagacttaccaaaccattgcaaactccgaataccaaaaaatgtaagtatgggagacagacatcgggtgctaacgttcggtgtcgagagggaaacaacccagaccttcagctaaggtcccaaagatacagttaagtggtaaacgaagtgggaaggcatagacagtcaggaagttggcttagaagcagccatcctttaaagaaagcgtaatagctcactgatcgagtcgtcctgcgcggaagatgtaacggggctaaactgtacaccgaagctaaggacttgcaattagttgcaagtggtaggagagcgttccgtaggcctgtgaaggtgatttgtgaagattgctggaggtatcggaagtgcgaatgctgacatgagtagcgataaaggaagtgaaaagcttcctcgccgaaaacccaaggtttcctgtgcaacgttcatcggcgcagggttagtcggctcctaaggtgaggcagagatgcgtagctgatgggaaactggttaatattccagtacctttatttaatgcgatgcggggacgaagaaggctagcttagccgggtgttggatgtcccggttgaagcaggtagacatgctatttaggaaaatccggatagctaagttgagatgtgataacgaaacttccttagggaagccaagtaagtaatgccatgcttccaggaaaagccgctaagcttcagttaaataaagaccgtaccgtaaaccgacacaggtgggaaggatgagaattctaaggcgcttgagagaactcaggagaaggaactcggcaaattgacaccgtaacttcgggagaaggtgtgcctttagtatgtaaagtacttcgcgtatggagcagaaaaaggttgcaataaaatggtggctgcgactgtttaataaaaacacagcactctgcaaacacgaaagtggacgtatagagtgtgacgcctgcccggtgccggaaggttaagtgatggggtgcaagctcttgatcgaagccccggtaaacggcggccgtaactataacggtcctaaggtagcgaaattccttgtcgggtaagttccgacctgcacgaatggcgtaacgatggccacactgtctcctcctgagactcagcgaagttgaagtggttgtgaagatgcaatctacccgcggctagacggaaagaccccgtgcacctttactgtagctttacattggattttgattattcttgtgtaggataggtgggaggctgtgatatatgctcgctagagtatatggagccaaccttgaaataccaccctggaatggtcggaattctaactcaggtccataatctggatcgaggaccgtgtatggtaggcagtttgactggggcggtctcctcccaaagagtaacggaggagtgcgaaggtacgctaggtacggtcggaaatcgtgctgatagtgcaatggcataagcgtgcttaactgcgagactgacaagtcgagcagatgcgaaagcaggtcatagtgatccggtggttctgtatggaagggccatcgctcaacggataaaaggtacgccggggataacaggctgattcctcccaagagttcatatcgacgggggagtttggcacctcgatgtcggctcatcacatcctggggctgtagtcggtcccaagggtatggctgttcgccatttaaagtggtacgtgagctgggtttaaaacgtcgtgagacagtttggtccctatctgccgtgggcgttggaaatttgagtggggctgctcctagtacgagaggaccggagtggacgcacctctggtgtaccggttatgacgccagtcgtatcgccgggtagctaagtgcgggagagataaccgctgaaagcatctaagcgggaaacttgccataagattagatttcccgggagtatagctcccctgaaggttcgttggagactacaacgttgataggtcgaatgtggaagcgcagtaatgcgttgagctaatcgatactaattgaccgtgaggcttgatcctataatcttgaaaattgagttgtattttatatatagttgctattattacccaattctaccgtttatgcttggcggccatagcgctttggacccaccttttcccatcccgaacagagaagtgaaacgaagcagcgccgatgatagtatgttttcacatgtgaaagtaggtcaccgccaagcttcctatttatagagtattttgaaagattatttttttaaaatactctattgttttgttgaggcaaaactatttttaattttagtttgcaatatttttacatattttataaaaataaacctgtagatcttgcatggctaatatttaaatatttttgtttaatggattaagaaatatcctcgtagtattctcatgcctatttatttcatttgttgcagctatatttttacatggctgtgatgaatgatttctctctcttctcacctggttattttcatagtatcgttttaattttatttccaatcatttaggttgatttttgataatttcatgggttgaattacctagggttacatggatgtaattctaattatcaatgttcttatgtgacttctgtttctattgaaaacaggaataagttggccaagatgtttgggtgtgatcttgatgtacagatcaagtggcttattctctatgctcattatcccgtatgatgattacatcattttccttaactgtctgcctggtggattcttttttatttgtaaaacttcgtaaactatagagaagctttattttctagtttaatcttctatttaaataaatgaacagtagtgataatctaggttgtggtgttatcttaaaatttgttctgcattcataatagaagttttggccgcaatatctgagcgatgtgttgcatattaaaaacgcgaatataagggcgatatggtggccagacagtatttaaaactatgaaaatagtggttgcaggcgttgattatattgggttatctaatttagtattgctggcacaacatgctgaaggtttgtcagcgtcactatctatacgcctacaagcatcaatcacttcaatgcgagctttgttaagataggttacctcgaaaatcctatttttgaaaatctattgatcgcaaataaaatcaatgtgttacgtacaaatattttcagaatttataggtttttcgaggtactcagtaatcgttcgtgatgtcataatcatcaatccgtgagcagtgatggcgatcaaatacaccacccagctggttatcttgccaaaattcgtaaggtattgggttacagataacctgttttttctcataaatttttagtgagggtagagcgccatcaagcaggaattccaccgctatttatcgacagtactgagatcgaggcaatcaagccgttgctggagagtgcgcgctggaagacccatcccagacgcatagacctgtccgaaatattctgtgtggtgtgctctctgtatttattcaggagtggctgccaatggcgcatgctgctcgaaaagtttcccaaatagcgcaagtacactcgtacttttccatctggagtgaaacgcgaaggtggcagctctgctagagtaggctttaaaaatcaggttagtgtggtccgagagaagctgggtccaatgccagcaacacgttcttggttgtgggcgtacaaagtgccaaaaacactgacacagcacggttcaagggttatgatgcgggcaacaaagtttcggggatcaaacgccacattgcagtagatactaaggattatcccatgcaatcgcagtcactatggctgaagaggccgtaagggaactttgctggcggctgcgtcgggctttgcagcagggacaaagtttgctgtacgacagagattatgtgggcaaacctttcactcaaggaaagtgcgaagtcctggaaaagtttgtgtcggtacaaatcgccaaacatagcgagctgccatacctttaagatcatatccaagtgctggattatgggacgtagtttcgcgtggctagaaaagaattggcggttgtggaaaaactgtgagcggttactcaataccagcatatcgtaggacttaaacaactaagaccgtaggcgtctatcagctgattatgaagacaggatcggataatttattcaacgaatcgtgaagtgcatcagggctaaaggaattgctgagtttttcaacttgcggatcccttgtgtcaggcaagttgccgctatcaagatttatacacgtgatctattcgggagcaattaattgaagatacttattactggttcagccggttttattggatctgcattggcgctgcggctgcttgaacgtggtgacaccgtcattggtatcgataatcacaatgattattacgatccacagattaaggaagatcgtcttgcccggtttgcggatcatcctgcttacacccatttgcgtcttgacttggcagatcgcgaagggatcaattcctgttttgaaatgcataaaccacaacgggtggtgaatctggctgctcaggccggggtgcgctattccattgagaatccattggcttatattgacagcaatatcgttggttttgcccatattcttgaaggttgtcgtcataacagtgtcgaacatttggtgtatgccagcagctctagcgtgtacggcgccaatacgcagatgccgttttcggtgcatcacaacgttgatcatccgctcagcctttatgcagccagcaaaaaatctaatgagctaatggcgcatacttacagccatttatataacttgtcgactgctggcctgcgtttttttactgtatatggtccttgggggcggccggatatggcgctgtttaaattcactaaggctattcttgccggagaaaagattccggtatttaactatggaaaacatcgccgagattttacttatgtagatgacattgtggagggcgtaatccgtgtgctggatcaacccactcggcctgacccggcctggagcggggaaaatccggatgcaggcaccagtatggcaccctggcgtgtttacaacattggcaataacagcccggtagagctgatggattatattgctgcactggaaaaagcgcttggtaaaaaggccgcaatggaaatgctacccctgcagccaggtgacgtaccggatacttatgccgatgtttccgatctcgtcgaacaattcgattacaggcccgccacgtcggtcgaacagggaatagccagctttgtgacgtggtatcgcaattacttcaatttgtaggagacaacatgcaactccaggatatcaaacttgccattatcgggcttggatatgtcggccttccattggctgctgagtttggccgcaagcgtcctgtgaccgggttcgatattaaccagcagcgtattgatgagcttaaaaatggcaatgactttacgctggaagtcacgcaggaagaacttgcagcggcaaagcatttgacttttaccaccaatatagacgatttacgcacctgcaattgctacattattaccgttcccacaccaattgatgatcacaagcgccctgatcttacgccacttatcaaagccagcgagactgtcggtaaggtattgagaaaaggagatattgttatttatgaatctaccgtctaccctggttgtaccgaagaagattgtgtgcctgtgctggagcgtgtttctggcctgaaattcaaccgggatttctactgtggctacagtccagagcgcatcaacccaggtgacaaggaacatcgtgtcacgactatcaaaaaggttacctcgggctccactccggaaatcgctgatctggtagatagcttatacaacgaaattattactgtaggcacacacaaagcggaaagtatcaaggtggctgaagctgccaaggtgatcgaaaacacccagcgtgatctgaatattgctcttatcaacgagctggcgttgattttcaacaaaatgaatattgatactgaagccgtactcaaagcagcgggcagtaagtggaattttctgccgtttcgtcccggtctggtgggtggacattgtattggggtggatccgtattacctgacacataaagcgcaggcaattggctatcatccggaaattattcttgctggacggcgactaaatgacagcatgggagcctatgttgttgctcagctggttaaagccatgaccaaaaaacgtcttcaggtagatggcgccaaggtattggtcatgggacttaccttcaaggaaaactgtccggatctgcgtaatacccgagtggtggatatcgtgaccgaactcaaggattacaactgcgtagtggatgtatacgatccatggttgtcttctgaagaggcacaacacgaatacagtatcaagcttattgaagcacccgaatccggtaattatgatgctattatcctggctgtggcacatcggcagttcaaggatatgggagcttcctctatccgtgcactggggaaacccaatgctgttctatatgatctgaagtatgtgcttaatccacaggaatcagatctgaggctgtaaataagattacttgcgcaggccctggttccgattgatccgggcagaaaacaggctggcagatgcaatcatgagtcctcccgcccagtctctacttgtcagatgttcgtcggtcagaaaacaggcggctacagctgcgaccaccagctcaaacagcataattacaatagcctgattggccggtacatgggtcattccatactgcagcaatatactgagggaaaaaaccagcccgcctgcaccgagcaatatcagccatacgttggcaggcagatgggtgatatcagaagtatttcccatgagcagggtggcgacaaacccggtcagggcagcaccagagagtaccgctatcagctttaagtggatattgtgctgctgatctttgcgaatcaggacattggtcagtgcaaaagcaaatccacccgatagccccatccagtcaccgtaggaagttggcagaggcaacccgccttccggctgccagagcagaagtaaagcacccgtcagagataacagaatgatcagataaccttgtctgcttagccgttcttgcagcagaatacgggaaaataaaatggtccacagcggtgccagatagaacaggagcagaacccgcataacttcgccgtgaataatcccgagcacataggcgatactggtccagcctgcgcccagattgatccagagcagaatccaggctgtcgtattcagtacttcagagatccggatttgtttcctgaataaagccaggctgatcaacaacgcaatggagtaagtcagcgcagtggataattcgccccgcataccggcctgttccagtagacggtaaggataccaggctactccccaagcggcagcacccagtaatagactggctatcggcaataattttttttgtttggtcaacgttgccagtgccctttataattagtgcttaacatttttactgcctccctaacctgctccacaagcaccacatgtggataatcctgaaaagtatgaaccctttactggaaagccttcagttatacccgtttcaaaaacttaccagactatttgagaatatcgtgctgagtgatgcctctctgactcccattggtttgcatattggagaaccaaggcacaatacgcccgagtttatcaggcaagagctagtgaataatcttgaagggctggcacattatcccacagtacttggaaccagccagttgcggatcagcattgcaaactggctaacacagcgctatcgcttggctgccatcaatccagataccgaagttatcccggtcaatggtagtcgggaagcattattttcatttgcccaggcggttattgatgccgatgcgcgcgaggttatgcaacctgtagtggtttgccaaaatcctttttatcaaatctacgaaggtgctgcattgctggctggtgccgaaccctattttctgaatcagcttccagaaaatggtttttcagtggatgccgctcagttgcctgattcggtgtggaaacgtactcagctgacttatatctgttcacccaataatccgactggtaaggtgctgacgctggatgaatggcaacttctgtttgatttgtctgatcgttatggatttgtaattgcagcggatgaatgctattcagaaatctatttcaatgaggatcaccctcctctgggggcgttggaggcggcagagaagttaggccgtaatggttttccccgtctggttgtgttcagcagtctttccaagcgctccaatgtgccgggcatgcgttctggttttgtggcaggggatgctgctattctcaaaaagtttttgctttaccggacttatcatggcggtgccatgaatccggctgtgcaggcagccagcactgttgcatggggtgatgagcagcacgtggttgaaaaccggcgactgtatcgtgaaaaatttgccggtgccatgcgtatactgggtgataccttgcctgttagcatgccggatgccgggttttatttatggttaaaggtgcctgtcagtggtatcgaattttccgggcgtttatatcgggaaggaagtgttactgtgctgcctggcagttatctggcacgagaggcacacggccttaaccctggtgagcattttgtgcggattgcgctggttgcgccggtggcagagtgcatggaggcaatggagcgaatcaaggatatcgctagaaagttctgatctgattattttttagttaggagtcacatggagcaattacaagctgtcatcgaagatgcttttgaaaggcgtgctgaaattacccctcgtaatgttgaggccaatcttaaggaatcggtcgcccaggttatcaatatgctggataccggcaagttgcgagttgccgagaaaattaacgacgaatgggtaacccgtcagtgggttaaaaaggctgttttgttgtcttttcgcatggaagataattattttatcaagggtggattctctaattattttgacaagattccgtctaaatttgctgattacagctcacgtgattttcgtgatggcggatttcgtgtggttccaccagctgctgttcgtaaaggagctttcatcgcgaataacgtggtgctgatgccgtcctatgtgaatattggcgcgtatgttgacgaaggcaccatggtggatacctgggcaactgtaggttcctgtgcgcaagttggcaaaaatgttcatctgtccggtggcgttggtattggtggtgtactggagccagtgcaggccagccccaccattattgaggataactgctttattggggcacgttctgaaattgttgaaggtgtcattgttggtgaaaattcagtcatctcaatgggtgtatacattggccaaagcaccaggatttacaatcgtgaaaccggagaggttacctatggccggattccttcaggatcagtggtggtttccgggagcctaccggctgataatggccgctacagtctgtattgtgcggtgattgtgaaacaggtcgatgcaaagactcgctccaaaaccgggattaatgaattattgcgcggtatctgattattcagatcggtgaatgctatctgttaataatgatctgtggtataaaaataatcgtgtgagttctgcacaaaatgtggcggggtttggtctgtaacatcagttggctttattccctgcttattcgtcgtattattgttacaaaagattcatacatcttgaccaaccaatacaagaggagaagctattatgaaaagaactctgataagtatgatcacaatctttgctgccgcattgttcttgaacatgcaggtgtatgcagattcgcatactgctcatttggatgaagcgttgaagcatgcggaagaggctgtagtacatggtaaagaaggtcatgttaacgaattgcttgagcatgaaaaggaaagcctgatgcatgccaaagctgccagagcggccggtgaaggcaatacacataccgaccacggtattaaacatttggaagacgctatcaagcatgctgaagaggggcatgttgatgttgccaccaaacatgctcaggaagcggtcgatcacctgcgtgcttccgaactttctgaacatgaacactctgggcattaaaatcatatcagaaaattgaaaaactgagtgctccctctgatgtattttagagggagtaatcagtttacataagaggagaagctgttatgaaaagaactctgataagtatgatcacagtctttgctgctgcattgttcttgagcatgcaggtgtatgcagattcgcataccgttcatttggataaagcattgatgcatgcggatgaggccgtggtatatggtaaagaaggtcataccaatgaattgcttgagcatgcaaaagaaagtttggcccacgccaaggctgctggtgagagtggtgaggccaatgcacatgttcttcatggaattaaatatctagaagatgcgatcaaacatgctgaggaaggccatgttaatgttgccaccaagcgcgtgcgaaaggccatcgaacatttgcgtacttcagaacgttaagttagatttatttacaaggaggggtgtgtcgctgataaattttgccagaggcatgtcaagcaatgaaaaaagcggattactccgcttttttcattatggtatatctgatcgggaaaaccacaacaataagattgctcgaagtgaataaatcagaagtgctcgcgagatattggcaggaaatttaatatgaatccgtttgcatttaccatcctgagaatgctgagtgacggaaactatcattccggcacagcactgggccaggcactgaatgtttcccgcgccagcatatccaatgcgttgagtgatctggattgctacgggttggtaatacacaggattcgtggtcgagggtatcgctggttgaatccaacgcaatggctggacagtaaacaaatacgccactatcttgccgaatatgcggattccatacaaatagaaatcgtagaggctgttgaatctactaattcactgctgctgcagcgcgtgattgatcagggcgcttctgttggcagattaaagcaagttctggttacggagttacagacgcaagggcgcgggcgacgcggacgtacatgggtatcaggactgggagacagcctggttttctctgttttatggccatcgcaatgtgcagtaaatactctttccgggttgagtttggcagtgggtgtggcaattgttcgtgcactgacattatttggaattcgtaacatcgcactgaaatggccgaatgatgtgttatctggttacaacaagttagcaggagtgctgattgagctgcatggggatatgttgagtccaggtaccgtgattattggtatcgggctgaatcttagactttctaacgttacaaaatctcagattgatcaaaaggtaaccgatgttgccagtgttgcaggacaaatgccggacagaaatcggttgttggctattttgttgaaagaactggccaagatgcttgatacatttgaacagcatggtttcgagccttttgtggaggaatgggagcgtcatcatacttatcaggataaagctgtgcagattagttttccggatggtgctgtcaaaaatggaatcgcaatcggtattgcgcccgatggtgccttgcagatcaataccccggcaggtatcgtgcaagtgagaagtggagaggtttctctgcgtgggctgatctgatacggatatcagagattccctaattgaatgaacgtatcctcttttctgctggcgattgattccggtaatactgctatcaaatggggattgcacacgggtgatcagtggctggtgcgtggcagtgcactgcaaagtgaacgcatggtgctgaaacaagcctgggcgctgctgccagcaccacctgcatcggtgctgatttccaatgtggccggattacaagctgcagacgatttaactgcgttgttaaaaccatggtatgtccagccgcactggattacggcaagtgccagtcaatgtggtgtaactagtcgctataccaaaccagagcagttgggctgtgaccgctgggcagcattgattgccgcttggtatagggtacagcgagcgtgcctggtcgtggatgtgggtactgccatgacagtcgatgcgctgtcctccacgggtgaatttctagggggcattatcgtacccgggccggatgcgatgaaacaagcactagcaggttgtgccggaacattagcagcacctgtttccggctgcttccagaattttccagttaatactgaaaacgcgttgtacagcggcatgattcaggcattaagtggtgcgctggagcgaatgtatcgcctgctttccggctattcggaaaaacaaaccttgacggaagttatcatgacgggtggcggtgctgcgttgctggctcagcatattcacattcctcatcgggttgtcgatagcttggtgctggaggggctggctattattgcgaaatcgggcaacttcgattacaacaaaaaataaacatcaggacaacgcactatggtacacccgcttttcaggcacgctgaattctacacgacagttaaccacatcaaggatttgccgcaagcaactggtgttgaaattgcttttgccgggcgttcaaatgcaggaaaatcaagcgcgattaatacattggtaggaagagggcgatttgcttttaccagcaaaacacctggccggacgcagcatattaattttttccagcttggagaggagcgtttcatggtcgatcttccgggatacggttatgcgcaagtgcctctagccattcgtcagcactgggtacatttactgagtacctacctgcaaactcgtcaagcgttgtacggtatgatattgatcatggatatacgccatccgctaaccaagctggatttgcagatgctggaatggtttgcgcaaacggggaaattggtgcatgttctgctgaccaaagctgacaagctaagccggagtaaggcgctcgcggtattagatgaggtcaggcagttcttgtctactagttactctggctgcacagtacaaattttttccagtttaacctctgagggagcagaagaggcttcccggttgttgcaagactggtttgatgaaggaggtgctagggtacagcagttgaatgacagtgaaatcagcaatcaaaaaaaaaccccggctaaaggggattaagccggggagaatcgccttgcttgtaaggcctcgcctcagggagggaaggcgagaggcagttattaacaactacctattcataagagagaactaattggagttagttccgtgatgcattaatttttttatttccagacataaacatgacatttttcagccagtttccacaaaaaagaatgcgccgtaaccgccgagatgatttttcccgtcgcctggttcgggaaaatcacttgcgggtggatgatctaatctacccggtatttgtactagatggcagtaagcgtgaagagcaagtagcatcaatgcccggtattgtccggcagagtgttgatctgcttttgtttcaggcagagaaatgtctgcgtttgggaatccctgcactggcaatttttccggttattgatacttccctgaaaagcttgaccgctgatgaggcctataatcctgatggcctggtgccccgcaccgtaagggagttgaaaaaacgttttccggaattgggtgtaattaccgatgtggcacttgatccgtatactagtcatggtcaggatggtctgattgatgctaatggttatgtgttgaatgatgaaactgtcagtgtgctggagcggcaggcgttaatgcacgccgaagccggggcggatgttgtagcaccttctgacatgatggatggccggattgctgcgatccggtcgatactggatcgtgaccgtctcattcatacgcggatactggcttactcggccaaatatgcctccagtttttacggccccttccgggatgcggttggttccgctgctatgctgggggcgggtaataaatatacctaccagatggatccggccaattcggatgaagcgttatgggaagcagagttggatatccaggaaggcgcggatatgatcatggtcaaacccggtatgccttatctcgatatcgtacgtagagtgaaggacaaactgggtgtacccacttttgtttatcaggtgagtggtgaatatgccatgctgaaagcagcggggatgaacgggtggctggatgaaaaagcctgtgttaccgaggcattgctggcgtgcaaacgcgcaggtgccgatgcgatcttgacttattttgctccagtagttgccagttggttacaggagaatacttgaagccggattgtcgaggttgcggtagcatccgtatcagctgatccagcctttgtgaattgctccagaaagctgataaaacttcaaagaaatgtcatgaacataaaaaacaggaattttcctaaccgaaccgaccggttatgtaatcttccgtctgtttgttttttggcttgataaaaatattgtcagtagcaccaaattcaattaattcccccatatacatgtaggcagtatagtctgaaactctggctgcctgctgcatgttgtgggtcacaatcagaatcgtcactttatttttgatatctgaaatcaattcttcgatgctggcagttgcgattggatccagtgcagaagtgggttcatcgaataacagaatttctggatcggttgccagtgcgcgggcgatgcacaatcgttgttgctgacctcctgaaaggttaaatgcgagatctcccagccgatctttgacttctccccataaggcggcattacgtagcgcattttctactctttcttccagaattgagcgacgcttgacgcctcttatcctaagaccgtaggccacattttcaaaaattgatttggggaaggggttgggtttttgaaataccatactgatccgcattctgacttcgattggatcaacctcgggcgagagaatattttcattgtccggatacaggagaatctcaccttcgtaatggttgtgcggataaagatcatgcatgcggttaaagcaccgcagaaaagttgatttgccacagcctgatggtccgatcaaggcggttacctgcttttcatggaccaccatattaatatttttaagtgcctgataacctccgtaatagaagttcagtttattaaccgctgccttttgagtagttggagaagcagcgttggcgggtttaaatatttgcataactttgatttaccacttgatttttttacgcagatggtagcgtagatagatagctaacccgttcatcaataatgtcatgaggactaacaccaagccggctgcggcagcattatgctggaaagcttcctggggccttgagatccagttgaacatctggatgggcatgactgtaaacggctccatcagccattcaaaggacagaaacggaaattgatcctgaacaggggatgggggcagaaaagcgataaatgtcagtgcgccgatagtaatgattggcgctgtttctccgatcgcccgcgccagtccgataatgataccagtcagaatgccagcggcagaataaggcaatacatgatctgcaaccgtttgccacttagttgcacccagcgcataagccccttcacgaatagtaaccgggatggatcgaatcgcttcacgtgttgccacgatgacaattggcaggattaacagcgcgagcgttaatccggctgccaggatactctgcccaagtccaagctgataaacgaataaccccagtgccagcaagccgtaaatgatggaaggcacccctgccagattggtaacattaatttcgataatttcagtaatgaaattttttggcgcgtactcctcaagatagacgccagctgctacgccaaggggaacagccgctgctgccgttaccagcatgaccagtgtcgtaccaacccatgcagaaagaattccggcaatttctggtttgcgagatggaaaagaagtaaaaaattcccaagtcaggcgaggcattccgtcgatcaccatgttgccaaacaacgcaataaatgtcagaacagcgatcatcaatgcgatgatacctgctactagtgcgagcagatcccagcgtttgtggcgagcaataatggtgcgaatttcatcaatattgtctgtgttattcatgggggtcagtgaattaaatcattccgcatgcactatcctgtcagtattcggtagcgactgtaaatgaatcatggcacatcaataaacttctcggaatcgtttacgcagcagatgtcccaggatattgaaaaccagcgttaacaagagcagcgtcaatcccgcagcaaaaatggtttgatatcctacgctaccatgcggcagatcacccaagctgacctgcacgatgtaagtggtgatggtcgcagcgggctccatgggattccatactagatttggctgcatacctgctgcgattgcaaccaccatggtttcaccaactgcgcgggaaataccaaggatataggcggcggcaatgccggatagtgaagcgggcatcaccaccttgacagctgtttggaagcgtgtagcaccgatagcataggaaccctctcgcagatgcataggtacagaacgcatggcatcttccgtcattgagctgacgtaggggatgatcataattcccatcaccagccctgcagataaaagactgaaacctggtagattcgggaaaatagtttgcagcataggagtaacgaacagtaatgcaaaatatccgtaaacgactgttggaataccgccgagcagctcaaggaatggcttagcgatctccctcacgacaaagggggcaaattctgagagataaatagcaatgatcgtgccgaaaggaagtgcaatggcaagtgcgaccagtgaactgaccgctgttccggaaatgaggggaagaattccgtaatgagcatcgtcaaacagcggtgtccattgcgtatcggttaaaaaatcccatagggaaacatgctcgaaaaataccagtgattctgagatcagcagataaataattgcaaacgtaataaaaacagaaaaaaaggccgccagaaacagcagcagctctattattcgctctttcagatggcgtttgtgattgtgattgtgatgtagacttttaggtcgatgactgacagctgacacaggtactctgaccatgaaatagcaagccggttatgttgaaaaaatttattctagaaagcaattattacaatttgatgaaaatataaaaatgaagaacaaaatagcagttgatataccagccggtactgcgagttacttcgctggtgtatgacatcatattcagttgtaagcagctaaacccgtaataagctcaagccgatacagcagatagctaccttgttggaaatttgaaaggagtaagttttatgacgctgaaaagcaccataaaagaatttgccgcttttctgggtaaccaggagtcaattcttgacagggattatccaagggttgtggatcagatcagactattgtggggttacgcagaattttctctttatctggagaaattgctggttacagaaaaagggcgcgatcgaggcggtttttcatttgaagttattctggagctggataaactgaaagaaatccacgaacgtcgctttccccgaaagagctgatttatcgatcagcctgattgctgacagtatcgaaaatgctaccgggtcgtctccgaagaggcagcccggcaagcgttataaaatataaaaatacagattgcttataattgaaatatctctatcagaggatcttcagtcggcctgttttctgagaaaggcaggaatatccatcggatccattcctgcttgctgcatggcagttacagcagcgttgcttcttcttccggttctcattacagcgggctcatctacctgatgagaggatactctgtcatcagtaccggtacgggtatggatgatggtcatgggtctctgggattgttgggaaatattgccaagtcctgttgcaacgagtgtgacacgcagactgtcacccatattttcgtcaataaccgtaccaacaattacagttgcatcttcagccgtcattttcttgacagtatccatgacttcctgtacttcacgcattttcatggctgaactggcggttatgttgaccaacactccacgtgctcccgttagggtgatttcttcaagcagtggactggcaacggcctcttctgcggccatgcgtgcacgatcaacaccaccggcagctgcagaacccatcatggccatacccatttcggacatgacggttttaacgtctgcaaagtccacattaaccagtcccgggcaattaataacttccgcgattcctgctacagcaccatacagcacatcatttgctgccttgaaggcatccagcatgctgatatcatttcccagcactttcatcagcttgtcattcggaataacaatcaatgaatcgacatgctctgccagtgcttccattccagcctgtgctgctttcaggcgtttgccctcaaacgagaaaggtttactgacgaccgcaacggtcagaatgcccatttccttggcaatctgggctacgaccggggcagcgcctgtaccggtgccgccccccattcctgcggtaatgaacagcatgtcggcgccctggacaatttcagcgatgcgatcacgatcttccagcgctgcttctttaccaatctccgggttggcccccgcacccagtccccgagtgacattgttgccaagctgtaacagggtttgtgcacgatttgcctggagtgcctgtgcatcagtattcatgcaaataaattcgacacctttaacctcgttacaaatcatgtgatctacggcattgccgccacatccgccaatacctatgactttgatgatagcttcctgggattcggtattcgtgatctcaaacattacatttctcctattgcatagtgaattttcaaacaatattccgttgacagaacattttttaaatctaatttagaaattttcctggaaccagcttttcatttttgccaaaatctgtctggtggagccgctcttcagttttgcctggtgatgatgaagatgatcttccatgcctgccatcaccaggccgatggcagtcgagtatctcggtgtctgcacaacttcttccaggctgccgttataagcgggtaacccaagtcgcacgggcatatgaaaaatctcttctcccagttcaaccatgcccagcatggaactgctgccaccagtgatgacaatccctgatgaaagcagctgttcgaaaccactacgtctcaattctgcctgaatcagcagatagagctcttctacgcgcggctcgataacctcggccagggtttgtcgcgacagcgggcgaacgccacgattgcccacatccggcacttcaaccatctcccggatatcagccagcgtacgcaaagcggtgccataacggcatttgatatcctctgcatcttttgtcggtgtgcgcaatgccatggcaatgtcattggtgatctgatcgccagccactggaattactgcggtatgtcgtatggagccatctgtaaaaacagcaatgtcagtagtcccgccgccgatatcaaccaggcatacccccagatctttttcatcttcggaaagtacagctgtagccgaagccagtggctgcaggataaggtcccgcacatccagtccgcaacgattgatgcatttggcaatattctgggcggcggatactgctccggttacgatgtgaaccttaacttccagccggataccactcattccgactggttcgcgcacatcttcctggccgtcgataataaattcctgttgcagaatgtgcagtatttgctgatcagccggaatattgaccgccttggcagtttccattactttttccacatccgcctgggtgacttctttgtctttgattgccaccatgccatgtgaattaaaactcttgatatggttgccggcgatcccggcatacacatcactaatccggcaacccgccatcagttcaacttcctcaagcgcacgctgaatggcgttgacggttgcttcaatattgaccaccacgccttttttcagacctcgcgagggatggctacccagaccaataatctcgaagccaccctcaggcttgatttcggcgacaatagccacgattttcgatgtgccgatatcaagaccgacaatcatgttcttgccttccttgactttactcatttgaaaatcccccgatttcatagttatggtgctctgtttgccttgaattgaatacacaaactcagtgtatgcgaacagcaaacccgttggcataacgcaaatctacataagtggagttgccgtaccaatccagactttcgttatattgcgtatgaactgccacataacgtttcaaacgttgttccatctgtttccttcccaatttaagccaggttccagtgttcagtcgtacgtgccatgcatgccgtggtgtcagagcgatctccgtgaccgtgtacccggtcggctgcagtagcttgttgaaaatatgatactggcgtgtaatcaaatgattgcttttatcagggcctgtgaataccggaagacgtgcattatccataatcgcgtgaaatatttctccattcgtattgaccagtgctgcctctccccaagatgcaagcggtttatgctcttcgagtaatatgtccaatgcaggtggccaatcgcgcgaaattttaactgaacgtacccatggcagctccatgaaagctttttgtaaaatcttcaggtcgatcattataaaattaccattcaccgagttgtgtatgacctgttcaatctgatcccgggtgatatgtgccagacgtatattgtttgtctggctcttgtccacagcctctacccgaacctcccgtaatgaaaaaaacggcaatgccagcaccctgattcctactgcatagatcatggccagaagaacgcctgtcagcagtatgtttgctagaagatttaaggattgatgatcgttccacatatgtcctggttacagtatcaatttgccctgatcaccttgatctggatttctatctttaagcatactcacaactcaactccagaatttgtataacaagttcatcaaaggaaatacctgcagcctgtgccgccatcggtacaagactgtgattagtcattcctggcgaagtattggcctcaaggaaaaaaggctggccatttttatccagaatcagatccactctgctccagccggtacatcccagtatccgatgagcatataaagcctgttcctgtatgcgggttgtcaatattttcgacaaaccgcttgggcaagtgtagcgtgtgctttcagaaaaatatttagcctgataatcatatagaccttctgtcacatcgattcgtaccagcggaagaggcacatcatccagaatggctgctgtcagctcgattccctgaataaactgctctgctattacaagcgaatcgtgttgtgcggcagtctgataggcggattgcatatcttgcgcgtaatccactttgttcaatccgatggttgagccttcccgggcaggttttatgatgagcggtaatcccagcctgtcagtcacttcctggaaattgctgtcagcatctagcatgacgtagtcaggtgtgctgatgcctgccgcctgccagatcatttttgtgcgccatttatccattgctagtgcgctggcgagtatgccgctgccggtataaggcagatccatcagctccagtgccccctgaacagagccatcttcaccataacgaccatgcagcgcaataaatgcccgatcaaagccctgttttaaaagatcttccagaggttggccgaccggatcaaatgcatgcgcatcaacctggcttcgctgtaatgctgccagtacggcatggccgcttttaagtgagatttcacgttcagcggaacgtccacccagcaatacagctactttcccaaggtcacgaatgttcatagctcgtttcctttgtgctgtccgataatgcgtacttccgtgaccagcctgatctcggttttcttgtaaacgatatcttgcacagtattaatcactgtctcgatttcagtagcagtagcgtgtccgcagttaataataaaattggcatgtaacgtagaaatcatggcatcaccgatccgaaatcccttcagaccacattgctcaactaaccgggcggcataatctcctggcggattgcgaaaaaccgatcctgcgctgggaaatcccaagggttgcgttttgatacgtgtaccaagcaatgctttgaccgcctgacgggaagattcctgctgaccagggcgaagtctgaaccagccgccgacaaaccagctgcaagatgtatcgggcggcacgacttcatgcaattcgacctgacggtagccgatacggtaatcctcaggtgttcgctcatgcaatgtaccgtcgcgatcaatggttttgacccgctctacccgttcccatgtttcagagccgtaacaccctgcgttcatcgccagtgcgccgccgaccgtaccgggaatgccggccagaaattccgcaccggccaggttatgtaatgaagcaaacctggccagcttggcgcagggtacccccgctccggcataaatcaggccaccatcctcctcttgttcaaccagcagcaggtcattaagttttgcatgcaatgcaatcattactcccggtagtccaccatcccgaaccagaaaattactaccaaggccaatcatcatgacgggttcatctttcggccagaagtgtaaaaatacagccagatcttccagatctgccggttggtaaaaataggcagcgtgtccaccggcgcgccaggaaacatgctgcttcatgggttcatgttgacgtaattcgccgcgtagcagatgtgtgtcgataccgagtgcaggagactgcaagctcggagcatttatatcgactggcagtcgggcttttgtctgcatgtttttcaatcaacctgttatcagtgtcagcttcatcgttggctctgccaagccaggtgcgatttttccaatggatccggcccccataatgagaactacgtcaccctcctgtacaacggtatgaacggcggatttcagctcgttgatgtgctcaatataaataggctcaatctttccctgcacccggatcgcccggaccagagatttgctgtcggcagcaatgattggttcttccccggctgaatatatttctgtcagcagcagtgcatccgcactggataacacccggacaaaatcctcgaataaatcccgtgtacgactgtagcgatgtggttgaaacaccaaaaccaggcgacgaccgggaaaagcattgcgggcagctgccatcgtggcagcgatttcagccggatgatggccataatcatcaatgagggtaaaagatcttcgatccggcaaacggatttcaccatactgctgaaatcgtctatcgactccgccgaaggtagccagcgcttttaccattgcttcatccggtatattcagttcattgccaaccgcaatggctgccagcgcattgagtacattgtgtttgcctggcagatttaatgtgatgtctagtgttcgtgccgagccattgacaccaatatgggcacagaaatgcatcttgcattgatcgtggcgaatatcggtggcacgtatttgtgcattttcagatgtaatcccatacgtggttatttgcttggaaaccattggtatgatggcgcttacatgcggatcatctgcacaaagtactgccatgccataaaaaggcaggtgttcgatgaattcgacaaaagtctgtttgagccggttgaaatcatgttcgtacgtgctcatgtgatctgcatcgatattggtcaccacggtcaacactggttgcagatagaggaacgaagcatcggattcatccgcctcaactacaatgaattctcctttgcccagcctggcgtggctatcgactgttttaagtctgccgcctattacaaacgttggatcttggcctgcttccgccagaatactggcaaccaggcttgtggtagtggttttaccgtgagtgcctgcgattgcaataccctggtgcagacgtaacaactcagctagcatcatggcccgaggtaccacgggtatacggcgttcacgtgctgcaataacttccgggttatcaggctggatagctgttgaaatgacgacggcatctgcagattggatgttttcagccgcgtgggtatgatgaatgacagcacccaggcattgcagacgtttggtggtcgaattgccattcagatccgagccgctgatctggaagccttgattgatcagcacctcagcaatcccgcccattcccgaaccaccaatccctacaaaatgaatatgcttgattttatgtttcatgggcttgtctcaataagttgttgacaaactgtgactacgctttgtgcagcttcaggcatggccagcatgcgtgcattgattgccattgtttgcagttgtgtgcgtgtacaagtcatcagccattgtgcaagtgagtttgcggtcagttcggattgaggccataaaacagcagcattgtgttcactcaaaaatcgcgcattagccgtctgatgatcatccactgcgtaagggtaaggcaccagaatactggctactcctgccgcagccagttcagcgatcgttagcgcgccagcgcgacaaattaccagatcacaattctggtaatgcacagccatattctcaatgaatgcgaccagattacctgtgacaccatgctcagcgtaagcttgctgcaacgcagccagatgaacttttccggactggtgggtaacaaatggccgctgatttccaggaatcatgctcaaagcctgcggcagcacggtatttaatgcctgtgcaccaaggctgccacccaccaccaggatgttcagcttgcctgcccgttttgcataacgcacttccggtgacggaagctgcgcgatctctgttcgtaccggattgccggtgacctgaatcttgcctgcctggtccgtgatggtgccgggaaatgccagcaggatacggctggcaatttttgccagtattttattggttagtcctgcgattctgttttgctcatgaatcagcaacggtttgccagacaaaacagccattattcctccaggaagcgccgggtaacctcccatcccgagtacaatctgcgggcgttggcgatgcaatatgcagaaactttgccagcaggcttttgtcaatctccaggggagcaacaaatagctgaccggttttttgccgcgcagcccggaaaaattgatcagctcaatagtaaaaccatgttgtggtaccagtgtggcctccatgccattacgagtacccagccagataactcgccagccctcagcctgcatggcacgagctaccgcaagccccggaaatacatgcccgccggttcctcccgccatgatcatgattgtgcgggacaagctgtgaactccacatgtggtgtatgccatggaccagattgcaggtgtttattcatacatttagccctctgcgtttttgccgattttcccaatcaatccgcagcaatatggcaattgcaatactgttgataacgatactgctgccgccatagctcatgaatggcaatgtcaagcctttggtaggaagcagacccatgtttacgcccatgttgatgaaagcctgaaaacccagccagactccgataccttgcgcgaccagtgccccgaattgatctccctgggtggctgccgcacggccgattctgaatgtgcggattagcagaaagaaaaacagcgctataacagtggccacgcctgcaaaaccaagttcttcggccagtactgcaaacatgaaatcagtgtgggcctcgggcagataatttaatttttctacactgcctccaagccccactccccaccattcaccaagtccgaacgcgattagtgcatgggtgagctggtagcctttattgaatggatcattccagggatcaaaaatagcgttgatccgatccatacgataaggctcaaatataatcagcagaattagcgggattggtatcaggcataacagccccagaaacattttcaggctcattccgttgatgaacatgatggataacacgatggcagctatgatcactgcagcccccagatccggttccatcagcaaaagtagggaaacaatagccagtaatgtaagaatgggcagaaaacctttgaaaaaatgatccttgtaagcggttttgcgtacaacgtaatctgctgtaaaaatcagaatgagtaacttcatcagctcggaaggctggaagttaaatatcaccagaggcagccagcgacggctgccattgatttcaaggccgatacccgggatcagcactacgatcagcagtacaatacctattgcaagcagatagtgagaataagtttgccactggcgtaacgaaacctggaaagcgaccatcccggcaaatattcccaataagatagaaagagcttgccggacaagaaaataataagtaccgccctcaccatattttgattcggcgattgcaatagaggcggaatacaccatgaccagtcctaggcccagcaacagcagaacagctgaaagcagatgcagatctagttcgggctggattggctgattatgtgtagtggatggacttatcatacggttagtgacatgtctgtgccgtgagtacaaatttgtgttcgattccctggactgcagccgtaaaaacctcagcgcgatggatgtagttgttgaacatatcaagactggcacaggccggggagagtagaacgatatcgccacgctctgccagcaaaaaacttacccggacagcctcatccatagttgccacgcgatgtaccggtacattgcagccctgaattgcctgtgaaattttctcggcatctcttcccagcagtacaacaccgcgtgtatgtttgctgataggctgttccagaggtgagaaatcctgccctttgccatctccgcctgcaatcagaatcacgttttttcggaaaccattcagtgcggcaacagcggagcccacgttggtgcttttggaatcatcataaaaagtcacgccattgaactcggcaattttctgcatgcgatgcggcaatcccttgaagatgtgcaaagcatgtaacaacggttcaaaaggtagatcaatggcccggcataatgccagtgctgccagtgcgttggccgcgttatgcaatcccgcgacagcaagttcgctgactttcatcaagcgagtggtgccctgtgccaaccacaaatccgatccactgggtaacacaccgaattcatcgtcgaatgccggtgcggacaagccaaaagttaattgtttgctgttttcgtgagccatggcgtatacccgggcatcttcccgattgagtacctgcacacaactgttatgtggatcgggaaatatccttgcttttgcggctgcgtattcctcgataatgcggtagcgatccaggtgatcttcgctgaggtttaatacgacggcagcattgggacgtaaactgctggtggtttctagctgaaaacttgacagttcgagtacccataaatgcggccattttcctgtatctattcgctgcatcagcgcatccagcgccgccaggccgatgttacccgctacttcaacatcccatccggtattccttgccatttcacctaccatggtggcaacagtggttttcccattggatccggtgattgccagaattttcgtacccggtggcgcgtgctgatcaagtgcgatggcgaacagctcgatatctcctattactgatacgccctgttgcaatgcagtttgtaccagtggctcggcaattgccacgccggggctgatagcaattgcatcaatgtccttgaacagctctgccttgaatggaccacagaaaatcgtttcaagcggcactatctgactcagcagctcaagattcggtggggtggtacgtgtatcggctacggatacccgggctccggcacgggaaagccacttgaccatggagatgccggttttacccatacccagaaccaatatatttttgtcggcgtaattcatcgtagtttcagtgttgataagccgatcagcaccagaatgatggtaataatccagaatctcaccacaacctggttttccttccatcccttgagctcgtaatgatgatgtaacggtgccatgcgaaaaacacgccggccgaataacttgaaggaggcgacttggatcatgaccgataatgcctccatgacgaatacccctcccatgatgaccagtactatttcctggcgaacaatgaccgttatcactcccaatgctgctcctagcgccagggcaccaacatcgcccataaacacttccgccggattggcgttaaaccataaaaatgccagaccggcgccagccagcgcaccacagaaaacagccagttcacctgcgctgggaatatgtggaataccaagatatttagcaaatatggcgtggccggcaacataggcaaagatggccagcgcgccactgatcatgacagtgggcataatggccagaccatccaatccgtccgtcaggttgactgcattactgctgccaacgataaccagataggtcaaaatgatgaacagaaatgatcccaatgggatggcgacttccttgaaaaacggtacgatcatatcagtgtgctgaggaagttcagccgtcatggcaagatatactgcgaccagcaacgcaatgattgattgccaaaaaaacttggctgaagccgaaagtcctttggaattatgctgtacgaccttgcgataatcatccacccagccaattgcaccaaaacccaaggttgtcagtagtacgagccagatataacgattactcaaatctgcccacagcagtgtcgtaatgataactgccatcagaattagtgcgccacccatggtcggagtgcccgcctttgtcaggtgagattggggaccatcactacgcacggactggccaactttacgcgtagtcaggctgcgtatcatggccggaccgatcaaaaaggagatgctcaatgcagtcagcgctgccagcatggtacgtagcgtgatgtaactgaatacattgaaagctcggatatcttccgcaatccattgaaaaagcgccaataacattttacggttcccgttgcaatgtccggtcgcagacacaaaaaacagttttaatcagaggatctaccttgttcctactcaacatatctatcctgcagttgctcgatcacacgctccatgcgcatgaatcgcgagcctttgaccagaacagaaacattctttcccaggcagtcttttgctttttccagcaatgtatccagatcggcaaaatattgtgccccgctgccaaatcctgcaacggtttgctggcttaattctcccagtgccagtaacgcatctatgccagcttttgcagcctgttggccgatggtgtagtggaatcctgcagcatccgtaccgagctcccccatgtcccccataatcagaatttttttgccgggcatctctgccagaacattcagcgctgcctgcatggaatccgggttggcattgtaggtgtcatcaatcagaatagattgatatagccccacttttttctgcaaacgcccaggagtgcccatgaagttatgcagaccctcggcaatggaggttgtgctgatgccggcagccgtagcagctgccgctgcagccagtgcgttgtaaatattgtgacggcctggtacctgcagcgttatttcaactttgtcgtctggcagttgcaacaaccatgcagcttctgatgagctggacatttgttgcgcacggattgcagcaggattcgttatgccgaaatccagaatctgtctgcttcctgccagttgtcgccacagctgggcataagcatcatccgcgttgatgattgcaatgccctgtgctcccagccctgtaaagatttcccccttggcacgggcaatcgcttcggttgtacccaggtgttcaatatgtgcggtgccggcattggtgatgacggcaatcgtgggtgcagccagttgactgagataggcaatttcgccagcgtggttcatgcccatttcaataaccgcgcaagtatgcccggtattgagctgcaacagcatttgtggaacaccaatgtcgttattcaggttgccggtcgttgcaagaacgtttcctgatccgaattcatgtctgaaaatagctgcaatcatttccttgacggtggttttgccattactacctgtcacggcaaccagcgggagtgtaaagtgctgacgccagtttgcggccaattggccgaagccaagccgagtgtcgtttactttgatccagccgaaatcagattttgtcggaacgatgaccgtatcggtcgaaaccattgcggcaacggcacctttttcgatggcagtagaaatgaagtgctgaccgtcaaactgctcgccggatagcgcgatgaaaagatcgcccggtctcagggtgcgactgtctgtgctgaccccagtgaatatcgggttgccaccagaccaatttgaatttgcatgcagggctagtgcagcttcctgtacgctcatcatccctgcacctgcaattctggaccagccaggtcatgcaatacctgccgcactacctcgcgatcatcgaatggatatttttttccttgtatttcctgatgagtttctgcccccttgccggcgatcaatacaatatcgcccttgcgcgcaccatgaatagcccggtaaatggctgcagtgcgatccgcttcagccgtgcagtgcttgccactggccccaagcatgatttcattgataatatctgccggattttcattgcgcggattatcgctggtaataatgacttcatcagccaggtgtgaagcaatctctccaatcaacgggcgcttgccgcgatctctatctcctccgcaaccgatcacgcaaaccagttttgcctggttttttcgtatccgttttttcatgcgcgtaccggccagtgtttcgcgcaagccggttaatacttcgttcaatgcatcgggtgtatgcgcataatcaacgattacgatgggctgatcacctcctcccagtttttccattcgccctggaattggttgtacttgttgcaaggcagttattgcatcatcaagatcaacattactggcaagtaaagtggccagtacagccaataggttatatgcgttataacgaccggttacattacattgcagactggcgcgccgattacaaaattcaacatcgaagctaatatgctgtgtggtaaatcgcagattacttccgtagagtattttttggttaccggttgtacgggctgatggatcaggttgcctgaaaccgtaaccaatgatcgacacgtctttccaggccagctgttgtgatagttccacgcccagtacctcatccagattaagaacagcgtgttgcagcccctcccagaaaaagagttttgccttagcagcagcataggcatccatactgccatgataatccaggtggtcacgcgtcagattggtcagtacggcaatcgaaaattccgaaccagccagcctgtcttgagaaagaccatgtgaagaagcttccataaccagggagcgagcgccgtgctgtaaatagtcagccatcagttgctgcagatatactgcatccggcgttgtatggttggcatgattcaacgctcccgggaagccatgtcccagcgtgccaatgatggctgtcttttcccccagtgtcatcatggcctgggcgtaccagtgactacacgtagtttttccgttggtgcctgtgattccaactagccgtaaatgtctggatgggtggtcgtacacctggctggcaattttcccggcttcatggcgtaatccagagatacccagattgggtatcttccactccggtttccaggaaaatccttgtttttcccagataactgcattgacgcccaatgcaattgcttgtggaatatcgttgcgtgcatcatgctgttcgccagcacaagccagaaaggtatcgcccggtttcagggtgcggctgtctgccaccagacgttgtatcttgacgctcagccgatccagcaagcaagcaagataagtttcatctgatccaaagctggacgaagtgctcatcccttatcttccagctctgcaggaacaggtgatataaccagattgcccagtggctcatcaaacggcacgttcaatatacgcaacgtaccttccattacccgactgaagacaggggcggctactgtaccgccataataatttccgcttgagggttcatcaatcatgatggcgataattacgcgcggatcagacgccggagcgaagccgacaaatgaagagatatagcgatctttggcataacctttctgacctttcaggcgtttgtgtgcggtaccggtttttcctgcaacacggtagccgctgatgcgtgcactattgcctgtgccttcaggttgaacggcaagttccagcatttttcggactgattgtgcagtttcgtgcgaaatgactttctggccaacggcaggcatatcacgctttagcagtgtgacaggctttaattctccatcagtggcgaacagcgtataagcacgcgccagctgcattaaactggctgaaatgccatggccataggacatggtggcctgctcgatcggtcgccaggtattatatgcacgtaaccgtccgcttgcttcaccgggaaatccaatgccggtttcagtcccgaaacctgagcgattgagcatttcccagaaagtttttggcgggagcaacaaagcaatttttgcagcgccaacattactggaagcctgaataacctgggaaacggtcaggttgcccttgtcacgcacgtcatgtatgacagctctgcctattttcagtttgcctccagcagtctccatcagcgtatccggcttgatccgaccggtttccatggccacagccacgacgaatggctttaatgttgaaccaggttcgaatgtatcgaccagcacgcggttacgaattacttcattattcatgctggcgcgctgattgggattgaaagccgggtagttcgccattgccagtacttcaccagtttgtacatccaacgctacgatgctacctgctttagcgtgctgttcttttactgcgcgtgccaattcccggtaagcgaggtattgtattttactgtcaattgacagaacgacatcctgacccggtttcggagattgaatctgctcgacatcttccacaatacgtccgatccggtccttaatcacgcgccgtttaccatcctcgccggtcagcatgtcctgccacgccagttccattccttcctgcccccgtccatctatatcagtgaagcccagaatatgcgcggccagctcgcgtgctggataataacgatagaactcgtgcttgagatttactccttttatattgagttcagctaccttttccgctaattctggagggagctgccgtctcaggtatacaaattttttcccgctgcggatgcgctgctggatgactgcttcttctacgcccgtcaaactggctaattgtctaatttgttccggtgttgcatttactctttgaggttcgatccatacagatctgacaggtgcgctaacagcaaggatttcgccattgcgatccttgatattgccgcgctgcatattttgttcgataacccgctcgtgacgcgactgcccttgttgctgaagaaaatccttgttcagtgcctgtaagtaaattgaccgggagattagtatgatcaggcacgtcagtagaagtccctgcaccaagcgtgaacgccattctggaacaggggagattgttttacgggaaggattgaacaaaactttcattcggttgtgcccggagtgtaatcaggatgaatagccagaatatttctggtcgtaggtggcgtaatcatgccaagttctttccgggcgattttttctacacgcgcagacatggccagtgtgctttgctccagtagtagctggctccattcggtttctagctgctcagttaatttttgttccttttcctgttccatgaaaagtttacgtgcttcataccgtgcagtcacaatacccaatccacagataatcaatattacaaatagaaaaatatttagcttgatcatctgcttatcgcgtttctggtttccagtttttctgccacccgcatgacagcgctgcgtgcccgtggattggcggatacttcatccgatcctgggcgaatttttttaccgataattcttaatttttgctgattgtgtaaacggctttcctcctccctgataggcaatcttcgcggtagagtatcggtaccggcctgcatacgtatgaaacgcttgacaatgcgatcttctaatgaatgaaagctgatcaccaccaaccgcccgcctgtattcagcaactccacacattgtggcaatgtcattgatagttcttcaagctcctggttaaggtgaatccgtatcgcctggaaagtacgtgtcgctggatgctgtcgatcatcccggtgaccgcgcttacgcacaactgctgcgacgatctcggcaagccgaagcgtggtactgatgggctggcgtgcctgctccataataattgcactcgcaatctgtcctgcgtaccgttcttcaccgtaggttctgattatttcctttaattctgcttctgacgccatagtcagccactctgctgctgttttaccccggctggaatccatgcgcatatccaggggaccatcatgacgaaagctgaatccgcgcgaagcttcgtccagttgaattgacgatacaccaagatccagcagaataccgtcaacccggtttatgcccagcgactgaagtgctgtgtacattccggcataactgctgtgtactgcctgaaatctttcatccaggatggatcgagcttcggaaatagccgctggatccttgtcaaacgcgattaactggcctgacttgtccagtcgcgacagaatcaggcggctgtggccgccccggccatacgttccatccacatagatgccgcctttttgaatatttagcgcatctacagcttcttccagcagaacggatatgtgcacggcgttaccggcacattacagtgaaaatccttccagttcgggaggaatatctccgtccttgcaagcagttgccgtatcgatttccagatcccatttcgccatatcccagagttcaaatttttcgccttgtcccgcgagcacgacttctttctgtaaaccggcaaattgccgcaagggggcgctgatcagaatgcgaccggagccatccatttccacgtcacaggcattaccgataataagtctctgcaaacttcgaatctgtgggttgaagctagaaaagccgctcagtttcttttcaattggttcccacacgggctgggggtatatcagcaggcacctggagggatcagcggtcacaacgatgttgcctccacaattggcaaataattcatttcgatatttggcgggaatcgcgagccttcccttgctatcgagatttaattgagtggagccacgaaacatttcgtcccttttgatttcaatggaggtggctgtttaatatttgaatcgtatttactccactggcatccacaattctacatatttcaccactttttgccactttactcaataaaattttcagggtcaagtcaggaggaatttttatattgttgtgacaattacttaacagattttttcggtaatcatttcaaataaaatcaccttgtaaagacagcttatttcgggatttgaatatggcatagtacaaaccgggagaacatttcaaaccagaccgatatggctttggtattttgggaacaggcagttaatgacttgtcggcacgtgatccgatgatgcaccggatcattccgagcatcttggttatgcccggcatgatcctgccgggcgtggggggcggtatcggtttcgatccggtggatgatcttgcacttgttatcgacattgatcgacagcttgtagccgaagtggctcttgccgggcttcttcgtccaggtcgcgtcggtatccttctggcaccgtgtcgccggcttccagtcgaatgccttgggtaaatctctccagggacaaccggtatgcatgcgtacagtatgccttcgacagttatacgcaaatcttgcttgttgtagatgttgtcgtgaagcaaaatagccaatagcttcgaccaaagttcggcattgagcagtaatcggagtattgcaagctcgtattgttgttgtgtgaaagctacaacgatatgagtgcttctttaaatcaatggcttgagaccaaacgggaacaggccctaggcgcagtataattaccgaagaaaaacagcggtgattcaaatcatttggacaaataccatgactcaacatatttcctgcgatttacacgactatatcgaagtggcttgtatgtatggctatcaggtcaggttgatcctgaaggaccagtcaactgcggaagggaaggctaaggatattctgacggatactgaaacgcgtgagtttctgctgctggaaactgaaatcggatcccagcaggttgaattaatttttctcgataaactgcaagtactgactccggatgcacgatttactgaagttgtcttttccggatcctgtgaatcctgaatccgttacgatccggaaactgcctgaataatcaggcgcgcaatccgtcatccggcggactgacttttccagattccggctttcgccggagtgacacagcctgaattaacagcgtagtggagtaaccggtattttcccggtcagcgtctaccgtcgtaccacatcggcagcttctttttattacgcaatgagcccaagggagacaataccaggtaaaaaaactgcctggtaatctcccatccactgtaaagcttggtttttctggaggatgtttcgagcgggtgtttgctcaaaattgcaaacttgagcttgtgctggcggccatatttcttgagtttccggctcaattcgatttcttccgccgcgtacagtgtcaaatcaaacccgcctccctctttgaatgcgatggcattgcatactatcagcgccccagcagcccagccaagctgcactgacagcagcgtccatattcgcagcaatatctccgcccatctgggctgatccggcatataaagcgtgctgcccgcaccgacatgcctgccttgtttgatcaattcaaacatatcgcctaccagtccggcattcataaggcaatcggcatccataaatatcagccattcccccttggcaacatctgcgccagcagttctggcacgcgcaatatgattgatcggctcaaaaaccacccgggcacctgctcgtttagctaaacgagcagttgcatcagtagaattgttattcactacgatgacttcatgggtatagccataggagcgattcgccatcactgcatcggcaactgaacgcaggcactgctcgatcaattgctcttcattgaaagctggaatgataaaagaaatgcgcatataacctatttcaataataaaaaattcagtaatttctgccattaccgagcgttcatcgtaaatcacagaattacaatcttattcagcttacaatataaaattcgggtaaggatagatatgcccagaagcctgcatttataattacatcttccaattttaaacagcttgatttcacacgcccctgccatatgatctggaaacccaatgttacagtcgccgcagttgttgaacagaatggtaaatacctattggtggaagaaattcccaaaggaaccgagataaaactcaaccaaccagccggtcatctggaacccggtgagtccattattcaggcgtgctgtcgagaagtactggaagaaactggccatacctttcagcctgaggtgttaaccggcatttatcattggacatcggcctcgaatggtatcacctacctgcgctttaccttctccggtcaagttactgcttttgatcacgaaagaaaactcgataccggcatcatacgggcaatctggctcaatatagatgaaatccgtgcaaaacaggcatttcatcgcacaccgctggtaatgcaatgtattgaagactacctcaccgggagaaactatccgctgaatatcctgaagtactacggctgagagccaatcagctaactacaaaattcggcacaaggaatcatacatatgaaccggtatggcaacccatgggctttctacactcttatctagcaaggatagaaacagcaatcccataaccatacaaatcacgatgctgcccagcttgttttttgttatacaatccggtggtggtttatgttctaacccgaatcaaaagaatcgagccagaatcaaacggcccggttaaaaggaaatacactaagcagcaccaaaatttgaaatcataaagtggaggaaatatgaagaaggtttttcgaaacagatacgttgccgggctatgcctcgcaatatcaatgtttctggtatcgttgcccgcatcagctcagctgatgctcgcgcacgagggacatcatgatgactcagggtgtaaagttgatgatggagattttcctgttgcgatcagcatttatgaagttccggaagggaatattcctcctatgcattcatattgcagtcatgttcccaatgcaggcaagatcaatatgacgattgagctttccgatgccaagacacgtgaagttcctatcgctgtcagggtccttatggaaggacatgaaggtagtgagcacggcgcacatgaagtgctgtatatgcctgccgagaaatattcctccggtattatcgtggttgcaaccaatcttgaacaagttggacagtataacgttcagctggaaacagacgatggtgcaggcaatgtcaaaacagccgtcaagatcccgctacatattggagaggggagtggccacagtcatggatccaactttggtacgatagaattgattctacttgctggtgtgggcatagcaggtgctttcattttccttcgcaagaaagatcccgcaaaagcttaatcaagataatatcaattaaatatggaagcatgcagcattgtgttgccaaatatagagctgcatgcctgaatacccggatacccagataccacgaaaaaagtggcgcaagctatgcataagcatgctcccaaccattttcttacaataaaaaatcatggcactcagtttgacatctccatcgttttctcatcaaggcctaattccagcagatcatacctgcgacggtgaggactcttctccgaagctcatctggacaggagcaccagaaaatacgaaaagcctggttctgatcgttgatgacccggatgcacctgatccacaggcacccaaaatgacatgggtacattgggtactttacaatattccaattactgttgataacctgccagcacaagtaaccgtagatagattgcccgctggtactttggaaggtataaacgactggggaagaactggttacggcgggccatgtccaccaatcggaacccatcgctattttcataagttgtacgctctggatactatattgcccgatttgaaccaaccaaccaaagctgttctggaaaaagccatgcaaggtcacattattgctcaggctgaattaatcggacgatattgccgcccaagcaacgtctgaaacacaaacagccaagttaaaagccaacaaactgcatcatcctgtcaatcttggctgctgactccgatactgatcactcttgttaatatgtctatcaaatcacgtatccgtactatcccacactaccctcgcgaagggattatgttccgggatatcaccactcttctgaaagatccagtcggattgcgtataactattgatgagattgccgagcgttatcgggctgaaaaaatcgacaaagttgtcggaatagaatctcgtggttttatctttgccgcaccagttgcttatgcgctgggggccggatttgttcccatccgcaagcaaggtaaattgccggcagaaaccatcagctgtgattaccaactggaatatggttacgataagattgaaatccatgcggatgcaatcgataaagacgaccgtgtgctaatgatcgatgatctaattgcaacaggtggaacgatggaagcagcgatcaagctggttcaggagatgggcggaaaaataatcgaatgctgttttgtgattgatttacctggtgtcggtggaagtacacggctgcgccaacaagaccatcagctgtattctctgtgcagttttgatgattgaatctgctggcggcatcctcgtttctctggattaaacacgtatacagatatctaatttctgttcaaacagaatcgttgcaatgctaatatccgcagcagattagccgcaatcctgccggttaagatgccggagcagctttccgcaataacaaattttatatcgacccagcctactggctgccgtggagtccgttcacatgttagatatccagcaattacgtagcgacctacaaaatattactacttgtctagcccaaagaggttacaacttccctgtgtccgattttgagaatctagaaagccaacgtaaatccatacaaaccctgactcaaacattacaggcaaaacgtaattcagcttctaagcaaattggtatcgccaaacagcagggagaagatgtcagtacgatcatggctgaaatagcgaatatgggagatgcgttaaagcaggcggaaaatcagtttgaatctattcaaaccaaactacagcaattgttgatggaaattcccaatcttcctcataacagcgttccgacgggcaagaatgcagatagcaatcttgaaataaggcgctggggaacgcccaagaattttgattttacagtcaaggatcatgtcagcatcggtgagcatctcgggttgattgattttgaaaccgcggcaaagctgagtgggtcacgcttctgcctgctgaaaggcggggtggcgcggctgcatcgcgcgctggcgcaatttatgctcgatgcccatacgcaagaaaatggctacaacgaggtctatgtgccttatctggttaatgcggactgtttgcgcggaactggacagctacccaaattcgaacaagatctcttttctgtactgaccagcgcacaggatgaaacagataatgtagataaaacaggcacggttggcctgcacctcattcccactgccgaagtccctcttgccaatatcgttcgcaatacgattgttcctcttgagcagcttccgcttaagtttgtcgctcatactccgtgtttccgttccgaggcaggaagttacggcaaggatacacgcggattaatccgtcagcatcaatttgataaggtcgaactggtacaaatcacccatccggaaaaatcttacgaagcattggaatcgctggtaggtcatgccgagaaaattctccaaaagctggagctgccttataggatcatgttgttgtgtacaggagatatgggattctctgccgccaagacttacgacattgaagtatggctacccgcacaacaaacctaccgggagatatcatcgtgtagtaattgtgaagcgtttcaggcgcgacgcatgcaggcacgcttccgtaaggggcaagataaaccggaactactgcatacacttaatggctctggactagcagtaggacgaacgctggtggccatcttggaaaattatcagaatgaagatggaagtgtcactatcccggaaattttgcagacttatatgggcggcatcaagcggatcagcctataatgtgtatatgttcgtctgtattaactactagaaatggaggattctgatgcaaaatgacaatcatgatgccacccatactgataaggatgttacccaacttgccgaagaagtcaggaagacaatagagcagggtggtgatgtggaaaatgccgtcagaaatcttacactcaagactatgcactctaacggtctggatattgaatccctgaaacagatagcaaccgctgtaatggaaggggctcaggctggcgcgcagcagaaaataacgcatgccacagggcaatctcaaacagcgcgatcacaaatcacccaggcagtcagcggactagatggtgcttttgctcaattggccggtgcttccaagctggctctggaagaagcagcaggaaaagccaagcagttctccgacagcgacctggccaaagcccgggcagatttggaggatctggaagatgtatttctggataccctgaaacagacggcttccgccgcacagggtttgattgctgaaacgctgcaggatctgttaacacatgcacaacataatggcaccgctgtgggcagacagatcaaagatacgctggcagttttggcgcatcaagtagcttcagccggccgggcacaatttgaagcgggcgtaaaactcactcaaatgactgcagatcttctgtacaaaatttctaccggggtcttatccggcatcaccagtcaaactgatcgggataaaaaataatcatttctccgatccggaaaatctgtcgaaaattctggcgcgcctcaacctggtaaataataacggttaactgggttgagcgagctatccagctcgtaacaaagcggctgacctgtcgtaattgataagcgcatcacctgtgcgcctgtcaatccttccaattgcataactaaagttcttaaaagccccttgtgcgagacaattagcaaacgtttcccctgcctgatttcagggagaatcgtttgctgccagaagggctgtacgcgcaccaatgcttgttgcatactttctgccagaggtaactgggcatgattaactgctgcatagcgctgctggctggcgggtacacgaggatcatttgccatcagcaatggaggcaccgcatcaaaatggagctggcttttcagtaccggccagataccaaatttacgaatggcagcccaaggacgcatgccctccagtgcgccgtaatgacgttcattcagccgccagctctgataagctgggagatggctcaggctcatttccgattgcacaaacgcgagcgtatctcgtgcacgctttagctccgaacagaaacagatatcaaaactaaaacctgcctgcttgagacgctggcctgctcttcttgcttcctcctcaccttgcaagctgagtgcaatatcactccaaccagtaaagtgcctgtctttattccagacacttttcccatggcggagcaataccagccgggttaacttttctgttttactcacaaatgattgtagatttttagagacagtaaagttacaaaaatattaaacatcaatcccgtatattatttttctttactgccgccgtagattcctgccagatttgcctcaatgcagaccacaatccattacgattggtttgtaaaatcaattggttatcaccaaattcctgtgcaagccgcctttgagccttgccgagattgtggtagggcatgctcatgaaaagatgatgtgtagcatggtaacgtagcccgaccggcgcccataatccggtcataaaattaccgggaacattgatggaatcaagatactgctcaaccagtgtcagatgataatcacctctatgacgatacgcatgggcagccagagtgcgcagtgaattcaggataaaaattgcgacagcaaccacataccagagcaccaatacctgccaggataacttccccaatatcacactggctacgacaattactgcaaacaaaaatgtcgccagctcctgcagctgccaatgatgatcgttacgtacagcatctgcccgacgaatataggctggattaattgtcagcgaagaagcacgctcccagataattttccgcaagggtggaatcagatacgagattggagtcagcaacaaaaaccgcatcaccagcagtagcggcagaatcagtgaaagcagtacataacctactaaccctaccggatgttgagtggcaaagggaagatattccccatcttcagaggtgccatagatagccggtttatgatgatcataatgcacgccgtcataggtaaaagacgggatcataaatggaatgccacaagtcagattccacaccagtcggaatattttgaacgttccacgctcaagatgggcaagctcatggataaaaattgcagcacgataaaaggcaaatatcgctacccaacaagaaagtatttgccagatggaaagccatggcatgtggaatgctgtcgcgaaagctgcccatcccagcatgatatgaaacagaaaatctgaccagtaaattccaggatcaggtgtcatcaggtcacgcaccaatgcacgcgcctcatataagggaaaattgacttgtatcgtattatcgttatcagcagccatgagggaaaatatttttcaaatttatccccaattagaaatcaggtgtttgattatcagctggtttatatctggattggttccgttaattttgctgaaatcaggcacaccgggccaaccagcgtcaaaaaaagttttaccggcaaattctctggcttgtgcataacgaggaataacgtgaaaatggacatcagggtcaaccatcatcaacatcaggtaattcaatttgtcatactgaaaggcttttcttaaagcaacgtcaatcttgccagtcacaattttcagttcagtaaaactggcactgctcaacgcagaaaaactttgtaccggttcatgcgcaatcaaaaccaaagcacccaaggtcaactgggctggacgcaacagcacgctccaatactgaaactggcaaataactgtgtctggcgcgccaaacttctgcatggtgccattaaatattttcatactcactatcttttctccagatcagcctggtgcctgcaggaactgatcagattgcgattgatctgcagcaatctccacacaagggaagtagtttctcgccctctgtaaatcctgaataaagtcaatttcacaccagtgattaccaacaaccgagtggctgcttactataccttgtttagctaacgcactgataatagccagataccacgatccaagtttctccggttcgcgtaatgcctgctccactgcattacggaaaagccgcgcaccttgcccgctgaaacgaatcagtccaattgattctgcattggtttcctctacagacagtttcttgctgacctgtttcacttggcctagcagatcaagctgaaccttcatgtcatcgtcatcaaatttttctttaaaatcaatgcataaagtaattggtgctatttgtgtgcgcaacacacctgacagcaaattatcttccagcagcgtatcaccattcagtaatagaaatccggtattcatctcttcacgtgcaatccagcaactggccagattatccgctacttcgtagaaaggattaaatacaacccgaatattagaatgattcggatagcgttcggctaacagcatttccactttgccaatttggaagccggcgacgattacgatttcctggataccattggccagtaaggtatcaatctgccaagcaatcaccggttttcctgaaactggcaacaggcatttaggagtatcttcggtcaagggtaataatcgtctaccctgcccggcactcagaatgatcgccttacccggaaaatcatcaatttgatcagtcatttttatatccggctctattcaattacgggttctttcgatatattcacacatttagcagtacgctcatttttctcaattcatccgctatatgcctgatagcagaaagaaaagcgtcaacttcttcaattgtattatctggccccagacttgcccttaccgcgcatcgcgccagaatagttggtacattcatggcttccagtacatgacttttaccgggtacagcactggaacaggcagcgccactggcaactgcaaatcctcttttatccaggcgaacaactaaggtatcgccttctatatctggcaatgcaaaataacaggtattaggcaagcgagaagcatccaatccaaatgccgtggcacccatcgccagcaaaccatgctccagatgatcacgcaacttcaccgtgtgtgccattgattcagttagcctggatatagcaagttcacaagcagcaccaaatccgacaatagctggcacattctcagtaccggagcgcagcccatcttcatggccgcctccgtaaatgagcggtttaagtggaagacgctcatcaataatcagcgctgcagcccccttgggcccgtaaattttatgtgcagacaacgtcatggcatgtatgccaagttcatcaaaatttaccggaactttaccaaatgcctgcactgcatcggtatgcatccaagtaccctgtgtctttgcagcttcggcaatggaagtaacatcctgaatcacaccagtttcattatttgccagcattactgaaaccatggctggtttttctgcaaccagcatttccgttgcttcatccgtatttacctgtcctgcagcatccacggacagataatgcagttgccatttctcaccgttttttcttgtcagtgcctgcgcggtacgcatgacgcatggatgctcaattgcacttacaatcagtgcagaaggcttcaggctatctgctacaccgcgaataaacaagttatttgcctcagaaccaccactggtaaaaatgacctgtgcaggccgagctcctaccgcctgagccacctgttcacgcgcctgatcaattgctcggcgtgcagccaatccaagggaatgactgctagacgcattaccataatgttcatggaagtaaggcaacatcgctgccagcactgcatcatccactttggtagtggcattatgatcaaaataaacttgagtcatgagatgtaagaatcggttagtacaccggatagcttgtatccggcaaactcctgatatagaaatcaataaagaacgagtatagtcaaatttgtggactgcggatacgatctttcaaatatctgcctcaaattaactggcaacagataaatcactcgatggtgcaatcacaagatacctgcccagagggtgatgcatctaatttgtacggtggcaagaaaagaagaggtgtttttggcgtatcttatggcaagcaagcaagcaagcaagcaagcaagcaagcaacgccatgccagtgaataaagcgatggtgggtattcccccgtagtccggcggtaaatccctccatgggatttctgtttgtatcatccagaaaaacatgcctgcgatggggttgtgttttgtgttatatgagatccttttaaaaataaaagaatctcatattttcaatctcgtgactacgccatctaagttaaaatcgacatttctcattcgcgttgactgggtagggtgatcagggtagaatcgccgcacttttttagggacatttcactttttaatttttcgacgtatccgcttggattatgtttctgattaagcacagaccgcttggtattgttctgctctggcaactgacatttgcatttgtggtggcgattgtttgtggtttgttgtcaggtgtaagtggcgcattctctggtttttttggtgcattggtcagcgtgattgcgggaggtgcttacgcagttttggtatcgaggcacagcggatattctgcaggtgatgttttacgcacggcacttcgtgcggaagctgtgaaaatatttttaatagtaatgctgttatggatcgtgtttgcagcatataaagatttgaagcctgttatatttattggttcgtttactgttgctgtattgatgtcaagcatggcagtgtttgtttcagaaaagcctcgtgttaaatgaacatatcaaataacgtaataaaggtaggtagatgtcaactgaagctgagttaaacccaacatcgtacatacagcatcacttaacacatatgacgatgagcatcggagagggttcattctgggttttgcatgtcgatacactggtgatgtcgttgatacttggcgtgatcagtcttggttttatttggatggttgttaggaaagctacgtcgggagtccccggtaaaacacaggcttttgtcgagttgttgatagaatttatagatgatcaggtaaaaaatacatttcacggaaatcgtcacgcctttgttgctccggcggcgttaacaatttttgtctgggttcttctgttaaattccatggattttttgcctgtcgatattatggcgtggatttatgagcacttattcggcctgcataactggcgaggtgtgccgacagcagatgttaatacaacttttgcacttgcgctttctatctgggtgctaacaatttatttcagcatcaaagtaaagggttttggagggtggattaaagagttgttttgtgcccctttcggaaagaatcctatattgtggccgtttaatttgttgttgaacctgattgaatacatctcaaagcctttatctcattctttgcgactttttgggaacatgtatgcgggtgagattatttttatgttgctcggtatgtgggcggcaacagggatcgccggtacaatttttggagctgtccttggtgttggttgggcaatttttcatatactgatcgtggtgttgcatgcgtttatatttatgatactggctgtggtttatctttccatggcgcatgaatcacattgatttaaaaggttttttgttattaacttgaactaaagggaaaaatatggataacgttcaatttcttgcaatgattcaggcgtataccggaattggtattggattaatgattggtttgggtgcagcgggtgcgtgtattggtgtgggtgtgatgtgcggccgatttttggaaggtgctgctcgtcagcctgaaatgattcctactttgcagggtaaggtatttttgttgctgggattgactgatgcttcatttattattgccgtaggtttagcaatgctttttgcatttggtaacccattgttagctgttgttcagtaaattattgaattagttgccgaatgtaaataaggggctgttatgaatataaatttcacattggtctcgcaagcgatagctttttccatatttatatggtttaccacaaaatttgtgtggccgtatttgttgcgtgctattgaagagcgtcagcagaaaatagcggatggcttggcagcaggtgagcgtggtaagaaggaattggagcttgccagccagcgttcatcagaggtattgaaagaagccaagcagcgtgcgggtgagatcgttattcaggcggaaaaaagagcttctgacatcatagaagaagctaaaaagaatgctcgagttgagggcgaaaaaattctagccggagctaaagcggaaattcagcatgagatttttagtgcgcgtgaatcattgcgtcaacaggtggcgggattggcggtgcaaggtgcttcaaaaattctacgtcgtgaagtaaatgccaaggctcatgctgatctactggcatcaatagagacagagttaaaataaatggctgaagcgataacaatagcacgaccgtatgcagaggcagttttcagacttgctcaaggaagtggatctttgtcactctggtcggagatgcttgggattgtcagctctgttattcaggaatctcaggtaaatgctttaatcggcaacccacaaatcccatcaataaaactgcgtgaaatcgttttcagtatttgtgataaagaactaaatgaagatggaaggcgtttaatttcattgttgattgaaaatggacggctacttgtattgccgcagataagcgagctgtatgagcagcttaaggcgcaacatgagagtgtgcttgaagcggaaatagtatcagcatttcctcttgaatcgtatcagctggaaaagctaatatcggttctggaggtaaaatttcagcataaagtaaaggctcaggtaagtgtggatagtgggcttattggtggcgtaaaaattgaaatcggtgaccaggtgattgacagttctgtgtccggaaagctggaagctatggcggcgactctcaaaagctaggagtgatataaaatgcagttaaatccatcagaaatcagtgaattaatcaagagtaaaattgaaggcctttccgttacatcggaatttcgtacgcaaggaactattgtatcgttgacggatggtatcgttcgagtgcacggtctttctgacgtaatgcaaggcgagatgctggagtttccgggtgggacgtatggcctggcgttaaatttggagcgtgattcggttggtgcggttatcttaggtgcttacgaacatcttacggaaggagatatcgtaaaatgtactggcagagttcttgaggttcctgtaggagaggctttgctgggtcgtgtcgtaaatgctttagggcagccgattgatggtaaaggacctgtggctgcacagggaatggagccaatagagaaaattgctcctggcgtcatatcacgtaaatcagttgatcaaccaatgcaaactggcttgaaatcggttgattcaatggttccgatcggaagagggcagcgtgagttgatcattggagatcggcagacaggtaaaacagcagttgcaattgatgcgatcattaatcaaaagggtgaagatatgatctgcatctatgttgcaataggccagaaagcttcatcaattgcaaatgtggtgcgtaaactggaagaagttggtgccatggcatataccattgtggtagtggcttctgcttctgaatcagcagctatgcagtatattgcaccttattctggctgtaccatgggtgaatattttcgtgacaaggggcaagatgcgctgattgtctatgatgacctaactaagcaggcatgggcttatcgtcagatttctttgttgttgcgccgacctcctggtcgtgaggcttatccgggagatgttttctatcttcactctcgtttattagaaagagcagcaagagtgaatgctgattatgttgaaaaagctactggtggaaaagtaaaaggaaaaacaggatcgctaaccgcgttacctattattgaaactcaagcaggtgacgtaacggcatttgtacctactaacgtaatttcaattacggatggtcagatattccttgagtctgatttatttaatgcaggtatacggccggcaatcaatgctggtgtttcggtttccagagttggaggcgctgctcagaccaaggtcatcaaaaaactaggcggtggtattcgtttggctttggcgcaatatcgtgaacttgctgcttttgcacagtttgcttctgatcttgatgaggccacacgtaagcaactggagcgtggaaaaatggctacagagttaatgaagcaggcgcagtacgctacattaaaagtttcagagatggcattaacactgtttgcgttgaataaaggttattttgatgatgttgacattaagcgcgctcttgcttttgagtctgcattaaaaagccatgttcgtagtcatcatgctgcaatactggataagatcgagacaaccaaggagcttgacgctgaaacagaaaaggcgttagaagcagctattcaggaatttaagcagaacgggatatactaacccatggcaagcagcagagaaatacgaaacaaaatcaagagtattaaaaatacgcaaaagattacgcgtgcgatggaaatggttgctgcctccaagatgagaaaagcacaggatcgcatgaaaaaggcgcgtccttatggcgaaaagattcgtaatgtggccgcacatatgagcaaggcgagtgttgagtatcgtcacccttttctgattgaccgtaattctgttaaaagagtaggaattattgttgtgacatcagataaagggttatgtggcgggctgaatactaatgtattacgtagagctctcaatgaaatacgagtttggggagccgaaggcgagcaaatagaagtttgctgcataggtaacaaaggcttggggttcatgagtcgtctcggtgtccgggtgatttcacaggttactggcttaggtgatgcacctaatatggaaaaactgataggcgcagttaaggttgtcttggatgcttatactgatgaccattttgacagggtatatattttctataaccgttttgtcaacacgatgaaacaaataccggttatggagcaacttctcccgctgactgacgagcatatgagggatgatggtaatgaagccaagcctgctcgcgctccatgggattatatttatgaacctgaagccaagcctgttattgacgatattatgattaggtatatagaggcactcgtatatcaggcagttgctgaaaatatggcttccgagcaatcagcaaggatggttgctatgaaagcagcctccgataatgctggtaatctaattgacgaactgacactcatttataacaaatctcgtcaggcagctattaccaaagaactttcagaaatcgtcggcggagcagcggctgtttaagtattgtaaatttgtatttagggaaaagtgatgagccatcaaggaaagatcgttcaatgcattggcgcggtaatcgacgtggaatttgcatcagagggaataccaaaagtatatgacgctctggtaatggaagggtcggagttaacactggaagtacagcagcagttgggagatggagttgttagaaccattgcacttggatcgtcagatggtctgaggcgaggaatgatggttaccaatacccaaaagcagatatcggttcctgttggtaccaagacgctggggcgcattatggatgtcctcggtaggcccattgatgaaatgggagaaatcggtgcagaatcattcatgcccattcatcggactgctcctgcttttgatgaactgtcagcctcgacggagctgctggaaactggaattaaagttattgatttgatttgtccttttgccaagggaggcaaggttgggcttttcggcggtgctggtgtaggaaaaactgtcaacatgatggagcttatccgtaatatcgcaattgagcatagcggatactcggtattcgctggtgtgggcgagaggacacgggaaggaaacgatttctatcatgaaatgaaagattccaatgtattggacaaggtggcattagtttatggacagatgaacgagccacctggaaaccgtttacgtgttgcgctaacaggtttgacaatggctgaagcatttcgcgatgaagggcgtgatgtcttattctttgtagacaatatttatcgttacactctggcggggacggaggtttctgcattattagggcgtatgccatctgcagttggatatcagccgacacttgcagaagaaatggggcgtttacaggaaagaattacttcttctaaaacgggttcaattacgtcaattcaggctgtatatgtaccggctgatgacttgaccgatccgtctccggcaacgacgtttggtcaccttgacgctactgtagtgttgtcgagggatatcgcttctcttgggatttatcctgctgttgatccactcgattcgacttcacgtcaattagatcccctggttgttggcgaagatcactacaacacagcgcgtgaagttcagcagacattacagcgttacaaagagctgcgtgacatcattgctattttaggtatggatgaactttcaccagaagataaattatcggttagtcgcgcacgaaaaatacaaagattcctgtcgcagccattttttgttgccgaagtctttacaggctcacccgggaaatatgtttcattaaaagaaaccattaagggcttcaaaggaattattaatggtgagtatgatgatattcccgaacaggctttttacatggtaggcggaattgaagaagtgctagagaaggctaaatcattccaataataaatatctattttataggtaatcaatgggtacgatattccacttggatatagtgagtgcagaagaatcgatttattctggacctgcagaattcattgttgctccggcagtgatgggggaggtaggaatatatcctcagcatacccctatgcttactcgtatcaaatcaggtgtggtacgagtaaaggcaccacttcaagatgatgaagaaatttatgtttcgggtggtatgcttgaagtacagcccgatgttgtaacaattctggcagataccgctgtgcgggggcaggacttagatgaagccaaagccttggaggcgaagcgcaaagcagaagaaatcatgaaaaataagacttctgatattgaatatgcacgggcacaagctgaattaattgaagcaacagcccagctggcagctattcggaagctaagaaaaaggagacactagagttatctaattagtgttcaatggtaatgtgtttataaaaaagggcgattcataatcgcctttttttataaacagaaggtattttgttagctgtcttatttattccaccctttccctttccagtacacttaatttgcgtgtgtttgtcactgataattgtgcaagagtgatagataattcttagtttagcagatacaccgttgactgcataaccataaacaaaagcatttcaagtaaggattaactcgtgttacaaattgatgtagtcatactggcagctgggatgggtaaaaggatgcggtcaactttacccaaggttttgcatcctttggccggaaaacctattttattccatgttttagatactgcgcgtattctgtctcctacaaaaatatgtgtgatttacgggcatggcggagaactggttcggcaaactgttggtaatgatcctaatcttatctgggtaaaacagacacagcagttggggacggggcatgcagtaaagcaagctctgccttgcttggggaagaatggtattacgctggttttattcggtgatgtaccgttagtaaagagtaatacactcaaatccctgattgataaagcgtgtgaagatagcctggctttgctgactgtagaattaaatgaccctgccggttatgggcgtatcatacgcgaccctaaaacaaatcgtgtccaagcaattgtagaagaacaggatgccctgccatcgcagaagaaaattcgtgaaattaacacaggcatcatggttcttccgaatatgtatctggagagctggctcgataggctaagtaatgccaatactcagggcgaatactaccttaccgatattattgcgatggctgttaatgatggagtccaaatagagacttccagccccgcatctgattgggaagtggttggtgtaaacgacaagattcaattgtctaccttggagcgcgcccatcagcaggatgttgcaaaggggcttatggagcagggagtgatgtttgctgatcctgcgcgctttgatgtgcgcggccagctgatttgcggacataatgttgaaatcgacatcaactgcgtatttgaaggtaatgtacgcttgggggataacgtgaagattagcgcaaactgcatacttagaaacgtggccatctcggatggatcgattgtccatccttttagcatgatagaagatacagaggtaggtaaaaattgccgtgttggcccttatgctcgcatccgaccggggacacaactcgacgacgctgtacatgttggaaattttgtcgagattaaaaatagtcatatagcttctgggagcaaggttaatcacctcagctatattggtgatactgaaatgggcagacgggtgaatattggtgctggtacgattacttgtaattatgacggagcctttaaacaccaaacgatcattgaagatgacgtgtttattggctctgattcgcagttgatcgctccgataacggtggccaagggatcgacaattggcgctggatccactattacgcgtgatacgcctgaaggtcagctaacattatccaggattaaacaaataagtattgccaactggaagcggccgaaaaaaaacaaggattgatgctgtttatacaaggtagagctgagtagaggataggttatgtgcggtattgtaggtgcaattgcgaaaaatgatgttgtaccatttttattggaaggattatccaggcttgagtaccgtggttatgactcggcaggaatcgtagttgcagatggtacgttgcatagattgcggacaacgggccgtgtttctgagctgagcaagctggttcatgccggaggaacatcaggacttaccggtattgcgcatactcgttgggcaacgcatggggcgccttctgagcggaatgctcacccgcatttttctggtgatcaaagaaaaattgctgttgtacataatggtattatcgaaaatcacgaaactctccggcaacgtttagaacaggagggatttaaatttctgtcagataccgacaccgaagtaattgctcatttgatttcgctttatcttcgtaagaccgatgatttgctggatgctgtctgccattcccttgaggagttgcagggcgcatatgctatcgccgttatggaagaggcgcgtcaggatcgcattgtcgttgccagaaatggggctccactcttgctcgggatagatgatggtggactttacgctgcttctgatgcctctgcactggtacagattacgcagcggattgtgtatcttgaagaaggagatgtggcggagttgtccagtgatggatatcgtattttgaattgcctgaatacggtaaacggctgtgaagtcactcgtgaagtaattgagagcagcttgacgcgggatgcggtggagctaggttcatattcgcattttatgcaaaaggagatctttgagcagccggttgctgtggcaaataccctggaaatggtattgaatgtacaatcagtgtctcctcaattatttggcagtgaagcacaaacgatttttgcccagactcggggaatattgatactcgcttgcgggaccagctatcatgctggtctggttgcaaaatactggttggaaacaattgcaagacttccttgtaatgtcgagattgccagtgaatatcgatatcgcaatccaattgctgatccagctacgctggttattggtatttctcaatctggtgaaactgcggatactctggctgcgctaagttatgctaagtcattaggccatcgctacaatttagcaatttgtaacgtgccggaaagtgccctgattaggcaaactaatctgcgcttcctgactcgtgccggccctgaaattggagttgcctccacaaaagctttcactacgcagctggcagttttgctgttgtttacagcagtgcttgcaaagatacgcaacaaattgccgactgaagacgaacagaaaatgattgccgcattacggcatttgccagttgcgatacagcgtacgcttcaaagtgagctggaaattaaaaaatgggcaggagatttttcccagaaacaccatgctctgtttctggggcgcggcgtacactacccaatcgcattggagggggcgctgaagcttaaggagatttcgtatattcatgctgaagcttatgccgcaggtgaactcaagcacggccctcttgcgcttgtagacagtggaatgcctgtagttgccatagctccgaatgatgtgttgctggaaaagctgaaatccaatttgcatgaagtgcgtgcacgcggaggagagttgtacgtctttgcagatgcagattcacgtattgaggagagtgaaggggtgcatattattcgcatggatgaatatggaggtgtacttagtcccattttgcatactattccgttacagctattggcttatcacgtggctttgcaaaagggtaccgatgttgataaacccagaaatctggcaaaatccgttacggttgagtaattgagctgctttgattttcagcttgcgattaaagtatccaagtactctctggcccgaccaacaaggcacacggctgcggcatgctttatacaatgatgctggaatggtagcattgtagcctttcaatgattagaggaagtcaatggctggtcatagtaagtgggccaatattaagcataaaaaggccgcgcaagatgcaaaacgaggaaagatttttactcgtctgattaaggaaattacagttgctgcccggctgggtggcggagatcctggtagtaatccccgtttaaggttggcgatggataaagcctttggacataacatgccaaaggataatgtcgagcgtgcgatcaagcgcgggtgtggtgagcttgaaggcgttaactatgaggaaattcgctacgaaggctatggggtatccggggctgctgtcatggttgattgcatgacggataatcgtacacgaaccgtggcggatgttcgtcatgcatttaccaagcacggtggcaacttgggaacggatggttctgtctcttatttgttcacacattgtggccaattattatttgcgccagatattgatgaagcgcggttactggaagttgcgctcaatgcaggtgcggaagatgttatcgataatgatgacggcagtctggaagttattaccagtccggatacatttgtagcagtcagagacgagctggaaaaggctgcttttaaggctgaactggctgaggtaacctggaaaccggaaaacgaaatcttgctgcagggtgatgatgcagccaaaatgcagaagctgttggatgctctggaagatatagacgatgtacaggatgtttatactactgcagtcttagacatctaatcttgttaccttccggcaagagcatccgcatactggggattgaccctggcttacgtataacaggttttggtgttatcgaaaaaaatggaagccaactaacctaccttgggagtggctgcgtagtaaccgaaaaatccggtttaccggatcgcttgaagaccatccttgatggactgaatgaaattattttgcagcaccaaccggagcaggttgctgtagagcaggtttttgtcaatatcaatcctaaatcgacgctgttgctcggacaggctcgcggtgccgcaattagcgcagcagttcttcatgaactttccgtatacgaatatactgctctgcaaatcaagcaatctgtagtggggaatggccatgcccggaaagagcaggtgcaggaaatggtgatgcgattgttgaggctaggagaacgccctcgcccggatgcggctgatgcgttggcctgtgccatttgccatgctcatggaggaacaggcttgcttgccctgagtgtgcgtaatcatccgaaacgaggtggttgtccgtgattggtagaattaccgggttgctgcttgaaaaacatcctccgctggtgttggttgatgtacaaggtaccggttatgaaattgacgtgccgatgagtactttctgcaagttgcctgatattggcaaaaaggtaacgctccatacccatttctgggtacgagaggatgtacatttgttgtttggttttatgacggagcaggaacgtgcgctttttcgccagcttacaaaaatttctggtattggtgcgagaacaggtttggcgattttgtccggcttgagcgtcacagatctccatcaagctgtggtatcgcaggacagtattcgcctaaccaaaatccccggaattggaaagaagacggcggagcgtttattactggagttgcgcgataagatcgatccagtagcgatcctttctgaagcgggagcggctgcatctaacgttgacaaagacattctctctgcactattagcactgggctataatggccgcgaagttaaccgggcattagagcaattgtcggaaggtgttacggtatctgacggcattatgcagtcacttaaatttttgtcgaaagtaaaataacgttttggctgatcttaaatgattgaatcggatcggattatcactgcctctccgttttcttcccaagaagaagtaatagaacgcgcacttcgtcctgttcagctggatgactatgtcggtcaggaaaagatccgtgagcaattgaagatttttattgaggctgccagacaaaggcaagaagcactggatcatgtgctgctgtttggcccgcccggattgggtaaaacgacactggctcatattattgctcgcgaaatgggtgtaaatttgcgccatacttccggcccagtactagagcgcgcaggtgatctggccgctttgctgaccaatctggaagccaatgatgtattgttcattgatgagattcaccggctttctcccgttgttgaggaaatcctgtatccggcgatggaggattaccagttggatatcatgatcggcgagggagtggcagcaagatcagtcaagattgatttgccaagttttactctagtgggggcgactacgcgagcgggtatgttgaccaacccactgagagaccgctttggaatcgtttcccgtctggaattttatacttcagatgagctcagcaagattgttacccgttctgccgggttacttgatgtcgatattactgccgatggcgccagagagattgcatgcaggtcacggggcacgccacggatcgccaatcgattactgcgcagagtccgtgattttgctgaagtccgggcgaacggacgtattgatcgccaggtagcagatgctgcattgcagatgctggatgttgatgctgctggtctggatgtactggatagaaagcttctgctagcagtgctggaaaaatttggcggtggtccggtaggagtggataatcttgctgcggctatcaatgaagagcgtgacacgattgaagaagtgctggagccttatcttattcagcagggttttctgcagcgtacgcctcgtggccgaatggcaacaaccatgacttatcagcatttcgatatcatccctttacagcaagccgctacacccggtctgtttaacccagattaaaagctagtaataacccgcaaaccaagattcaatatctttctgaagagtatttttacaaaaatgaaagctgcttttttttatcccgtgcgtgtctactaccaggatactgatacgggaggcgttgtatatcatggatcttacctcaacttcatggagcgcgcccgttacgagtggttgcgcgatctggggtttacggtggataccatgatccggtcacataaaatgatttttcttattcgttcactcagtatcgagtacttcaagccggctgtactagacgatttgctggacataactgtgaaggtaacagaaatgggcagaagccggataacgttgcagcagcagattttacgtgaacaaggtacacttgccagcgcaactgttcatgcagtatgtgtcggatcagatacgttgaaaccgattagtattccagtgccacttcgtcaaaaaatagaaaacggccatcatgagtaaaaccatcacccaggatttatcatttcttcacctgattagcggtgcaagcctcccggttcaactggttatgctgctattgttgttggcttcatttatttcctggtggtttattttcagaaaattatttaccctccgtcaggaaatcaagcaaaccgatgaatttgaaagcgtattctggcgcggatcagatttgaatgcgctgtatcagcgagcggccagtgcgcgccatgcagcaggtagtatggagcgtatttttgaagctggatttcgtgaattcaccaaataccagtcggggatcgatatcggtcccatcatggacagtacgcgcggcgcaatgcgagctgtttaccagcgggaaatggacagacttgaatcacatttatcgtttctggctactgtaggatctgtaagcccgtacgtaggattgttcggaacggtgtgggggattatgaatgcctttcgtgagctgtccaatgttggtcaggcgaccatcgcgcatgttgcgcctggtattgctgaggcgctgattgcaacggcaatggggctttttgcagcgattccggccgtgattgcctataaccgctatgctagtgataccgctcagctcgccactcgctatgaaagttttatagaggaagtatccaacgttttgcagcgtcgtgtggccaaacctcgggatatggcaaatttctcatgattccgcgtcgcagtaaacgccgattaatgaatgaaataaatgttgtgccatatattgacgttatgctggtgctgcttataattttcatgatcacagcaccgcttatccagcccagccaaattgaattgcctgaaatcggtaaatcatctgtacctccagcagagcctttagaagtcacaattgccgcaaatggtaatctcacgttacgtgatcgtgccggtgcgaacagggagcagcaggtgaatcgcaaccagctagtggagctgatcaaggccaggcaggcacagaataccaatcagcctgtcgtgattgcagcagataaaaatgttcgttacgaagaggtaattcaagtaatggatatgttgcaacagcaacaaatccgtaaaatcgggttgttaaccaagtcaaaataaactatcggggtgtatgcgcaatggtccggctacccgggaataagaacgaaccgggaaaactgcgtgcggcattgtttgccctgttggtgcatgcagcatttctcgctttgctggtatttggcctgaactggaagaatgaagcacctgaagcgatgtccgttgatttatgggcagatctgcctcaacgtccgatcaagcctgtatcacctgttgcgcaagtaacatcccagcccgaaccagctaagccgcaatcccggccacaacaaaaaactcaaccccagcctcagccggtgatcaaggcgacaccccctccggtgcgtaaacccgagattgcgcttaaggataaaacggaaaaaccacaacctaaagaggaagtgaaaaaactggaaccggtgaaaaaggaagtgtcaaaagaagaaccagccaagaaaccggtagagaaaccagcatccaaggaagaggtaaagaaaccagagttggttaagaaagaggcacccaaaactgaatctatcaaaaaagtcgaacagaaaaccgagaaaaaggatgacgctcggcagcaggctgaagcacaaaaacaggatcagcagcgtgaacagcagatggctgcagcgaaggcagcccaagccagagcgctgggtgaaatcgaaaaatacaaagccatgattcaggccaagattcgtagccggattatcatgccgccggatcttccggggaaccctgcagttgagtttatggtgaccctgctaccgggaggagatgtgctgacagtcactttgcgcaaatcaagtagttatactgcttttgatgaggcagtggaaagggcgatttatctagcgaagcccttgcctttgcccccggatcccggattgtttaatgagtttcgtaatttaaatattactgtttattatcgtgaatagtttttgacctacctctacaacatggcatggtgattcatatgcgtaattttttgtattgtactggtgtgtttctgttgttatggatgaatacaccgctacaagctgctcttaatattgaaatctttggtggtggggctaacaggatgccgattgccgtagctccgtttaatggcgaaaaagggcttccccaggatatttcggcgattgtatcggctgatctggagcgcagcgggatatttaaactggttgatccgttggggttaacctcgcaagagccagtgagctatgtcgattggctggggcgaggtgcgagtgcgctggtcatcggcagtacatcaatgttgccggacgggcgggtggatatccagtttcgcttgctggatgttgccaaacaggttcaactgactggatttagcggtaccgttacgatcgaacagctgcgtgcctttgctcatcgtattgcggatattgtgtatgaagcattgacaaatgaacctggtgtcttcagcacgaggattgccttcgtcagaaaacagggaagccgctatgcattgcaagtgtcagattatgatgggttcaatgcacgttcactgatcgagtataccgagccgatcatctccccggcttggtcgccagatggcagcaaaattgcttacacttcctttgaaaagaaaaaaccagtggtttatgtgcaggcgctggcaacccgtgaacgtaaggtggtagcaaatttcaaaggaagtaacagtgccccggcctggtcgcctgatggtagcaaattggcagtggttttgacattgcatggtggatcacagatttatctgatcaatgcggatggtagtggactgcagaggatttcacaaagtccggggatagatacagagcccagtttttcaccggatggaaaatggctgatatttacttctgacagaggaggaagtccgcagatatatcgtatgccggtatctggcggtgctgctgagaggttgacctttgaaggagattacaatgtcagtccgcgttatagctcggatggaaaacggtttgtctatatccacagaaattctggccgattcagcgttgctgtacaggatttatcgactcgccagatgcaattactaacggattccagttttgatgaatctcccagtttttcccccaatagccgcatggttctgtacacgacggaagtgagtgggcgtggtatattatccatcgtttccagtgatggccagacgagaagtcgtttttcgcaggaagcgggtgatgtccgggaagcggtttgggggccgttgctgaaacagcggtaatgtggataagaaacgctcactggatgtgggttaattatttatttatggtgagaaatgaaaaaatttttagcagtactggcgattagcctgctgtcagcttgcgctagcgataatgcacaacaaacttctgatgttgaggatcattcgtatagcaggggaggagaaagtgagggtatgcgaagcggtaccggatcagatagatttgggatgaatcctttacaggacccgaacaacatattatcccggcgtagtgtttactttgattttgacagctatacagtaaagggcgagtaccgcgacctggttcttgcgcacgctgcctatttgcgtgacaacctgaacgcacaggtgttactgcaaggcaatactgatgaacgtggcagccgggaatataaccttgcacttgggcaacgccgagccaacagtgtgaaggatatcctactgctatccggtgcccgtgatcaacaggttgaagctgtcagcctgggtgaagaaaaaccgcgtgctctggggagtgatgagtcatcctgggctgagaaccgacgtactgatattctctatcaaggagagtattaatgtttttgcgcgctttcttgccgttacttttgcttcttggttgtagcgttgcacaggctgcactgtttggtgattctgaaacacgtgaacagttggatgcgctgcgcgcaaaggtattggaaatggaagcgcgcatgcagcgtacggaagaagtttttatgggccaatctctaatcgaattgcattctcaggcagaagccctcaaggaagaaatgggaaaactacgggggaagatagaggtacttgaggatgagaatcggtcattgcgcaagcaacaaaaggatttctatctggaccttgataaccgactgcgtcagattgagcctggttcagcgagcgtctctgtgccggactccgaaatctctgtcccggcatcagaaccgccagctgctgatataaaaaatactacacctctcaaagcgcctgtgattctgcaattaccggatacagcgcagcgcaatcgctatgatgcagcctatgctttgtttaaggatggtgattattccgggtcgatagccagtttcgagagtttcttgtcccagcatccccaatctgctctggcacctgccgcagcctattggattggaaacgcacattatgcaatgagaaattttgacaaagcgattgctgcgcaacagcgattgattgaaacgtatcctgatagtcccaaagtaccggatgggcttcttaatatggcaagcagtcaggttgaaatcagtcaaaaggctgctgccagaaaaacattggtaaatctcattacgaactaccctggtactgaggcggcagaaaaggctaagcgtcgtttgggatctctcaaatagacttgactgtctatgctgctaaaatttagcacaacttgttctactcatttttaaattccttttggcaagcagagggaatgttccagttccgttaggatccgatgttacgagttacggaaattttctattcgcttcagggggaaacaagccggatgggattgcccacggtatttatccgcctgaccggctgcccgttacgttgtggatattgcgataccagctacgcattttctggtggcgaaagtatggatatcagtgaaatcatgcgcaaagtggcttcgttttctccgcattatgtcactgttacgggaggggagccgttagctcaagccgacagcctgactctgctgacagctttgtgtgatcgaggatattccgtttctcttgaaaccagcggagcactggatatttcacgagtagatacgcgtgtatcgagaattctggatatcaaaacaccaggttctggtgagatggaaaaaaattactggaataacctcgactgcctgactgctcatgatgaaataaaatttgtattgtgtgatcggactgattatgactgggcgatgcaaaaactcctgacgctgaagttagataacatctgcccggttttgttctccccggtttataaccagcttgatcccgcagcgctggcggcttggatattacaagatagattgccggttcgtttgcaattccagctacataagttgctctggggggagcgtgtcgggcgataaaacagcagacgggtttgattcatgaaaaaagcagttgtgctgttatcaggagggctggattccactacaacacttgctattgccaggggaaatgggtttgcctgttacgcactcagtgttgattatggtcagcgtcatgctgccgagctagctgctgcaacgcgaattggtcaatcactccaggtttgtgaacatcagtttctcaagctggatttgactgttctggccagctctgcgctgaccgatccttctgttactgttccgatacatggcaccagtcgaggaattccagccacttacgttccggcccgaaacaccattatgttgtcgctggcgctggcatgggcggaggtgctgggcagccaggatattttcatcggcgtaacagctgttgattattctggatatcctgattgccggccggattatattgatgcttttgagaaaatggcgaatctggccacaaaagcaggaagagaaggcaatcttctaaaggtgcatgctcctttaattaatctgcccaaacatgacatcattcgtcgtggcctggagcttggaatagattacagtatgactgtttcctgttaccaggcagatgcaagcgggtgggcttgcggtcagtgtgatgcgtgccatatccgccgagctggttttgcagcggcaaatattcccgacccaacacactaccaggacaaacgatgattacaatcgactgcgctcgatgcagataccaagctgtttcaccccttgaataacatccagttttgctgcactgacttttacccagggtgagccaaattcattaagaatcatctgagcaatattttctgtgagcgtttcaagtaaagaaaaatgttgctgatcaagcattgaattaattttatacgcgacttgtgagtaatccagcgtatcttcaatatgatcagtcttgctagcctgttgagaaggcaaagcaatctcaaggtttaattcgatggtctgcggaatttttctttcccacggataaatgccaatcaaggtttttattctgaattctttgagaaagatgatatccatggacagactccgggttggcttgggggttacgggtaatacccgggttgcacaattttagtttatttattggaatataaaagttttgatgattacggtgattctgattttttctgcctacttgctaggctcaatttcttttgctgttgttgcaagctggttattcaagcttccggatccgcgtagttacggttctggtaatcccggagcaacgaatgtattgcgtaccggtaagaaagcggcagcggcagtaacattattgggagatgcaggtaaaggctgggtagcggttgtggtcgctaaatatttgggtaatgttctgggattaggtgatgaggtcattgccagtgcagcacttgcagtatttctgggacatttatttccgatttttcttgcgtttaagggtggaaaaggcgttgccacatcggcaggcatactgttaggattaaatctgtggttaggtattcttgctatattaacttggataatcgttgcattggtttcgcgtatttcttcattgtctgccttattgtcagctctgcttgcaccgttgtacacttattttttattgcagaaagaaatgctgacaataactgtgctcatcatatccatactattgatattaaagcatcaatcgaatattgctaacttgatcgccggcaaggaaacaaggataggcaaaagtagctaatttcaagctgcatattctcataaatcttccaggttccagcgagccttgatggtaaagctgccatctgatccaggtggtttttcgttgagctgctgcaagcgtaatgcgccggctaaggcgatcattgcaccgttatcagtacaaaattccagctcaggaaagaagacggcaatacccgttcctaccaggtgatgttgcagtttttggcgtaaacggctatttgcgcctacaccgccggctacgaccagttgttgcagtctggtaatttttaaagcagcgatagatttttttaccagtacgtcagtaaccgcatcttcaaaagcaagcgcgatgtcggcacgagtttgagtatttgctttctgtttattaatgagtaaagctgcggctgtttttaatccactaaaactgaaattcagatcgtcgctgttaagcatggggcgtgggagtttaaatcttcctggctggccctgggttgccaagtctgcgagcaattttccacccggataatccaagcccaatagttttgcagttttatcaaatgcttctcctgcggcatcatccaccgtttcacctaatagcttgtattgcccaatgccttttacgtgcattaattgagtgtgtcctccggatacaagcagcgccacaaacggaaaatcaggcgccggatcagataaaagtggggaaagaagatggccttcaagatgatggatgttcaatacagggatgttgcgtgcaaaagctagtgcattgctaatgctcgcacctgtcaataatgctcccgcaagtcccggaccctgggtataggcaattgcatcaatagtttccagagaagtattcgtttgttctaatacctgtgtgacaaggggtaatacccgacggatatgatcacgtgatgcgagttccggcacaacaccaccataatcacgatgcatgtcaacttgagagtacagagcgtggccaagcaattttcgacgggtgtcatagagtgccacgcctgtttcatcgcatgaagtttcaatacctaatacgagcattttgggatttttggtgggaaatattttttgtagtgatcaaactttcttttggaaaaaaatgattgatgttaaactagcgggatttttcgaggccggttgggcaaacaggctttggagaaagtaggctggtttggagcgaacttgcgttgcttcattattcaaacaaggaatcagtcaggtttataacttagttttaactgcagggcaaaccgattaacgtttgctttgtgtgatatggaaaacaatcaaaggagaccgaaaggaattattactttatgactactgttaaagtcaaggaaaatgagccatttgaaattgcaatgcggcgttttaaacgttctattgaaaaaacaggtttactgaccgagttgcgcgcacgggaattttatgaaaaacccacagcggtgcgtaagcgtaaacatgctgcggcagtaaaacgtacctataaacggttacgtagtcagatgttgccacccaaattgtattgattccatttgttttcctgggtttcatcatttaatgaaattaaggcaaaaaataaccgaggatatgaagtcggcaatgcgtgcaggggacgtgcagcgtcgagatgcgttacgtttgctgcaagctgccttaaaacaaaaagaagttgatgagcggattgagctggacgatggtgccgtagttgctgtgatagagaaaatgcttaagcagcgtcgggattccatttcgcaatatgaagcggcacagcgtcaagatttggcggatatcgaaaaatttgaggtagagattctacaggtgtatatgcctgtagcactaagtgatgctgagctggatgctatgataaacgaagtgattacttcacttggagaaagtgggtcaccaaaaattgggcagatcatagcgctgcttaagtcaaggcttgcaggtcgggcagatatgggaagggtatctcagctggtaaaggaaaaaatcgcatcaaattaagttgaagctaaccggctaatacctgttccaggcaggcatacttcagaagaggtgtgctccgagtggtcttttatcggagatttattacccataaatgattgcgcagccatttattcaggaattgttggatcgtatcgatattgtcgatattgttgcaagacatcttaaactcaaaaaggccggtgcaaattttacagcgtgctgtcctttccataatgaaaaaaccccgtcatttactgtaaattcgtccaagcagttttaccattgctttggttgtggcaggcacggcaatgccattaattttttgatggaacatagtggagtcagttttgtcgaagcagtggaaagtctcgcggcgcatgctggtatgcaaattcctgcttggaagaacattaattcaaaagcatccgattcaggtgaaacttcattgaatgaagtgagatttgatgaggttatacagacatcatctgatttgtatgggcggatggagcaggctgcaaagttttatcgtgtgcaactcaaacaatcagagttggcgattgcttatttgaaagatcgaggggtgtcagggcagaccgctttgcatttcggaatcggatacgcaccttctggctggcaaaatctggctgagatctttacggattatccgtcaggtgattccagtcatgcgctggtgcgatcaggtttgatcgttgctcatgaaagcaaaaaaaactatgaccgtttccgtcatcggatcatgttccctattctcgatcttaaaaagagaataatagggtttggcggacgagcattggatgggagtgaaccgaagtacctcaattcgccggaaactccgttatttatcaaaggacgcgaactttataatctggtatcagccggtccggcaatccgaaaatcaggtcgggtagtcgtcgtagaaggttatatggacgttgtaatgctggtgcagcacggcattgaaaacgtagtggcaactttaggtacggcaacgacgtctacgcatatccagaagcttttacgttatacggatgaagtggttttttgttttgatggagatgaagccggtacaaaagctgcttggcgagcattagaaaccagtttgccgcaactcaaagatgggaaggatatcaaattcttatttctaccggataaagaagatccagatagctatattcgcaaatacggcaaggatgcttttaaaaatctgctggaaaaagctcagctgctatctgtgtttttttgtaaagagttatctagccgtgtgaatcttagtacaagtgagggacgtgcccgattggttcagcaggcagaaccgctgcttgtgcagattaatgctcctatatttggatttatgttaatgaagcgtatttctgagttagctggagtggatcagaatcagctgattgcttttctgaaacccggaaagaagaatcagccttccatatctcgttcaaatgtatccaggcccttatcggttacgccatatcgaaggttgatacagattttgctgcacactccagcttatgtggataagctggatacagatctttttgcattaaatgatggtcaaaatgaggaaaaggcactgctggctgcattggtggattttcttaaaacatcttcctgcacttcgatggatgaattgaattcagtagcaatcatgttgcatcttgatcaaactccgcatcgtgttttattggaaaagattgcccgggatatacatgtaaaagatgtagattgggatatcgatgctgaatttactggagcaatggtgcgattacgagaagctcaacgtaagtcgagagtggctgagttacacaatagaccgcttgcatcacttactccggaagagaaaaaagagttgcgacgattgatactttcttgagctgtggtgtgcaggaccttttacaaggtgatcaaaataaaaaatgtggggtatatcaaattgtgttgccgcgattggttgataagcgatacttttgttcatctattaaaagcgcgtcagaaatttgatataattaaaagctttcggtttgtttcgtctttagtcttaataggtgctctgcatggcaaaagtaaaggtgtcagaatcagctaaaaaaaatacggttacatcacaaaaaacgactgaaacaaaaagtaaaaaaacgcctattacagtccacgatgatgagattgaagtggtagttaagggtgctggcgatatttctgtggctaaatcaggggttgcatctgttaaaaagaaggcgatcaccaggaaaaaatctgtcaagggaacgaagtccagcggtgatctagctgcctcgcccggacaggatgtggtgatgcctgaaacaggagtggaagagtcgaaactcgttgatgatatttctgaaaaaaacaaagtgagcaaaaaagataaaagccttctttcagagaagcaggttattgaattgagcaggagctccgtatctatatcatcgggcgatgatgttgaattacgcagaatgcgtttgaagaaattaattatgcagggtaaggaacgcggttatctgacttactctgagattaacgaccatttgccagatgatatgttggatgctgatcaaattgaaagcattatcagcatgatcaatgacatgggtatttcggtacacgatgaagcgcctgatgcagaagctttgctgatgtcggatacagcgacggcggtggctgacgaggatgtggctgaagaaacggaagcggcactttctagtgtggattcagagtttggacgtactacagatccagtgcggatgtatatgcgtgaaatgggttcggtagggttgttgacgcgagaaagtgaaatagaaatcgccaagcgtatcgaagatggtttaagacatatgatccaggcaatttctgcctgtccgacgattatagaaaacatacttgggctggctgcagatgtggaaagcggccagttgcgtgcagacgagctggtcgatggtttcttggatgacgatacagaggaaatcataggcaagggaatgcctgaagaatcactggatcaggactttgattcggatgaaactgaagaagagcaaatcgcttcggccaatgccgatatgctgaagatgaaaaatgaggtgctggagcgttttgctatgatacgccaaacctatgatgatatgaaaaaaatcattgataaaaagggtggtgggcgccaagacaagaaatataagcagctgcaggaaaaaatttctgccgaactgatggcaatgcgcttctcggccaagatggttgaaagattgtgtgatacacagcgtgctattgtgaatgatattcgcagctgcgaacgcaaaattgctgaattgtgtgtcgtgcgggcaaaaatgccacgaaatcattttattaaggcatttccaggtaacgaaacaaatattgactggatcaactcggaagtggatgcaaatcagccttacagccaatctcttgagcactatcgcccggctgttatggagcagcagcaaaagatgcttactcttcaggaacaggctggtattcctatcaaggaattgaaggaaattaatcgtcgtatgacgacgggtgaagccaaagcacgacgtgcaaagcgcgaaatgacagaggctaatttgcggttagttatatcaattgccaagaaatacactaatcgcggattgcagttccttgatctgatacaggaaggtaatatcggattgatgaaggcagttgataaattcgaatatcgacgtggatacaagttttcaacgtatgcgacatggtggatccgtcaggcgattacacgctctatcgcagatcaggcacgtactattcgtatcccagtgcacatgatagaaactatcaacaagatgaatcgtatctcccgtcagattctgcaggaaaccggacaagagccagaacctgcagtacttgcagaaaaaatggagatgactgaggaaaaaatcagaaaaatccttaagatatcaaaagaaccaatttcaatggaaacacctattggtgatgatgaggattctcacttgggagattttattgaagatgtctctaccatggaaccggccgatgctgcaatttatgcaggattgcgtactgtcacaaaagatgtactggactctttaacgcctcgggaagcaaaggttttacgcatgcgtttcggtattgaaatgaatacggatcatactctggaagaggtaggaaggcagtttgatgtaacgcgtgaacgaattcgccagatcgaggcaaaagcgctgcgaaaattaaggcatcctgctcgatctgaccgattacgcagcttcctggatagtggaaattcctgataatatattaatcaaattgaaaaaagaagctatcaaaaacttctgtcatcagggtctgtagctcagttggttagagcaggggactcataatcccttggtcgtaggttcaagtcctaccagacccaccattcaatcaaatagttatgggttatataacccataactatttccgcaaaccgctacttcgttggagtggttttgtcaccttttctctcccgagcatatatctccgtcatcatggtgactgatgcgtgtcccagttgcttttgagcctgtctgatatcatctgcagactctgctttatcgatcccggcttttgcacacaaatcgcggaactgaaatttgcctttatctacgccggccgcttccctgaccttatcaaaatgtgtgcgcagcgtgatatataccagcttcttactggctgtagtagtctaatttggagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttagggctaaaacgttcaatacagttatcaaatgccgcatacgctttttcccgcgtttctgcctgccagatattgtgcagtgcctccttgaccttgggttgcatggctttggcagcttttccattacattggcgattttatgcacccagcaacgctgttgatccgtatccggccagcactgggcaacagctcccagcgcaccgtcaccgacagctaatttgggggcacctttgaggccacgttgtttcaaatccatcaatacttccgtccagctcgcttcagactcacgataaccatcagacaatgccagcagctccttacgccccgtttcatcagaaccgataatcaccagaagacataatcggtcatccattcgcacagtgctgtagataccatcagcccggacataagcataccgtttgccacccagatcgcggcgagtccagttttgataatcctgttcccagtcctgctgtcaccggcaatgtaaaaatgccccctaacggcaattaaaaattgacccccctgaattaagctggtcactttttctacgaggtggctgctattgttaacacaggagatggcaatgagtattagggtattaaagaagcagggaaagaggattaaagcaattgttcgggaaaccggtatatcacgcaatacggttaaaaaatatctcgatgaccaagagatgccgcgttacagtaaacgcagtagccgtgtcagcaaactcgacccgtttaaagcctatattcagcagcgtatccaggccgcacatcctgactggattcctgcggcggtcatgtatcaggagatactggcacagggttatcagggcaggatacggatgttgagcagttatatggcttgtttgaaaccacgagcaaagccagatccggtggtacgttttgaaaccgcacctggccagcaaatgcaggtggacttcaccacgatccatcgcgggcgagaaacactcaaagcctttgttgccacgctcggtaattcacgcgccagttacgtacgtttttatgacaacgaacgcaccgacacatggatagatggactggttcgcagttttgagttctttggcggagtgccgcacgaagtgttattcgataatgccaaaaccatcatgatcgaacgcgatgcttatgcccccggccagcatcgctggaatgcggcattattatccagcgccaacgattacggttttataccaaaggtctgccgtccttaccgagctaaaaccaaaggcaaagtagaacgctttaatggatatttgaaactcagttttatcgtacccttaaaagccacctaggtggaaaatccaccatccgaggagttttacatgaaaaagcaatgcaggccatgaaagaatagtataaaactcatccccatctctttcataaaaaccatacaatcatccaggatgcgacagctagcttctcctggttggcttccatcgtcaattgaatcagttgcaagcgcgacttattaatggtgatttgaggtactcagatttttattttatagacttccagttctatttggagtataagtaactatcacaacgaatttgtttcaaagcttttgcagttattggtgttcctgttggtattccatgtgcaatcttagattcaaatagctctacggaagcctttccgttttttgacaaaggagtattcacatgacgacaggtatagttaaatggtttaatgatgcaaaaggttttgggtttattacccctgatgatggtagcgaggatctattcgcgcatttttctgcaatcagcatgaatggatttaagactctgagagaaggtcaaagagtttcttttgatgtgacacagggtcaaaagggcaaacaagcatccaatattcaagctccctgattaagacttgatctgataaaaagcccagcccttaagaagctgggctttttgctgtttaccctacattccccacctttccattcccttccttgccacctgtgcaggtaatgtagtggtcaagtaatttcagacactgcgataggttcttttgctacagcatgtaactcataatcaaccggtgttgatatacccaagcgtggagtgcaggcgcaccgcgttataaaagccaacaatgtattgcatcatatcttttctggcctcggcatggttagcgtaatctcgctgccaaacacgttccattttcagattcaggaagaagcgctccatgacggcattgacccagcagttgcctttgcgactcatgctgcagcgcataccgtattcggtcagcagtgcctggtacgtatctgaggcgtattggctgccgcggtccgagtgtaaaatgagccctggctctgggcgacgctgctgcaccgccatctgtagcgcagcgacgacgagctcagcaggcatagtgggcgccatggcccaaccgatgattttgcgcgagtacaggtccatgacggcagccaggtaaagccagccctggcgggtgcggacatacgtgatgtccgacacccaggcctgattcggttgtgccacgttaaactgcccgtcaagtaaattcggtgccacggggtagtcgtgtttgctatcagttgtgttaataaatttacgtttccatatgggacgcagtccattctcgcgcatgagccggcgcacacgaaatcgccccatgggaacgccacgctgcgccagtgccttgcgtacacggcgactaccgtagctcttgccactggccataaatgccgccttcacctgagcactcgcctgcctgcacatccctggccggtgccgtgcggtgctggcgttgataataccccgcacggcttacgcccaagacccgacaggcctgcgttacgggtatggccttctcctgccattgctgaaccaactgatcggtcatttagttcccgggcgaagaaggccgatgctttttttaacaagtcgttatcagagcgcaattgtcgaacctctgcctccagggttcgaatccgttgctgctcaagcgtcaacggcttaccgatgccgcgttgaccgttaagatctgcctgatactgcgcgacccaacgacgaatcgctgttcccccccggggggggatccatccacctatcgaggtgtctgtttaaattagaccactacaatccacctcagtccaaccggtaacgagtagatcctgaagatcttcagagcattccacaaaggatcgccaattctacgtggtaaagtattggcccagactttcagttctgtgatcagtttgtctgttagttactatgatggtacgagctgatctcttagatgtttagtcccacggtgtgctggtgtaacatatatccaactacggagggatgatttatgggacagatattacacggaagcgcccgcacgacagcggcggtgcgtcgggcgatacaatatagtcaagagagtctgaatgttctggccaagcggcatgggtatatggacccctccgtcaagacaataatgtatcgagtttaagagggtaaccttcttcatgcagcggaacggcgctgccccggttttcggtttctttttttgtttctacttctgtgtgagatttttctttctcactatatttgtccacaatccttgctccgccaccactcgctgtacggtatacctgatctggcgtgtcgtagcccagcgattggtgcggtctttctgtgttgtaaagcacaaagtattctgtcagacctatcagcaattcaggcatcgtgacgtaacctttcagatacacgtcctcgtgtttgacgctgcgccagagccgttccacaaagatgttatccagtgcccggccacgcccgtccatgctgatggcgatttctttttttaacagcacgccagtaaaagcttcgctggtgaactggcagccctgatcggtgttgaatatctcgggcgttccatatgtctgcaatgcctgctccaggcagtccacacagaatccgctatccagcgtattcgataaccgccacgacagcactttacgcgagtaccagtcgatcacggccaccaagtacacgaacccgcgtgccaagcggatgtatgtgatgtccgtactccatacctgattggggcggatcacattcacgcctctgagcaggtacggataaactttgtgctgcgggtgcgggcggctggtattcggccccggcgccatgccggcaaggcccagtatgcccatcaacctctgtacgcgcttgcggttgatcttgtaacctaaaccacgcagataatgcttgatcttgcggctgccgtaaaacggatgacgtgtgtattcggcgtcaatcagtcccagcagtgccaattcctgctcgtccggttttgcggccatgtgcggcgcatagaccgtggagcggttaactcccgccagttcgcattgccgggtcagcgccagtggttcgatggcgctgacccattgcttgcggttttctactggctgatcccggacttttttttgagccagtccagttccatcttcaaccgcccgatctcggaatacaggtgctccgggctagctgacgggtcggcaggctttgggctgcgcttggaatcaaacaggctggatgcctgctcttgcagctccttcttccacataccaacctgtgtcggatgaaccccaaactcctggccaatttcgttaaccgtcttgatgccacggaccgcttcaagtgctaccttggccttgaactcgccactaaaattcttgcgcttcgtttcgctcataacctgctcctcagttgcagcaggttaccaccttaatttattgtctgaaaatcgggggccactatagggattaatccaaaaacggtagcgaagtggcggaagcgggaattcacccacgatgcaccgatgggccccaaagagtcgcactcgaccgttttaagtctggaagaagaagccgctgttgtggcgtttcgcaaacatacgcttctaccgctggatgattgtctatatgccctgcaaccaagcattccgcatttaacccgctcaagcctgcatcgctgctttcaacggcatggcatcaatcggttgccggatcttgtgggcgacaagccaaagaaaaagtttaacgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacagctcagtatgtaacgcatatgttcgataggcgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacatcgtgggactaaatatcttacagcaacgggatctggctttgtccagacaggtggcttgatagatagcttcggcgcaggaggtgcctttgcttctttaataccctaatagttattgccatctcctgtgttaacaaaatagcggctacctcgtagaaaaagtgaccagcttaattcagggggtcatttttacattgccggtgacactccagccataaggacgatctctcccttccggaaactaaattgccgtcaggttaaacaggatgccttgctgtttcggtgaaatgaatttgtcgggattgctgataggttactggttaacttccttatccagaatatccagcacccatttacgaaactccttggcaactttggtgcgggtaaacatggccagcaggcgacaactagagcatttttgacttatttgtttacatatccacatgaagcgaagtagttggcacactcctccggagtgaacagatccaacactttgccgatctgcgcccataaggcatccatggttcgtttggcggctttgcgtaatagggccttgagtttggagaacattttctcgattggattcagatcaggtgaatacggtggtaagtagagcagcgtggcacctgccgcttcaatggctgcgcggacgcctggaaccttgtgacaagacaggttgtcggccaccacaatgtcacctggctgcagcgtggggcacaggcaggtttgaatataggcgagaaacgcggccccgttcattgggccgtcgagcactaacggagcggtgatcgcatcgtgacgcagtcctgcaatgaaggtggtgctcttccagtggccgttgccgtctcatccagaaagactaggtgacggcaatcccaatgctgctgctcgcgggcccactcagttcgtgcctgacgtacgtctgtgcgcgattgctcgctggcgtgcagggttttttttaaaactcaacccccccatttgttcagttgatgccatagcgccggcaccttgatctgaatgccttctgcagccaaacgctcactaagctcgacaagcgttagatccggcgtggcttctatccattgccgaatctgcgcttccttgtgcgcaatgcgggatcgccgataacctcccatcggcaagctatggcgctggccctcttctttccatcgcttgcgtacctgatacacccacatgcgactcacctcaaagcgccgggcaattgccgttggaccttcgccacgatccaacgcacccagaatgcgatctcgaagatcttgtgaataggcatgcataaccttccccatcagttgtgatagaaaatagtctattacatgcatatatttaaatcaaaaatgctctagcctgacacaaggggattgggtagaaggtatggcgaatgcgtaagatgccgtgaagggcaggtttgtttgatgactagatgaaaaaaccgttaacccaacttcagtttaaaaagaacagagtatgttttttccacaaaccttactgaggctggttgaatgatcgtaacgatataaaaaacaggaggttaattcttaaagaatgtctcctgtcgattacgtcagataagtaagatgttacctgagtgtggtgatgtactcagataccgccttcatctcttgttcactcatgcgcgaaacaatcatctgcatggcactgttcgtgtcattcttgcgtgttcctagacgaaatgcttgtagctgggacagagtgtaggcggcatgctggccatctattcttggataatgcggtggaataccttgcccattgggagaatggcagctggagcacgcaggaataaagttttccagatttccgccctgataaagcctttttccttcctctatcagggaagcatcaccaactattccgggttgtggcttttgctgtgaatagtaagcagcaagattttcgatgtcgctctcgcttaatgttgccaccatgggagccataatcatattgtcacgcgcggcagtttcacctgctgcggccttgaaatcatgcaattgcttggcagtatatcccggttcctgccccgcaagaatggggtaaataggaatagtactgttaccatcagcattgtgacagcctgcacatattccggctgcaatttctttgcctttctcaacatcgcccgcagctggggattcggcaaatacaaagctggaaaatgtgagtgcgattgctgctacagtagttccaatgagtttcatgatcgttataggctataaagtagtttctgataaaagagacaatatatatgtattctaacaagatttgttgactacagtaaacgctgctattgtttacttataaatctatgagatgaaaaaacttcttctttttttattgctggcaaatataggtgctgctttttacttttacagcctgccgaaaaataatttttctgtacagaagccattgattcatccagaaaaaatagagctattgcctaccaaggttgcatgtcttaaatggggaagcctgccagaacctgttgccagattagccagagcggaaatttctaaatgggaaacgaggaaagatcttgtcactgagatttcccaaggaaaaattactattcattggatgcacattccaccattacaaaacgcacgtgagactgcgaagcagatcgaacaactggaaaaattggagattcctcatttgcatattcaagaaaatgcagataacccgtggcataatgcaatttcattggcaatcctgatggataactccgatgcggtggcgttgacagaagacatgaaaaacaagggtgtggaacatgtgttggatagtgaacaaactctggaacaatttgagtttgtagttcgcagtccaactaaacagatcactgaaaatattcagcagctgatccgtcagttcccgggcacacagcttgaagttagcgaatgtgatcgcttataaaatctggtggcgcagtattctcgagcggtaaaatcaatgaattgtttatctgtagatttttcacagatttcttcaaatatttatcatgattattggagcaagttggagtgggtgtggtagttcatattaaaacagcacaggaaattgaaaccatgcgtattgccgggcgactggcgtctgaggtgctagattatattgaaccctatgtagtacccggcataacaacaggtgagctggataagctttgccatcattatatggtcgatgtacagaaaacgataccggctcctcttaattatgcaccgcctggttacagtccttatccgaaatctatctgtacctctgtgaatcatcaggtttgtcacggtgtgccgggagataaaaagcttaaggacggagatattgtcaatctcgacataacggtcatctatgaaggttaccatggtgataccagccgtatgtattacgcaggtgagccttccattcaggccaagcggttatgcgagttcacctatgaggcaatgtggcgtggaatcgaggaggtgcgtccgggcaaacatttaggagatattggccacgcgatccagcgtctggcagaaaaaactggttatggcatcgtcagagaattttgcgggcatggtattggtgcaaaattccatgaagatccccaagtattgcactatggccgcgctggtacgggaatcgagcttaaacctggtatgatttttacaatcgaacccatgatcaatgcaggaaaagctgccatcaagcaactcccggatggatggacagtgattaccaaggatcgcagtctgtctgcgcaatgggagcatacaatactggttaccgataatggctacgaagtgctgaccatatcatcgggatctcccgccaaacctgactaccatttctcagtctgatgacattatccgatagcacgctggaattacattatcagtgtaaaaaataagtgattgatatgccacgatacaatcatcgtacgcttgcacaaatgcgcccgatcagaataactcgccactatatccggcatgctgagggttcggtgttgattgaatacggtgaaaccaaggtcatttgtaccgctagtgttattgaaaaagtcccgccttttctcaagggggccgggcaaggctggttgacggcagaatatggcatgttgccgcgttccacaggtgaaagaatgcagcgtgaagcggccaaaggtaaacaatccggacgtactatggaaattcagcgcttgatcgggagagcattgcgttccgtactggatctgaaaaaacttggtgaacgcacaattcagattgactgtgatgtgatccaggccgatgggggaactcgtaccgctagcattaccggcgcatttgttgcgttgtgtgatgcagttggatatttgcgtgcagaaaaaataatttcagaaaatccgatcaaggatcacgttgccgctgtttcggttggcatactgaaaggccaacccctactggatctggattatgcggaagattccagttgcgatactgatctgaatgtcgtcatgactggtaatctgggattagtggaagttcaaggtactgcagaaaaagtcgttttcagccgtcaggaactggatgtcatgcttgatatggctcaacaggggctgcaagagctgtttgacctgcaacgtaaaacacttgaaaccgctgtgcttcctgacaataaaagtaactacacatgcagcgctccctgagcaggattgttatcgccagcaataatgccggaaagcttgctgaaataggaaaactgctggctccccttggtattgaagtggttacacaagcatcgcttggagtaactgaagcggatgaacctcacatgacgtttgtggaaaatgcgctggccaaagcacgacatgcgagtctcgcaaccggattacccgcactggcagatgattccgggatatgtgttaatgctttgcaaggtgcgcccggtgtattgtccgcccgttatgcgggcgaacctcgctcggatgaacgtaacaatcgcaaactggttgaagcgctgcatggccaatccgatcaccgggcctattattactgtgtgattatcctgttgcgtcatgggcaggatccgcaacctgtcattatcgaagatacttggcatggagaaatcattgctgaacccaaaggtcagggtggatttggttatgatccccatttttttctgcccaaactgggtaaaaccgcagccgagctttccatggaagaaaaaaacaagatcagtcatcgcggcaaggcgcttgccaggctggtacaaatactggcgaggaatgaaaaaatgccagtttaatttgacataacgtgtttgtgatcatgcgatcgacatgaaaaaaataatcccagttttatccctacctgattcaaaatcacctcatctgattgagcttcctcccttagggttgtacattcatctgccctggtgcgtcagaaaatgtccttattgtgatttcaattcgcacgcaattaatctgaatagtgcgctcccggaggccgaatatgttgcagcactcaagcgtgatctggagctatcgttgccacaaatctgggggcggcctgttaccagcgtatttttgggtggcggaaccccgagcctgttcagtggtgcctcaatcgatgcaattctttcgtatgcgcgtatgctgctgtcttttgctcccgagactgaaattacactggaagccaatccgggaacgctggaagcacaaaagtttgcagatttccggtctgctggcattaatcgactgtccattggtatccaaagtttcaatcccaggcatttgcaggcattggggcgtatccataatgatgctgaagcttctcgtgcggttgaacaggcgctacagcatttcagcaatatcaatctggatttaatgtatgcactgccgaatcaaacccaggatgaagcattgcaggacattgaggcagcctgtggctggggcgtaccgcatatctctgcttatcacctgacgcttgaacccaataccctgttttatcgccagccgccaaaattgccagatgaagatacatcagctgatatgcagatcatgatcgagcgtgttcttgcagaaaaaggctaccagcactacgagacttctgcatttgcacagcccgggaggatgtgtgtgtataatatgaactactggcaatatggcgattatctggggatcggtgccggggcgcacagcaaaatcagctttcgagaaaaaattatccggcagatgcgtcataagcaccctcgtcactatctggagcaggccgcagctagaaataccaatcttgaaaatatgcttgccacggaacaggaagttgggccgcaagaccggatttttgagttcatgatgaatgcactgcgattgacggacggttttgatcctgggctgtttcatactcgtactggcttgacagttgcctcaattcagcagcaactaaccactgccgagcaacgagggttgattgagtggcagcacgattgtatccggccgacggctgacgggcgaaggtttttgaatgacttgctggagatttttctgccagaatccaggcaaacgacaacttcctgaacttaaaatagcgggggggggggagatcggaatgaaggactcaatttcaagacgcgcctttctgaaaaaatcaggcacactgggaacccttactgctctggacgggatgctgccgacctatgcctggtctaatttcttaagtgctgttacgccggctatgcagctaagcggagatgttatcaatctcactatcgccagaacgccgtttcgtatcgataatcgcactacaaccgccacgactgttaatggtaccgttccagggcctttacttcgtttgcgcgaagggcaggatgttaccctgaatgtgactaaccgcctggacgaaacgtcttcaatacattggcacggcattctcttgccacctgaaatggatggtgtgcctggtgtcagtttcccgggtattgagccgggaacaaccttttcctatcgcttcacgatcaggcagtacggcacgtactggtttcacagtcattcaggcggccaggagcaggcaggcgtgtatgcaccaatgattattgatccgcttgaaccagacccgatccagtacgatcgcgaatatgtgatcatgctttcggactggagcttttcttcagtggatgcaatgatcggaaagctcaagaagcagcccggctacttcaactttcaaaagcgcacgctgggtgattttattaaggacgtcatgcaggatggctggctcccggcatttgacaattacttgatgtgggcccggatgcgaatggatccgacagacttggcagacgtaacgggttatgcctacacctacctcatgaatggattgacctcggccgcaaattggacggggatttttcgtccgggtgaacgcgtacgattgcgctttattcaagcaggggctatgacatttcaggacatccagattcccggactcaggatgaccgtagtgcaagcggatggtcagaatgtacaacctgttgaagtggatgagttccgcatcggtccggctgaaacctacgatattatcgtggaacctaaagaggatcgtgcttacacgatttttgcagagacactggatcgaagtggtttcgcacgcggcaccctggcaccgcgccctggaatgacagcagagattccgccgcgccgctcccgtccgcttctcaccatggcagatatgggcatgcgacacatgaacgccgagagccatggtgaccacgaatctcacgatgcagctagaggtgaaccgaaaaaagggatgcagctcgacgacacgcatggagagcatgatcggcccgggcgtctcgataccagacctgtcaggcatgctgctgacgatcatggtcctggcaatcagttcattccggatttcacacagagtcgtatggatgaaccgggcatcgggctgggaaatgatggccgccgggtgttagtctataccgatttaaagagcctcaagccctatcccgatcagcgcaaacctgagcgtgagctcgaaattcaccttaccggtcatatggaacgcttcatatggtcgttcgatggcaagaaatattcagatgccagggagccgatccttttccatcatggagagcggttacgctggatttttgttaacgatacgatgatggaccacacgatgcatctgcatggcatgtggatgtatctggaaaatggcgctggcgcataccttccgcgtaagcacacggttcttgtcaagcccgctgaacgcatttctgttgccattactgctgatgcacctggtccttgggcctttcactgccacttgctcttgcatatggaaacaggaatgtttcgtgtggttgagaccctggatgcagttcccggatcagaaccgtgaaattctttctgcaacttggggctggcattgttgcgattctgttcttaggtgcgggtagcagcctgccgacagcgagcgcagaaatgttgtcagacaaagaaaaacagactttgtccaatcatctgccccgatctcggggtgaatatcatcatccgacccatagtgatcagaactatgcgttcctgcgtgctgatgtacttgaataccgtccgggagaggatggcggtgatttccgctgggatatacagggttggtacggaggagacttcaaccgtctgtggtttaaaagtgaaggcgaacgaaatacggctttcaaagcagaccacgacatcgacatgcagcttctgtacggtagatttattgggaagtattatgattttcagatcggtgtgcgcggagagacacaaatctttaaagggagaaatgtggcgcgggctcatgcagttatcgggtttcaagggctcgctccgtatcgctacgaggtggagtctgcgctctttattagccaggatggagatgtgtccgtgcgtttccagacatcccgcaactttttgctgacacagcggttgatcttgcaaggacgtattgagactcatgcagccgtgcaaaaggtagaaaaatttactactggccaagggctcaacaatattgagctggggttgcggctgcgttatgaaatcaggcgagaaatcgcaccttatattggaatttcatacgaccgcagcttttttaagacggctgatcttgtgcgagaggaaggcggtgattccagccagattcgctttgtggccggcgtgcagttgtggttctagtcatcgcagtttttattaaataccgtcagaaaataccggtttaacctatccatgtacccgcaacagccaagcagcgcagcccatcatccccaggctgaccgtcagcataaagagcgcgtggcggcgatatttccggatcaactccgtttgcgggtgaaccgatatgataaacggacgtctgtcatcttccagtctggaaatatgatggatttccagttcgtgcaatagctgttgatgaagggtgcgagcttgtgattgggcagcctcacgagcgatctcccattctgcctgatctatctcgccatcccgattgctgtcaaagcgttccagcaattgctctctgtcctgtttccaatcactgagcagatcacgtgtaatattctgcacagattgctcggttgccggtgatcgcgtttgcagatggccgaggatatacagccgttgcccaggcaggatcaatcgctcactgtagcggtaacggctggtcagcgcgacaatggctgaagcgctatccagcacctgggttcgtgtcggccattcggtattaccgtgccagatcagtttttcattgctggtgatttctgccccttcgggattgatcaggcaggtaccagtaccatcatccagcataaacgactgatcgctggtgtgctgatacaggattttccattcggtgcgggtgtgtttctgttccagtatggtctctttgcgttcgaccagactgtgataccagatacattgatggttggacagcggagcataaatgggctggtcaggcggtgattttcccttaccttccagttcgatatagccctgatgtgcagaacgcaaacgtgctgtgggtgtatcctggattagatgccagcgcttccagtcgcgtgtgaaatagtaaaaacttgttactgctgccagtagcagtaaaatcaatgtgagtccgtattcttccggagaaaggctggatgaaaattcctccatgacgcaagcagatcagccgaacagcttgttcagatcatgatcctgtttatcgatttcagcaaattccaacaataaccgttctttaaatccgaaccatctggcaatgagaatttcagggaattgttcgatgcggatattgttgttcttaaccgcttcattgtagtactcgcgccgatcggcgatactattttccaggctggtgatgcgggtttgcagatgctgaaatttttcgctggctctcagttcaggataagcttccgccactgcatacagattacccaatcccattctcagcattccttccgctgcacccagagcgggaagattgcctgcttcacgcgcacttgcaatgcttgtacgtgcttccattacccgactgagagcttcctgctcaaattgcatatagcgcttgcaggtttcaaccagcttgggcagctcatcatggcgctgcttcagcagaacatcgatatttgaccacgcttgtgaaaccgtatgcttcacatctaccaggctgttatagatcatgaccccgatcactagcagagcggcgataattgcaagaagaatgtagagaaaaagtacaagatccatggatattccttttatcgtctcaaaggatatatcaacggcagttattacatacattgaagtacagtactgcacccaaataatcaggctggtttgtcaatatgttcggcaatataatcgattaactgccgcacccgggtagtcattccctttggctggaaaatacgctatgtacgattgcttgtcctggaagtccaaccgggcaagatgtcgatcaatttcccttgagccagatcttcctttattacccaccatgcacggaagtgaaccgccccgggttttgaggaggctccaatatctgagaagatggagccatgaacaaatcaaataaatattcccccgaagtaagagcgcgcgcagtccgtctggtgcaggaacaccgcagtgagtatccctcgttgtggtcgacgattgaatccatcgcgccgaagatcggctgttcagcccacacattgcttgaatgggtgcgcaaacacgagaccgataccggcttgcgagacggtgtgaccagcgaagagcgcgaccgcatcaaagccctggaacgcgaagtaaaggaattgcgcaaggcgaatgagattctgaagctggccagtgcttttttcgctcaggcggagctcgaccgcaaactcaaatcctgagatcgttcatcgaccagcaccgcgacgcccatggggtcgagccgatctgcaaggttttgcaggtcgccccatcagggtatcggcgatatttcgcgcagcagcgtaatccggctttgcgcagtgctcgcgtcctgcgtgatgatgaactgctgccgcagatacagcgggtctggcagaccaacatgcaggtctatggtgccgacaaggtctggcgtcagcttaagcgtgaagatgtccaggtggcacgctgtacggtcgaacggctcatgaaacggttagggctgaaaggtgccaggcgtggcaaggttatgcgcaccacagttccggacaaggcgctgccgtgtccactggatcgggttaaccggcaattcaaggcagatcgtccgaaccagttgtgggtgtcagacttcacctatgtctcgacctggcaaggctggctgtatgtggctttcgtcatcgatgtatttgcccggcgcattgtgggctggcaggtgagcagctccatgcgcacggactttgtgctggatgccctggaacaagcgctgtatgcccggcaaccggggcggatggatgggccttggtacaccatagcgacagaagctcgcaatatgtctccattcgctataccgagcgactcgccgaagccggaatagaaccctcggtcggcagcaagggcgacagctacgacaacgcgctggcagaaaccatcaatgggctgtacaaaacagaattgattcacaagcgcgccccctggaaaaccagggaggccgtggagctggcaacgctggaatgggtagcctagttcaacaaccagcggctgctggaaccaatcggttacatccctcccgcagaagctgaggtaaactactataggcaattcgccaaggaagccattccggtggcttgactttaaccaaacagcctccacgaaacccgggacgattcagattgagcgtttgcttccctggtcagagcttattgccctgatcgagccgtgctgcctgacaagtgggcgccgtggcgagcaaccactaccactgaaaagtatgttgcgcgtgcgtattgcctaaattgcctacaactactctgatccggacatggaaagatgcacttgatgagattgccagcctgcgccaattctgccagttttgaactggatcgcatgcttgatgaaagcgctatactgcgttttcgtcgcctgctggaacaacataacctggctcagcaagtctttgccactgttaatcgccaactggcagtccaaaatttgtttctcaaacaaggtgatcgttgattgctgcaccgccttccaccaggaatactgaaggcaaatgcaatcctgaaatgcactcaagcaagcaagaaaggcaatccatggcgtgtgtcacgaacacaggcggcagtatagtagttcaatggtttcggacttgtatgggtaccggccggggcgattcagtgggatggccaagcgtttcgtgataccccagttcagccagctctcttcaaaccattgcgttatgcatcttcctcaagttcactttgcaataattctagctcttctaagttattgagccaggtttcttccagtttcacttgctgttgtagcaagttggtttgctggtttaagtgttgcttgagctgctctttttgtggcggctcatagagattattatcagtcaagatggtttccaaagcctgtagctctttttgaatgttatctaactgtttttccaatgtatcagtgtgcttgcgtagcggtgccagttgtttacgtagtgctgcagctgcttggcgttgtgcacggcgatcaactttatcggggctggtgcctgcatcgctattaggatgctggcgcaaacgatagtcgctgagccatttgctgtagtcctcaagatcacctgcaaactcttgtacccggccctcggcgactaagtacaactcatccatggtatttttaatcagatgacgatcgtgagacaccagcagtagtgcaccggagaaatcttgtaaagccatacttaatgcttgtcgcatttctaaatcaaggtggttggtgggttcatcgagcagtaataaattaggtttgccccacgcaatcagtgccaaagctaagcgggctttttcaccaccagagaaattgagcacgggttcatcacagcgcttgcctcgaaaattaaaaccgccgagaaaattacgcaagacttgctcgcgctcatcttgagcaatgcgttgaaaatgcagtaacgggctggctttgggatcaagtgaatccagttgatgctgagcaaagtagccgatcactaagttttcactacaggtgagctggcctgccaataacggtaaatcacccataatacttttaatcagcgttgatttacctgcaccgttggggccaagcaaagcaatccgtgcgccggggactagctgtagttttacattgcttaaaataggctgctctgcgtggtagccaagtgctgcttcatcgagattcagcagcggggtagagactttatcggcttcgcggaaaataaagtcaaaaggtgaatcaaagtgtgctggtgccaactcctccatgcgctccagggctttaacacggctttgtgcttgccgtgctttactggccttggctttaaagcgtcggatgaaatcttccatatgcgcgcgctgtgctctttgtttttcgtgcgcttgttgctgctgcataatacgttcagcacaggcgcgttcaaaggctgtgtagccgccgcgatacagcgttagtttttgctgattaatatggacaatatgaccgaccaccgcatctaaaaaatcacggtcatgggaaatcagtaacaaagtaccggagtagttttgcagccaaccttccaaccataaaattgcatcgagatccaagtggttggtgggctcatcaagtaatagtaaatctgatgggcacatcaatgcttgcgctagatttaagcgcatccgccagccaccggaaaagctgttgacctggttttccatttgttcttctaagaaacccaaaccagctaataatttacgcgcgcgcgcgtcggaggtataggcatcagcgttgtcaagttccgagtacaagcgaccaagctcgaccccatcttgccgttgttcagctttggctaattgctgttgaatatcgcgtaagtggctgtcaccatcgagtacataatcaatcgcatcacgatcaggtgcgtcgatttcttgacgcatatgggcaatgcgccagttcatcggcaatacgcaatcgcccgcgtcaggatgcagttcgccacgcagtagggcgaataaggtggatttgccggcaccattggcaccaattaagccgactttatgccctgggtgtagggttaaatctgcattttctagtaagcgcaaagggccacgttgcagggttagttctgagattcgtatcatggcgcgcagtttagcagtttcgcggctgttactgatatggagagagccatttagtttgtcttacaagcttttgagtggggtagccataagaatgatgcctgttgctgagtaataacagtttgatgatttcaaattgttcgcgactgatatcactcgggtaacttgtctctagctagctagaggtgccctctagttgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacatctagtataaggggataggaatttgttgctccgtaaccccattttcaggaatggggctacggagcaacaaattgtttttatcagaaatcaagtttgatactggcctgataaaaattactggatacattacccttcatatcgaatccacccgcaaaacgcaaggcgagatttttcggcaagccaaattcaatgtaaggacctacccagttgtatacgactccctccaggctactgtctatacggtttttagctgcccaaaggtgttcccagtgaattccgacggaattgatcggtaatgtcttgtcaacgccaaacaaagcaggctttaccccgacattgatccagttatgcaaaaaatcccttgcacgcggtccgcgtgtagccatgtagtaagcaacatagaggttcgctgtaacataattgttgtcgtaattaacaaccaggttaggtacaattccttcaccagcacgaatatccttaccgacaacttcagaagacaacaatgaaccattcagcatcccaatattgggattgatgctcaaagtgttatcaaaaaatctgaaatttaggcctataccaaactctgtccaaagtcccttgccacccgaattgacggaatctcctctcggccctgataccacactgctttgcccaaaattaggattggtccataaccatgagtagaacgtgaaatcgatattgtcagcaacttcataacctgcatctataatagtctggaaaccgaaaaagttatcctgcttcaggatcactcctccatgaaacttatgtctatcgaacccgtgcttatcaccatgcccttcgctgcctgaacgtccctcgagttcagcaacctttgcctctaaggcctccactttctgcctgagctccctatctccctgggcatatacatttgttgcagtacatgcaagactcagaagtactagacccaccatctgctttttcattgatgaatacctttctcaatataaaattgaagctgttatctttccaagtcagacgacatcactgcctctgatcagaaaaacgattaatgacttaactgaccgtaaatggctacccgtgaactaatacgctgccagggtaatcaacttggtagttgactaaatttttccttttcacctcagaattatttatagtattaaatgaggtcaaatttttataattgatttaaaaaaataggtcaatacttttctgctggaattcaactggaatcctaaatcaggcgagggttccaaatcacacaccagcacaccgtgggactaaacatctcataaaaaaccatacaaccatccgggatgcgacaactatgtagtagcctatggtaggccttgcacggtaaactccagccatgatggagtatctcgttcagattattctactgctggccgttgccatcactgtggtggtggtttttcagcggctgcatatccccagcagcctgggttacctactggttggaatcctgctggggccccatatagctgggcctgtggtctctatgcctgggctggaatcgctcgcggagttcggtgttgttttcttgttgtttaccattgggctcaacttttccctgccgcaaatggatgcgctgagaacccgggttctcggactgggtaccgggcaagtcgtgcttaccaccctggtggtgggcgttgttacctggcttgccgggcttcctatcattgcagcattcgtgtttggtgcggtgtttgcccagtcctccaccactattattgccagcctgctcactgaacaaggtgaggtaaatacgccccacggccgtctgggtctggccatgtcagtgtttcaggatgtcactgccgttccatttctggtggtgatcccggttctaggtgtatccgtggccgctgatgtgctggctggatccctggctctggcttttgccaaagcggtgttggctttcattctggtgttcatcgtcgggcgctggctattatccccattttttcagattatttctgaacgcaggtcagttgaggtatttacgctggccgtgttgctggtggccctgtttgccgcatggattactaacagcttgggcttgtcactggccttcggtggattccttgccggccttgttctgggtaaaacagagtttcgccatcaggttgagtccagtatcagcccgttccgggatgtgttgctgggccttttctttattggtattggcatgcgtttcaacccggtggcgataccgcctatctggcagtggacactgctaggtgccttgcttattttgatcagcaagatcctgattgttgccgcattggtacgcgggattggggttgatgccaggatgatgtggcgcacgggactaatgttgagtgtgggtggtgagttcgggcttgccctcattgcaattgcgcttgattctggtgtgattgacatcgggcttggtcagatcgcgatatcatccgtacttctgtcgatggttttgggtgctgtgctgatccgcttcaatgatgccatcgctactttcttgactaagactccaccgccatctgatgaggaggcagccgagttgccgcaagcggccgagcgttccgtgataattggtggctacgggcgcatggggcgtacgattgctattttattgcatgcatgcggtataccgtttgtggcgtttgatacggatccccgacgggtggccctgggccgggcggatcgacatgcggtttggctcggtgatattgccgatcccatattactggcctccattcgggtggagcgggcgtctctgatcgtgctggcagttgatatcaagagcatcgcattaagtgccatgatctatataaaaagaaccagtgcccatgttccggtgatcgtacgggtacgggacctggaaaccagccggcatttgctagcggccggtgctgcccatgcttacccggaaacaattgaatcgagtctgagccttggggtgacagcgctgcggatgctcaatgttgcggccgatgaaattgaggaggccgttcaaaatctgagaaaccgaggttatcagcccgttgtggaagatgaaaaaaagaggttgtgagagcgttcatacttcaccacacagccaacgggtgaggtgtgttgtcaaaaatggagtccatgtgtttaagcggcgatcagatttgcataacattgttgtttaaattctactggcgatagataaccgagtctttcctgttttacttgtaatcgtattctgaatttccgatgctgtaccaattcggtttcgaagattctccagaagcttccgctaggggcgttatcccagcaatctcccttgccactcatggaggcgcgaccaaaccaaattgttttaatatgtgctggtcatcatgtgagcaatattggctaccacgatccaagtgaagaattaagccttgctccggaagtttttcgtcaattgcacggaacaacggaacagtgcccggataaccagattcgatctcatctagtcacgcaggtgaccagctggcccgcgcgctcttggcaaacatttgatctaccagcatgagccgatcacttttcttttactgggcccgattcagtttgaggtgagtgtaagaaccgccttcgttacaacgaccaattccaataccgcactcaattaccaggacatttatcatgcacaacatcgttcaagactcagtcaaagattattacggtcgccaattacagcatactggcgatctcaaaaccagtacctgctgcgatatcagtgcgatgccagcctggctcaagcctatgtttgagcacatccatccggaagtgctatcgcgctattatggttgtggcctggtttgtccgcccttgttggaaggttgccgagtgctcgatctcggatgtggctcaggacgcgatgtgtatgctctggcgcaactggtaggaccgacgggcgaggtgatcggcattgacatgactgacgagcaactcgctgtggccgtaaaacacaaggcttttcatgtgcaatccatcggttacgacaatgtgcgctttttgcacggctatattgagcgtctggatgaactcgacctggagccgggtagtttcgatgtgatcgtctccaattgtgtcgtcaacctgtcgcctgacaaggatgcggtactgcgtggtgtgcaatacctgctgaaagacggtggcgaattctacttctcggatgtgtacgccgaccgacgcgtgccggcagcagtacgcgacgattcagtgttgtacggcgaatgtctggggggcgcattgtactggaatgactttctgcgcctggcgcatcgacacggctttcttgatccgcgcttggtgaccgaccgtccattgcagatcaccgatcctgcattggcgccacgggtcggtgatgtacgttttttttcagccaactacaggctcttcaagctcggtgatctggaaacggcgtgtgaggattatggccaggctgtcatctaccgcggcacaattccctactgcgccgaacgtttcgttctcgacaaacatcacgcgatcgacactggccgcgtctttcccgtgtgcggcaacacttggcgcatgttgcatgattctcgttttgcatcacattttgattttatcggtaattttgagcgtcattttagtttgtttgacggctgtggcagcaagttgccgttcgatatgaacacttccttgtcaggctctggcggcacgtgctgctagaaataaacgtttgtacaagagagatcaagaatgaacatcaagactgtagtaggcaatccggagagtattggttatatctccatcggcacagggcgcgccgatcaagttgctgccgttggaagaaatggcggctactgttgctaacgtgcgcgccgggcatatcctgttaccggcggccgggtcggctatcgctgctgggctcatgcttggcatcggtcgtgccacggcggagacagcggcgttgattttcaccagcagctatgttgatcgcataccggaatcattgtccgatactggccgtgccttggctgtgcatatctacgatacaatctatcaatgaacgtcagcggtgatgaagcgcagcctattcctcagcactagcgctctctggtggccaacaatagtgtggttatgcatttgcccgcgcattggtgctggagccattggttctgctgcttcaaccatgcaaaaatattttctaccaagtgtcggtaatcacaagcgcaaggaggattgttcaggcagttttggtgaatatcaggtcgcggatggtgtggccgagcttcatgccacgttgctcgaatttggtcagtggccggtatgcggggcggggggcatagtcagcggcagtattgatgagccgctgctcgctgcttaaaacatgcaggctatgaatggcgtagtcttcccagtcggtggcgatatgcagataaccaccaggtttcagccggttacacagcagcgagacaaaatccgactggatcaggcggcgcttatggtggcgtgccttgggccacggatccgggaaaaaaatgtggatcccatccagtgattcaccagtaagcatgtgttgcaaaaccagtttggcatcatgcggaataatccgcagattggtcaggccgtgtttctcgatacgatcaagcaggctgccaattccgggtgcatgaacctcaatggccacaaaatctttttccggatgctgggcagcaatctcgacagtggtttcccccatgcctgatccgatttccagaatttttggtgcggtacgtccaaaaatcgaatcgagatcaatcgggttttccgagaatggaataccgtaacgcggcagcagggattcgtaagcgtgccgctgtgcatgggaaaaatacccctggcggagcacatagctgcgaataggagggtgagaagacaaaaatcggtttcctgaagaagcgttgctgcagcttaattgtttgcagcagaatgcggcgatccggtaatcatgccttctgacggggagcttggcgtggcctgataaattttcttcggcatgcgtccggccaaccaggcttcgcgtcctgcttcaactgctttgcgcatggccgaggccatcagtatcgggttgcgggcgctggctacagccgtattcatcagtacaccatcacagccgagctccatggcaatggcggcatccgatgcagtaccgacgccagcatcaacgataaccggcactttgaccttgtcaatgatgatctgcagattccagggattcaggatgcccatgccggaaccaatcagcgaggccagtggcatgatggcggcacagccgatatcctccagttgtctggcgacgatgggatcatccgatgtatagaccatgacatggaaaccatccttgaccagaattctggctgcttcgagcgttgccaccacatcgggaaacagcgttttctgatcgcccagcacttccagtttaactaacgcatgtccgtcgagcagttcgcgtgccaggcgtagcgtgcgaacggcgtctgctgccgtgtaacagccggcggtattgggcaggagcgtaaattgtgagggaggcagtacatccagcaggttgggttcatcgggattctgcccgatattggtacgacgtatggctacggtgataatttgtgtgccactgacatcaactgcagcgcgggtttcagtaaaatccttgtattttcccgtccccagcagtaaacgggaagtataacttttaccagcaatgacgagcgtgtccataagtgtgtcagtggttgttttgtgttagttggggacaggatcaaagcaaattttaataatcagcccccaccaactgccacaataatttccagttgatccccatcattgaggatttgttcgggaaaactgctgcgggggatgatttcaccgttgcgttcaatggctatgcgcttgttctgcagcgacaagtgttcaaccagttgctgtatattcagcgggccatcataactttgttgctgtccgttgattatgagttgcataatatttaaaaagtacccaaggtaaggtagactttaaaccaagcaatccattctaacatgcgggtgtagctcaatggtagagcagaggcttcccaagcctacgacgagggttcgattcccttcacccgctcatccagagactgacaacccacgttaattttatctgtcagaattatccggttaccgagagtgattctttaactattacaaaaattcagaaaccccgatgactattcgtttaatcagacagatcttgtacatcttgtctgcagttttgctgctattgccttatggtgccacctgggcagaaaaatctgccgagaccccggattccctaaaaattcttggctgggttgaatttatccgcctggaaccttggggaattaagatgcctgcacgagtcgataccggcgctaatactgcttccatgagcgctcgcgatattgaggtattcagaaaaaatggtaagccatgggttaaatttacctttgatttcaggaagggttccggggaacgctctgtcgagattgagcgcccgttgacccggatgcttaaaatcaaacagcacgacggaccttctcaggaacgcccggtgatttccatggagatctgtctggcagatgaggttcgggaaaccgagtttgatttgattgatcgccgtgccttgaattatccggtattgctcgggcgcaaggcgctggccggttatgcactggttgatcctgcgcgtgcctatctcaccaaggcagtgtgcggtcacgtcaaaaagaaaaagaagagtgatgaaccaactgattccaggcagcctgaatgagaaaactgcatctttatttgctggctttcatactgtgtttcataggactgggactggcctattacaaggttgctgtaattggcctgcctttgactgcttccgaacaggcagaggtatgggatattgaagcgcgtatcagctttcgcgccaaatctgacagcgcgatcaaggtaaccctgccgcttccgcttaaccctcccggttattccattcttgatgaggattttgtcagtgcggattatgggctggcaatcgagcaggataatgccggtcgtgttgcgcactgggctaaacgaagagcgcagggtaagcagttactgttttaccgggttgtattatttgaaaacgagggagctgtacaaaaaccggatgtggtgccagtttatccgaaggccccggagtatccggaaaacctggccccggtgattcaaggactgttggataaggcacgtcagcaatctgccgataccgtttctttttcgcagcgtgtgattgaacagttgaatgcagcagcatccatgacggagctaaaattgctgctgaagcatatcaaccggacacgtaatttggcaaaaaatctgagctggatactggccggcgctcgtattccttcccgtatcgttcgcggcctgcgcctgcaggacaacaaagaatattcggagctggagcattttctgcaggtttatgatggcaaacagtggcgttcactgaatatcaaggatggacaggaaggattgccgtcgaatttcattgtgtggcagattgacgatgatcgagccttctcaattgaaggcgctacagaatcgagcattcaatatactgttgccagtgcattacaggaaaccatcaatattgccggctcccgttcggcggaaagaggtttccatctgatggatttttcactgtactcgttgccggtgcatgtccagaatgtgtacaaagtgttgctgatgataccgctgggcgctttagtggtggtattcatgcgcaacatcatcggaatccggacgtttggcacgttcatgccggtcctgatcgcactggctttccgcgaaacagaattattatggggcgtgattctgttctgtctgattgtcggtctcggattgctgttgcgcgcctatgttgaacagttgaaactgctgctggtacctcgccttgcagcggtgttgaccatggtggtgttactggtcgctggtgttagcgtggtcatgcacaagcttgggctggagaccgggttgtccgtggccttgttcccgatcgttattatgacgatgacaatcgagcgtatgtcactgacctgggaagaggctggtccagctgaagcattcaagcaggtttcaggcagcctgctggtagcggtgataggttatctggccatgaatatcaatgaatttcagtacatgttctttgcctttccagaactgttgctggtagtgttggccataatcctgctgctggggcgctactcgggctaccgactgatggaactctggcgtttccgtgcatttgcgcggaacaagccgtaatatcatgtttggaatctgggaaaggctcaagcagagtggagtcgttggtatgaatcagcgcaatgctgattttattctgcgttataacaagcgctcgctttatccgctggtggatgacaagttgcggaccaaatatttggcgacagcttccggtattgcggtacccgagctgtatggcgtgattgaaatccaatatgatgtcagccgcgttcccgagatcgtcaaggatcatgaagattttgtgatcaaaccggcgcatggctcgggaggcagtggtatttgtgtcattaccgggcgtctcaataatcgttaccggcaaaataatggtgacctgctgaccggggaagatatcgaatatcatatttccaacatactcagcggcctgtacagcctgggtggccagcccgatcaggcgctgattgaataccgggtcaagtttgatccgctgtttgaggaagtttcctaccgtggcgtgccggatattcgcaccatcgtcttcagaggaattccagtcgcttccatggtacgcttgccaacccgcatgtcggatggcaaggccaatcttcaccagggtgcagtgggtgctggtatcgatatgatgaccggctgtaccacccatgctatctggcaaaattacccaattgaacaacacccggataccggtgttgccatcagtggactcaaaattcctcactggcataaattgctgacactggcagcgcaatgtcatgagctggtcggactaggctatctgggggtggacgttgtgctcgatcgggaattgggcccactggtactggaactcaatgcacgccccggtttatccatccagattgccaaccgcagaggtatgagccagttgctggaaaaaatcgccaaactgaaagaaattcctacctcggcatcagcccgtgccacactgggacaacaattgtttctggaaaatcagacttgatgttgcgaaaatttatccgtttgaatatatcccatttcagtggtctgttagggctttaaacacatatgacagacaacatagtagttaacaccaaagcggcccatataaatatggacccaacaggaagagctgtttacattaattgttaaagatatgcagctcactaaatttggtaataccgaaattacaatatcggactaaacaatctggcgacaatggtcccggtacggatgtaccatggccgcagccgaccatgactcgcattcatgttatcggaagctgcgaaatcttgttccagcatttgtgctgcctcctgaacaaggtcgggatctgctaccgccagcatcagttcgaaattcaggtgcagagagcgattgtccagattagttgatccgatcagtaccagattgtcgtccgccagaatgcacttctggtgcatgaatccttcggaacaataacggtataccggaatgcccagtgattcgagttgctgttcgtaatagaagccggcaaggaacacgagccaggagtcagccttttcgggaatcagaattctcacatcgatgcctcttgcccgagccatcgatagcgccgtaatgcaggaatcatccggaactaagtacggagaactgatccacagtcgctttcgagcgcagccggcaatggtagcgaacatcatggtagcgcgcatacggtcatctgtcgggccggtcgcgcacaccgccgccattccatgctgatcacccgaaacgacttgtgcttcggcagtcgtgctccagacagcttccggcagatcccgtcgagtggcccaatagtaatcactggcgaatacggcttgaatttttcgggcaactgctccgtcaacatgaattgccgtgtcccgccagcgaggagcccaggagatgcgaccaagatattcgtcaccgatattcaggccacctacgatcgctcgctgcccatcgatcacgacgagtttacggtggttgcgaaagttcaattgaaaacgattggcccaaccctgacgcgtattgaaagccaacacgtccacaccggcatcgcggacccgctgcaaccatgtctttgtcagtttcgtgcagccgatttcgtcgtacagcagacgcacagtgactccggcctgagcgcgcttgcataaagcttctgcaaactcacggccaatatcgtcatctcggataatgtaaaattcgatataaatatagttttttgcgctgtggatctgttcaaacaacgtgttaaaaaaagactcgccatcaatcagcaatagaaaagtattgttacaactcaatggtgtatcaagaacgtctgctagaacgtccaacggcgactcgcctgttgcactgccggcgtttctgtccgtcatcaattcacgatggaccgcttcgacggaggcttggtgctgctcacccacctgccgaatggcgtctcggtaacctgcaaaccgtttctgtccgaatacccagtacagcggtagcgtcagaatcggcatcgtgacgaggccaacagcccacgcgacggccgcctgggacgttctaactttgtttatcgcatgccaggctgacgcaatgccaagcagttcagtggttgtgacaaagatcatgaccacggtagtccgcgattcacttagcagattcaggacgacgtccattcagatttggttcctttaccttttattgattaatacccggaagattccggcttatccagcaagtgcgtactttgtggtaaaaatgttgaagaaagtaggtttaaggctgaaattgtctctgaattttaaccatgaagctttttcaatatattcaccagttttctatatcgcaacctttggtatagttgatgatttttatcaaagtacgcattttattgtgggcatcataattgtttcaatacagaaagataaatagcgatggaggtgttcggtttatcgaaagccggaagtaccccaagcacgaagtggtgctactactggagcagtttcatgctctgactgaaatgctgtgttctggactggaatcatacgaccgatagcttggtagtgctggttgcgccggggatattcacctttatcatccgccgcgcccggtggccgtcagcttccgccctcagccatggatacgcatcacacaatcagccgactgttaccaaattttgggactgatgcagctgtttgaggacaacctgacagtctgattgaagtttttcccgtaggcggcgcagccagtaaactcttgtgcctggccttgtgcgatatcgagaaaaatgggagatgccgcctgtaacccggagatttatttgcgtttctttatcagctggcagtgatttgtagtggccaccagttgccgaacggccagtaaccgtacaggtagatccaaccggttatcgcgacttcgataccgacaaaatatgtcatcgcgatagttatccccatgagcttggtgttgcccttggtcattatttggtagaacaggtaccagagaatgccgtatgtgatccattcaaaagtccagcccagatctccatccataaaagccttgatggcataagacacagtcgtgaatgcaaccagcagacagtaataccccagcgcacgctgatcttcagcgccgcgaagtgcgttgataccgacccacagataggtcatggcgaacagcaaacctccggcggacagtggaaaattgttctgtaccaaaccgaaataaagtgcgccaatagtggcgaggatcccaactagcaggttgaagattccaacatccttggtatccaccttgccctgtagccatatagcgttaacaataaggataaatcctatgaacagtagtggtacacctaaaaaatcaccagccatctttaatcctctttaaactgaattactattactgctttcgttattccaccagcctagcagtagtgcccaaggtctggtcaaatttgtttggcaggacgtcgttgatgccgtaaatgatgaagtccaccacctcgacgggtgcataacataattcccaatctgttgactattgtcaacggcgatttaaaaccgatacaccgtcattacattcgcatactactttgacagtttcttaaaaaaaccaggtatcagaggctcgtatccaggctggctgcaacgcatgtccaagcatgccgattgttgatgcccagagtgtaaaaatacggataccaccgaggaaaagggctacgatgcaggcaagaaagtgtccggaatcaaacaatatattgctgttgacaccttgggattgcctcacgccattgctgcaacaaccttgcagacgttatcaatcgcaagggcactattgctgcattaacgccaagcatcctgactgtcctgcgtattgagcatgcttactgattctggctacacagctcaaccatttaccgaggcagtcaggtttgtttgggcgaggtggtcgcggtgcagattgccaggagaagtgaactgcacacttttacagtcattcctgggcgctggattacgaaacgaatttttcatggtcggaaaaatgtcggcgattatggaagagctgcgagcgaaaacgcaataccagcctgcaatttgtctacctggcacttttaatgctattgcccagaagagcataaacaggttcataggcgtggctcgcttcggaaaccatacttaccctgcaaaatatccagcaccaacgcgcgggttgttcaactgatctcaccttccattttgatgctcatggtgtcttttttccattatcatctgtgcaggtttttactagatcgttacacacacccatcatcaatattgatgaatgccaattactttcttgagattcggcctgttattaattgacacaaagacagcttttatttttctcaaggcaaagaaatcttaaaaaaccctgttacattcccatattctttagtttgttttacaaaatcctcttcattgttggtattttataatctaacgtattttttataaaaaatagtattgacgatttaaattcaagttatcgtgactgtaagatctgtttatctattcatgctgcagcacttcaaagctgttttttaattccatttttgaaaggttccacaatgaattctttgaaccatgactacccagacgttctgctgcataacaaggaggtgccttgtctgtcgctgtaccagacgacgcaccggcagcatcccgacaacgtgcaagacccgatccgctttcgcaatctggtaaaagagttggaagagtcgctacgccagaagtaccccaagcgggaagtgatgccgctgctgaagcagtttcatactctggccgacaatgctgcgttctggaaccatacgaccgatggtctggcagtgctggctgcaccggggatgttttgcgtctatcgtctgccacgcccggtggccgatctggtcgtggtggccgacagctttcataccaagccattgatgcgcatcacacaatcggccgaccattaccagattttgggactgagccgcaatagctttaaactgtttgagggtaaccgcgacaacctgattgaaatgttccccgtggaaagcggtgcctggacggcagacgaaatgttggataaagacccaggcgcccgcgaaggcgcgcaccgcgcttatggccctactggcggccatggccctactggcgactctgtatggtcgggcaccgacgtcaagcaggatttggtcgaccgcgacaccgagcagtttttccgtgctgtcgatcaggctgtaatgcatcgctatgacaagtctagcggaatgggcttgatcctggccgcgctgcctgagcaccacaacctgttccgctcggtcagcaaaaatccgcagctgctgaaagatgctctggacgtgcatcccgatgccatgtcgattgacgcgctgcgtgagcgcgcatggcaattgatccagccgcaatacctcgaacgcctggcgggctttgtcgattcttatggcgtcgctaatggcaggggccagggctctgacttgctggacgacattgccaaggctgccgtcgaagggcgcgtggccacgctgttgatcgaagccgaccgcatcgttccgggccagatcgacgtcgccaccggcaggatgactgttggcaagctggatgacccagaggtagatgacctgctggacgatctaggcgaactggtgctcaagactggcggcgaagtggtgatagtgcctgctgagcgcatgcctaccaacacaggtgcagcagcagttttccgtttttaaacggcaagacgcccgagaggatatcactcgggcgtctttgctgcggattgagtagtaccagtcccggatgattgtatggtttttatggaagagatgggggatgagttttatgccattctttcatggcctgtattggagttttactcttgagggcagactgcggtagttgctgattatacaggctgacataacgtatcaaggtttgttccagatcttcagcgctattgaatcgatgtgtcttgagtacgtcagcaatacgcccgttgaaacgttcgaccatcccattggtttgcgcagtgcgtggctgggtcaggcgatgttcgataccgagttcctggcacagctggtcaaactgatgattgccactgggattacgttcacggctggtaaacagtctgtcagtaaattccttgccgttgtttgtcaggatacgggtaatcctgatcggacaggcattgcgtagcgccttcagaaatgctctggcgctggctgcggttttgttgggcttgatagccacatacacccaacgcgtggctctgtctatcgacacaaactgtggctttgcacttgacgaatatttgcgacagaattccttttatcggccagcttaggctggtcgataaatgaaatgctggtggtatctatggattatttccgcttgttgtcaacaaaaagaagcgcgtcgatcatgcgagccgaataaccccattcattgtcgtaccacgagatggtcttggccatatgtgtgccgatcaccatggtcgctctcgaatcgaagatcgatgaatgagggtcgttcatcatgtctgtcgagacgaccgggtcttcggtgtaagcaaggatgccgttcaaagtcgtttgcgcggcttttttcattgcagcgttgatggattcgaccgtcacaggcttttcgaaggtcgcgacaagatcaacgcacgaaacattgggtgttggaacgcgaaccgacatgccgtcgagtttgcctttgagctcaggcatcgccttggtcacggcaacggctgcgccagtggtggtgatgaccatgttcacagcggctgcgcgagcacggcggaagtccgacttatgcggtgcatccaggaggccttggtcgtttgtgtacgagtgaattgttgtcatgaggccgttctgaataccgaagttttcatgcaggacctttgcaactggagccaggcaattggtagtgcagctcgcgacgtcgatcacagtcatatcaggagtgaaaccttcttcgttcacgcccaacacaaaagtcatgtcgaggcccttgccgggagccgacatgagcacaaattttgcgccagcttcgatgtgtttcgaaacctgctctttattgcggaaaatacccgtgcattccagcacataatccacaccaagatcgccccatggaatattggaggggtctctttcagaaaaaacgcgtatcttgtcaccgtcgacgctgatcgagttttcggtgctgctgaccacgcccgcgtatttgccatgcgttgagtcgtacttaaagaggtacgcaagctgctcggcgcttgtcagatcgttaattgcgacaaggtcgacgctagggttctgagccgcaatgcgtgcaacgcagcgaccgattcgtccgaagccgttgataccaattttgatcgccatgatgtcctcgtggtggttaggtgtataggaaaaataaacggttctgtcgcattaggcgcaaaacgcatattttggatgagctgacatgccatcctcttaaactagcagatttttattccgccagtgtataaaactgcttagtaactcagtaaacttcttccaaattttatgcctctggccgttgtcactattgctttatctccactattcctcccgcccgtgctattccgctcatgattcgtccagtgtggttacgtatttgtaccacttctccttcggcagcagcagcgagtgcttcaccttccgtgctgacggcaaatcctgctccggttgcggtgagccgtattttctgtccacgtgtgatgatatgtggagcgcgtagctggtgtgtgcgtatcggctggccggaagcaagaaaggttaccgccaccttgccgactacctgatcagaatccgtgactgccctagcggggatacgcacgagatcgacttccttgctcacaatatcctgtgtatccactaattttcccatgttgatgggctgtgcggcgtgtatgacgttggcaatcacttcgatttcaaccggcacataaagcgtccaggcagcttcatcctgacaacgcacgccaactgagaattttccccataagcgtccacctggcggcagaaaaggctgaagctggttacacggacgtaatgtctgacgtgaatccaactggtttgtcttgatgatgaccctgccgggcaggtgacgggtttccacacgcacaaaatcattgattatcttgtgtattgtttctgtaggtaagtcttcgctagcgattgccgttgtagggagcaggaggctgcatacgagtatgatcaataagggttttttgttcatgtccggtatggttggctatcgggattgacaatcaggacggtcagtttttgccgctggcggcaatttttgccgctggttcagcatggtatcgccgcaattccctggctaacctggaaactgaaaggtgatcatggatcagtttgattgattggctggaaataatggcttgctcaatttggcatggtttctgcttgtagtaattatgactactttgcaggaggaaaacatgatcaacaaactggacaatctgctcggctttaaccaaaaggcactcgggttacgagcggcccggcaggagctgttgtcgggaaatattgccaatgcggataccccgagttttaaggcgaaagatttcgatttttccaaggcaatgcaaaacgttcagtcgccaagacaggtacaaagtgcgctggcgacgacttcatcaagacatatcggcttgtccgatttcagatcgattacgtccgtgccggagcagtatcgtgttccgcagcaacccagtatagacggtaataccgttgatatggataccgagcgtatgcagtttatggataacgccatacgctatgacgctggactgacatttatcagcggccagttccgaaccctgttatccgctatcagagaaggaaattaatagccatgtccctgttcagtgtatttaatgtcgccggttcagccatggccgcccagtcacagcggctgaatgtggtggccagtaatctcgccaatgcagacagcgctaccagttcaacgggtgaagcctatcgttcccggcaagttgtttttcgtaccgttgatatttctgcagataaggcaaagggcgtcaaggtggcaggtatcgtgcatgatccctcgcccatgcgggtggtgtatgacccgaagcatccgatggcggacgaaaaaggctacgttaccctgcccaatgtcaacgttgtggatgaaatggtcaatatgatgtcggcatcgcgttcctatcagaacagcgttgacatgatgaacgtgaccaaaacattgctgcaaaaaacactatcaattggccaataaggagagatagatatgagtcaggtgcaaaacaattccagcgtatccgaactgctggcttccaatggggggggcagcatcaagactgcccgcaagggtgatgaggatatgcaggagcggtttctcaagctgctggtgacacaaatgcaaaatcaggatccgctcagcccgatggataacgcagaagtaaccagccagatggcgcagatcagtaccgtaagcggcatcgacaagctcaatagcacgctggaaaagctggtatcggattccgatgcacggcgttcatttgaagccgccaacatgattggccgtagcgtgttggttccaggcgctgacatgcaactggaaaaccacaccggaatcggcggatttgaactgaccgaaccggtagacaagctggtcgtcaccatcaaggatagcgccggtattgccgtgcgtgacattgatctgggcacgcaaccggcaggggtgggcacatttgcctgggatggcctggcaaacaatggtaacgaagctgccggggggcaatacagtttcgccctgaaagccgtgcgcagtaaccaggaggtagctgcttccactctggcatttggttcggtcagcagcgcacaggctggcaaggagggcgccttgctggaagtaggtaggctgggttacgtcggtatgcatgatattaaaaaaatattttgatcaggggagtaaatcatgggttttcagcatggattaagtggtctaaaagcagcctcggccaaactggacgttaccggtaataatattgctaacgctaatacggttggcttcaagcaatcacaagcgcagttcagtgatgtattcgccaattcattaggtgggggcaagaatcagatcggaattggcacccaggtggcagctatcgcgcaggaatttgcccaggggaatgtgaccagttccgacaatccgctagatgtggcaataaccggaaatggtttttttcggacgaataacaatggcacgatcagctatacccgtaacggccagtttcatctggataaggatggatttctggttaatgcaaatagttacaacgttactggttttgccgccgatgcttccggtcagattattcccaatataccggttaatctgcgattacctacttcggatctgacacctaagccaactgccaattttgcaacaggcgtcaatctggatgcgcgtacaagtgttacaagtgtggcgtttgacgcaaacaatccattaacctatgcccattccacttcaggtgagatattcgacagtctgggtaattcccatatattgaatctgtttttccagaaaacaaattcaacggaatggggtgtatttgcaactgtcgatggagctgttgataccactaacgggttaccactcggtgtgacatttggagggggaggatccacttctctgacctttgattccaatggaatcatgactacgcccacaggaccaattgatgtcactgtcgattttcaagcaatagatgctactaaatggggggcgatcccagatcttacattttcgttcgatctgactcgctctacccagtttggcaacaagttcggtgtcaacatgatgaatcaggatggatttacttcgggccgtctggccgggtacagtatttctgataatggtgagatcaggggcagttataccaatggtgtcacacgcacgctcgggcagcttgcgttggcaggtttttccaatcctaacggtctcaaaccgatgggaaacaatcaatgggcagagaccgctgaatccgggttgccgttgattggcacgccagagactggtgtgctgggttcactgcaatcttcggcggtggaagaatccaatgtcgatctgactagtgaattagtcagcctgatcatgacgcagcgcgtgtatcaggctaatgccaagaccattcagacacaggatgcggtcatgcaatccatcatgaatatctgaaggattttctgtttaaccctgacctggtaacgctctaaaaatggatagactgatttataccgcgatgaccggcgcgctgcataccctgacgcagcaggcaacggtttcccataatctggccaacgcctcgaccacaggttttcgtgcacaggccgatgctttccgggcagtgcctgtttacggagagtcgctacccacgcgtgcatttgtactggattcaaccaccggcgcggattttacgccgggcgcgatccagcagaccgatcgtccgctggatgtagcgatacagggttccggctggattacggtgcagcttgaaaacggtgaagaagcctatacccggcatggcaatctcaagacggatgccaatggtgtactgcaaacacagcaggggttcaatatcaagggagaaacggggccgattactattccaccggatagtagggtggcgattggcaaggatggcagtgtctcggtattgccgtcagattcccggatcacggcggtatcaattatcgggcgcatcaaactcgtggatccgcctgcagagcagcttgttagaggagatgacggcctgttccgattgaaacaagggggtgaagcacctgccagcggtaaagtagccctgattgatggagcgcttgagagcagtaatgtcaatgcagtcagtgagatggtgaagatgattacgcttgcccggcagttcgatatgcaaatgaagatgctcgaaaacgcccagcagaatgcccagcaggctagtgaaatcatgacactgagaggctgaattctacctgtttttaattttccaaaaaggataacgctatggttcgctcgttgtggatatcaaaaaccggtctggatgcccagcagaccaaaatggatgtgattgccaataatctggccaacatcagtaccaatggcttcaagcgcatgcgtccggtgtttgaagatttgctgtatcagaccatccgccaaccgggtgcgcagtcatccgaacgcacgcgtctgccttctggtttgcagctgggaaccggggtgcggccggtggcaaccgaaaatatctttttgcagggtaatttgcagcagactggcaatacacgtgatgtagcgattcagggggaaggattttttcagattttgctgccggatggcacgctggcttatacccgcgatggtgcattccagtctgatcaggatggtcagctggtgaccgccagtggctttccgctgcagccatccattaccattccgccgaatacgctaagtatcacgatcggacgggatggcacggtatctgtactgacaccgggttcggccacaccattgccagtgggtaatattcaattgacctctttcattaaccctgctggcctgcagcgctttggtgaaaacctttatctggagactatgagcagtggtgtgcccaatcccggtattccggggactaacggcatcggactgctaaatcagggatttgtggaaacttccaacgtgaatgtggtggaagagctggttgaaatgattcagacccagcgcgcgtatgaaatcaattcccggtcgatccagacttccgaccagatgttaagcagacttacccaactttgattcagtttgaatgaatgtggttttaacacatcagctgtatcaattggaaattcaggctttttggtacgctcatgggatgtgtggcttctgattttatggataggtaatgttctggcgccatggaatttttgtatgaagaattttggggaaacactgattaaattgatggacgtcattgcgaatgaaatgaagcaatccagctgctttgacgcaataaatcagcgtcttcttggcacgctgatttctcccgtattaattgtcatggtcagtatggtgacagggtgttcaatgatcacgcccgcgccgaaagtgcagcaaccgatgacgatccggccgcctgagccgctgattattcctgtcagtcagagcaatggtgggatttatcaggcggcattcaactatcagggcagcgggcgctatacgccattattcgaggatcgtcgcgcgcgcggcatcggtgacaccatcatcgtcatgctcaacgagaagaccaatgcgagcaagaaaagtggcagtaacgcccagcgtgatggggggattgatctttcagtaccgtcattcctcggtttgccattcaaatccatttttcaggatcttgatctggaagccaaatcaagcaacaagtttgatggcaagggagagagctccagcaacaataatttcaccggcacgattactgtgactgtgatcgatattctgcccaacggcaatttgctggtgagcggtgaaaagcagatcggtatcaatcaggggcatgaattcatccggctttccggggtgatcaacccgattaatgttatgaacaacaccgtgtcatcggtgcaggtggctgatgcgcgtatcgaataccggggcactggttatctggatgaagcgcaaaccatgggctggctgtcacgtttctttttgtcgatttcacctttttaagcataccagaggcatatcgctatgactttatccaaatggattcggaatttcgggctgctgaatctcggattattgggctgcctgattatttctgccccagcttctgccgaacgcatcaaggatctggtcaatatccagggcgtgcgtgctaatcagttgattggctatggattggtagtcggcttagatggtacgggtgatcaaacccagcagacaccctttaccgtacaaagtatcctcagcatgctgggtcaattgggcgtgaatcttccgccaggagtcaatttacagttacgcaatgttgcttctgtcatggtaacggctaccttgccggccttcgccaaaccggggcagcagattgatgtgacggtttcatccatgggtaatgccaagagcctgcgtggcggcaccttgctgatgaccccgttaaaagggattgataaccaggtgtatgccgttgcccaaggcagcctggtgattggcggtgcgggtgccagttcagccggcagtagtgttcagattaatcatctgggcgcagggcggatcagtgcgggtgcgattgtggaacgcgctgtgccaacgttgctcggccagggggagtacatcaacctggaattgcacgacactgatttcacgaccgcacggcgtatcgtggagacaatcaacagccgtttttcgtatggaacggccactgcactggatgggcgcgttatccagctgcgggcacccgtggataacaatcagcgtgtcacgtttatttcacagattgaaggtcttgatgtcatgccggcacagggtgtggccaaggtcatcatcaatgcgcgtaccggttcggtcgtcatgaaccagatggtgacgcttgaacccagtgcggtggcgcatggcaatctctcggtgatcatcaatacccagccgattgtcagccagcccggacccttctcacagcgtggtgaaacggtggtggtgccgcaatcacaaatcgaagtgcgttcggaagaaggtaatctgatgttgttgccgggatcagctagtctggctgatgtggtgaaagcgctgaatgccattggtgccactccgcaggatttgctggcaattttgcaagcactcaaggcagcgggatcattgcgggcagagctggaaattatttgattaggttggcgatatgatcaattctcccgacatttccggccagttggccatcgatgcgcaagcagttgatcaattgcgcaatcaagcccggcgcgatccgcaggaagggctgaagcagacggcaaagcagtttgaggcgctgtttctcaacatgatgatgaaaagtatgcgtgaagccacgcccaaagaaggattgtttgatagtgatcaatcgcgtttttatacccagatgcttgatcagcaactggtgcagaatctttctgacaagggaattggcctggcagacatgatcgtacggcaattgtcacaagctgtcggcaaggaacaggctaacgccatagacggagcagaatctctcttgacagctattgtcggaaatgatgagaaaccactggtttcagtggcgccggggcaaacaaaggatctgccttcccaactctggacgaatcttaatcgggctaccgctaaaccaaatttttcagctgtctcgcccgcatggcgaacaaaccggatgggaattgcttccagctccgggaatgatggtcctgagatagctgcggttgatcagcccagagagtttgtgctggatgtattgccgcatgcccgcaaagtggcgcgtgaaaccggcattcctgaacatttcatgattgcccaggccgcgctggaaactggctggggcaggcatcagatccggcggacggacaatcagccaagcttcaatctgtttggcatcaaggcaagcgggaactggcgtggacaagtggtggaaaccatgaccaccgaatatgtggatggtacaccgcaaaagatcagggaaaaattccgggcatacaattcctacgaggaagccttccgggattatgcgcggttactgcagaacactccccgttatgcagccgtgctgaaaagccgcagtgccacagcgtttgcctgggggttgcaacaggctggttatgcgactgatccatcctacgcggaaaagctgctgaagatcatcaacagtgatgcgttgaacatataaggagttgttaaatatttgctgcttttttgcgaataccagcatccagtagcagtggttccaaaggtgttggattgcttcacgccacccacctgtttcactatgttcgcagtgacggctaaagcttaaaacggatctcgcaaagagggcggttgcgggattcataacgaaatgagcaaatatgatgaatcatggctttaatcccactggaattttgccgtaaacaaatagaagtaattcacgataatcgagggtagaacaatggcaaacagtattatgaatgtgggtgtttccgggctacaggctgcacaaactgccttgctgacgaccagccacaatatcagcaatgcgaccacacccggttataaccgccagcaagctattcagagtacgaatacccccctgccgcacagtaatggatttatcggccgaggcgtgcaggtgtcaaccgtacaacgtatctacaaccagtatctggtcagtcagtcgttgcaagcgcaaggccagagcagccaattggatagtcattacaatgagatcaaacagatcgataatttgttggcggataccacttccgggctgacgcctgcgctgcacaattttttcaatgcagtacaggatgtcgcctccaacccgacctcgatccattcccgccaggcgatgttgagcaacgctgaagcattggtttcccgctttcagtcaatggatcagcgtttgtcggaaatgcgtgagggagtgaacagccagattgctagtagcgtgaatgagattaattcactggcgcagcaggttgtgcggctgaatactaatatccaggcagtagaaggctcggcaaatagtcagccggccaatgatctgtacgatcagcgcgatgcgctcatccgtgatctcagcaaactggccaatgtggatgtcgtgcgtcagagtaatggccattacaacgtctttattggtaatggtcagtcgttggtggtcggcaccagtgcgatggcactcaaggcggtgccctcttcaagtgatccgcagcgcctagtagtggcgatggacgtgggcgataaagagatattgttgcccgagcatcagttgcaggggggaagtttgggaggattactggcttttcgcagtgaaacactagatgccatacaaactgactttaatcagcttgccaaggggcttgccgatactttcaatgatcggcatacattaggactcgatctacagggtacggtaggtaaaaatttttttgaggtgacggattccaatcatgttgcgcgaagtattgaggtcgcaatcagtgatcccgctgaaattgcggcagctttaaatgatggaggcagttttgatgatcgtgtggccgataaccgtaatgctttgcagcttgccaagttgcagacaacaaacactctgcagggtggaacagcatcctatcagtcggcgtatgcaagtctggtcagtcaggtgggtaataaaacccgtgaactggaagtcaccagccaggcgcaggagagcctgcttgcgcagacagatcaggccatacagtcattatccggggtcaatctggaggaagaagctgctaacctgctgcgttatcagcggatgtttcaggcttccagcaaggtgatcgaaatcagcaattcgctgtttgattcgttgctcagaatctgatcaatttttgacagaaaaggaatttatcatgcgcgtcagtactaataccttatacgatcagggtacaaaatccatgctgcagcagcaaagttcattgttcaagctgcagcaacagctttcaagcggcaagcgcatcatgaccccgtcggatgatccgatcggagcggcgcgtgcgcatgagttatcccaatcacttgcattgaatacacaatatgctgataaccgttaccgggcaatggacagcctgcagcaagtggatagtacactcggcagtgtttccaatgttatccagagtgtgcgaaccatggcggtagcagcgggtaatccggcctattctgataatgagcggcagatgatggccgtcgaactgcgcggtcatttcgaacacttactgggactggcgaataccaaggatgaacagggcaattatctgttctccggatttaagggtaatacccaaccgttcgtcgagcagtctgctggcgttgtgacgtatcaaggtgatcaggaacaacggctgatacaagtttccggttcccggcagttgccggtaagtgaaaccggtgatgctgtttttgaaccgggtggtcaaaatctgtttcagacagtggataattttattacagcactgaaaacccctggtggtatgcccaatggggcagtgggtaatgtgttgcaggagttggatactgctttggataatgtattgaccaaacgggctgcggttggatcacggctgcaggaaatcgatgcgctgcagcaaattggtgaggatactgccgttcagtatcagcaatcactctcgcgcctgcaggatctggattttgcgcaagctatatctgatatggtgcgtcaacaagccttgctggaagcagcacagaaatcctttacccgtgtttccgagctgtcattgtttaatgtgatttagcctgtttcacttgcccgtgttcagcagattgccggtattcaggtaaattcgtgacgatctgcttttggagaatgatatgaaccgggaagaattgtatttgaagattgcagagctgcatctcaagcgtgtagaagtactgcaaacagttgaatggagactcacattaagtatctggacatttgtagcgggtgttgcgatggtgagtctggccaatgccaataaagtgcaacaggtagccgtggctatggggagctttctcgggccttttgtcatattgtctctggtaagtgccatttatggggtactctggtactcgtataccatcagattttgcaagaagaattacaacagcctcgtaacggaacgtaatcgttatcagcgcatgcagaatgaagcgataaaactccttttgaaagccaaatccagggatttcctgattaaagctgagaccgaagataaacaggttgctgaatcaggttttcaggaaccatccttcgagcatctttcgggtgatagttttaaaaaatcaggtatatggcagttcaaagcggttgtgacagcgacattgatgttcttttcgtggctgcttgttgcaatgattgttgttcctgctatccagtaaaaacctgaatgatgccgtagtggccgcaggtgagccagtctggttgaagcgtggtggttttcgcggcaacttcaggtgtaaggccagccagcacttctgatttgagtgtgcgtaaaaacagggctgatcggccaaagcgctgcaaaaaataatctttttctgtggtgtgcggccagcgtcgatcaccagcaaaatagcgataattcaagtcccccttgaaaataaccaattctgcattctcaaaagtttcacgggtaagtgtttcatccgcataaaaactggcaggtaatcccaatgcaggactggtgcgcagtgtcagctgattttggcgcaacaactgcgtaatatcttcccccagtttgcgtgctgccggaatagatgaaattcccagtttttcgatcagactttccatattgatcatagtcatgtccgaaacaaacatcggataaggcctgacatgcgcaacgatgtgtgaacagtagctgctgatcttgcggatcagcagcaggtctgtcagtacatccattccggcattatcaaacaccagatcaatccgctgcattcgggaagcaattaactttgttgccgcatcacgctcatctaccagcagcgaaacctgatcagcttccgggatggtgtgttgactgagatcagctgtgtttccaatgactgaccagcgcagcagtttgtgggtatcgcagtcgggatcacaatactcaaccagtgtggcaagcgattcaatggcctgtaagttggctgcttctttagctagctggaaaggatcggccggcgcggctgtgctataaccgaaggccagcaaaatccgtgcgtagaaatagagctcgacggtaagaaacggcatgtttgcccagctccgtccgctgtacggtttgattatctgatcaagtgtgccaaaaattaccggtggcaaggtagtgatttttccttcccgcatctctgttgccagttgctgcaaagcgtgtaagacagctgtgtcagcgttatcgataagcttgccaagaatgacaggtaaccgcttttccagtgaaaaggaagcgaaggagccgggttcttcagtagttagacggggtggaggcagaattgactgatgagatggcatgagtggtattcttgaatcttatgactgaattggacattgtaccgggagggtcgtgaaacggccattttccgcagacggggtgtatgggttgtaacaggagagatgaggatgagatggctgataaagagacacgacagactgttatgggtacttggtatgctgattgtttttcctggcacaagtttttctgaagccagtttcgatcgaccgtctcttcacagtaggcaatcccagattcttccggcaatctggatgggaggtggtttgtcgtatttccctttttatattcaaccgcttctgctctatccggaaataccggggctgtacccctgtttcccttttggcagttgcatggtgctgcaaccgtatcggaaatatgaacggcgtgagaaacagcggccagtattcaagcggggagcgcctttggcagatgacgccatggaaatctggcgggcaggattgcgcccagctgtagagccatttcgtactgatgagcagttaattatgccggcattccgggggcacagcctgatccggccggaatatcagaaggctggcagcattctccccgaattttcagccgatgagcggaatgagaacgatgaaaatgagtggccagatgaacagtaaaatccggatacgaatctgttcatctggtgatgaagcagcacttgcactgattggccaggcgacatttctcgaagcgtttgcgggcgttctggagggacaaaatattctcacgcattgtgccaacgcccattctgttgagtgttatcgcagctggctagccgatagtcgctatcaactctggctggccgaaatcagcccgggtcacgcccccattggttacatgactgtcgcgccatcgccgtttttgctgccggacagctcctcgcgtgatcttgaattgaaacgaatttatattttcagcaaatttcaggggcggggccttggtaaaaggctgctacaggaagccattgccgaatcacgcgcccgcatggcggagcgtttgttactcggtgtatatgaacataatgatgccgccatcgggttttatacccgcatggggtttcgcaaggtagggacgcgcaaattcaacatgggcgggctggaatgtgatgactacgtcatggggctgacagtctttgcttccgagtctatccattcggaaaatatattgtaaactgcccattggtatgacgcgtattcatctctcataaaaatagtcgtgtaatcaatctaaacggataacaacaatatggccagaaatgtgcaatgcatcaaacttgggtgtgaagcggaggggctggattttccaccttacccaggggaattgggtaaacggatttttgaaaatgtctccagggaagcatgggggcaatggatcaaacatcagacgatgctggtgaatgaaatgcggctgagcatggcagatatcaaggcgcgcaaatatctcgccacccaaatggaagcctatttctttggtgaaggagctgagcagccggttggctacgttcctcccgaaaaataaactattgcgaccgttttctacattccggaaatattgggcaggggctgatcgtggtaaataacgaaccggacaaggcatcggcaaccaggccggatatcccgcttaccaaacaatttttgaatcgcgagcttagccagattgaatttaatcgccgcgtgctggctcaggcggaaaatgaagaaatcccgttgctggagcgtttgcgctttatctgtattgtcagcagcaatcttgatgaattctttgaagtgcgcattgccgggctaaaagaacagatcaagctggattccccaggttttggttcggatggcatgtcgccgggccagacgtttgaacaggtatccaggcaggtgcatgagctgatttcccggcaatatcagctgctcaatgatgacgttcttcccgcgttggtggagcagggtatctgttttttgcgtcgtaatgtctgggatgacagccagcgtgaatggatccggaattttttctttcgtgagctgatgccgatgctgactcccatcggtcttgatcctttgcatcctttcccgcgcgtgttgaataaaagcctgaattttgcggtcgggctggaaggaaaagatgcatttggccgcaactctggtgttgcgatcgtacaggcgccccgtatcctgccgcgtctgatacggttgcccaaagaagtcagtagctacccctatagtttcgtatttttgtcctccattattcacgcgcatgtcggcgaacttttcgcagggatgcatgttaccggctgttaccagtttcgcgttacccgcgatagtgatttgtatgtggatgaagaagaaatcaagaatctgcggatcgcattacagggcgagttatcacagcgccatctgggggatgcagtcaggcttgaggtagcagataactgctcacagcaaatggcagaatttctgctggaacagtttgcactcaaaaacgaggatctgttccaggtaagggggccagtcaatttggtcagattgatgcaggtgtttgatctgattgatcggcctgatctcaaatttccacgtttcgttccgggtcttcctttcttgccccggaaaaagaaggggcataatatttttgaggtgatcagcaagggtgatatcttgctgcatcatccttaccagtcgtttcagccagttgttgaattcatccagcaagccagcgctgatccggatgttatggcaatcaagcagacggtgtatcgtgccggttcagactcgactctgatggaggcgcttgtggcagccgccagtctaggcaaggaagtgaccgtagtggtggaactactcgctcgcttcgatgaagaagccaacatcaactgggccaagcggctggaagaggtgggcgcgcacgttatttatggtgtctttggccacaaaacacactgcaaaatggccatggtggtgcggcgtgaagcaggccagctaaagcgctatgtacacttgggaacaggcaattatcatacgggaacagcgcgggtttataccgattttggcttgctgacctgtcatgaagaaatctgtactgatgtcagcgaggtgtttttacaattaaccggactgggcaaggcaagcaaactgcggcatctctggcagtcaccttttaatttgcataaccagattctgaacagcatccagcaggaagtaaaacatgctactgcagggaagccggctgccatcattgctaaaatgaatgccttactggaaccggctgtcattcaggcgctgtatgccgcttccgccgccggggtaaaaatcaatctgattgtacgaggtgcctgtgcattgcgccccggtgtaccggggttatcggagaatatccgggtgcgttccattgtcgggcggtttctggagcattcccgtattttttattttctcaacagcaagcagcacaacgtctatctggcaagcgccgactggatgagccggaatttcttccggcgcgtggaaatttgttttccggtgcttgatccacggctgaaaaaacgcgttattgtagaaggattgaaaccgtatttgcgcgataacgtacaagcctgggaaatggatggcgacgggtattacaagcacaaatcagccagaaggaacagtagattcagtgcgcaggaggtcttgcttgaaaagcttgcagcagttaaacaggaggcgatcgaataatgtaatctcatacaggcgttttatagtggcgcgtgcgtagtatcgtaatccttggcaatttcctctcccataccatcaaagctttccatgatctcctgtgcacgctgtaaggcggcctcaatatggggcagaatattttcttggccaatgctgctagtaatggatgaacgctttagcatctgtgctggctggttacgtatgccacacacaagcaaggttttgcccgcctgctgcaaacgttcaggcaaactttccaatgcatgtagtcctgttgcatcaattgcaatcatgttgtgtagatgcagaatcacaatgggtgcgaactgagtaaggtctgttgttttttccaatagtttatcggttgcgccaaataaaaatggcccctgaatgcgcaagattgaaacataggaggggagtcccctgtcttgcaagctgtgagcacgtccgctctgaacatactcatcggttaccgtgtagaccgacgttgtttgtgatacacgatagatatacagcagcgcagccagcacaataccaacttcaactgcaacggttaaatcagctaatacggttaagctaaaggtggcggcccatactgcctgctcggctttaggaagacgtatgatgccgcgaatttctttccattctcccatgttgtaggcgacgacaaagagcactgctgccaacactgccagcggaataaaacgcgccaggggcgctgcgatcaataaaatgagtaacagtgtcagggcatgaataacgcctgcaaccggggtttttgcaccagaacgaatattggtggctgtgcgcgcaattgcaccggtagcaggaatgcctcccaccagtggtgtggccagattcgctacaccctgcgcaatcagctctacgttagagtcgtgtttgtcaccactcataccatcagcgaccactgccgagagcagactttccactgctgcaagtaatgcaacggttaatgcagaagggagaagtggaatgatcagatcaggttggaaagcgggcatggttagtgcgggtaaaccggttggaatatcaccaaatgtactgccaatggtttcaatcggcagattaaatcccgcagcacaagcagttcctaagaacaacgccacaattgagcccggaatatgtttactgatgcgtggaaacagtaaaatgaccgccagtgaagcgcttgccatcaacactgttgggatattgatcgtgtcaatatatgtccagagcatggtaatgcgttctataaattcactgggagcagcaggtgtttgtagccctaaaaaatccttgatttgagttgaggcaatcagtaatgcaatcccgttagtaaaaccaataattactgggcgcggaatgaacttgactgcggtacccaaaccggtaatgcccatgatgatcagtatcacaccagccatcatcgtaaccatcaataaaccggaaaaaccaaatttgataatgatgtctgcaacaatcaccacaaacgcgccggttgggccaccgatttgcgtgtgcgaaccacccaatgccgagataatgaatccggctacaacggcagtataaattcccgattgcggagtagcacctgaagcaatgccaaaagccattgctaatggcagcgctaccaagccaacagtcagcccggcgatcagatcagccacaaaatcctgcctagagtagttacgcaggcatacaacaagtttgggcatccattgattccagccggaagtgtatttactcattgttcgccggattctgttttatctatctgctcaagctcctgaaacatcatcacggattcctcaatatgcgtctgaaagtagcggcgcatgatatccagaacctctataagaagtggatcacgcaccatataaaaaacctgattaccttttttacgcgtagcgacaatctgcttggcgcgtaagacagcgagatgctgtgaagcatttgcctgctctaacgccaacttatcgataataatgccggcggacagctcaccctctcgtagcgcttctacaatagcaatacgcgttgggtgtgccagcgcctgaaaaacactggccttgaattgtcgcaaaacatccgacattgaaacacctgctgttgaaatagaaggatggaagtgtaatgttatatttgtatattcgcaataaagaatatagctatgaattctatatgtggatgaaatagacaaaagacatgagtaatacgaaaagatatcgagatcagtgaagattgtcgtgattcatcgtctgcgcaataatcgttgacacaagcatcttcatcagcgacatcaacgccgataggaagtaacatcactcatccacaaaacggaagatgtcggcaacatgtagtggtcaagtaatttcagacactacgataggttccagggatccaaaactcatctgcatcttctactccactcaccttttacctttcgccagtttaggtgtttatttggctaacgtggggaagttgtgcaggagtcttcaggttgtcggcaccacaatgtcacctggctgcagcgtggggcacaggcatgtttgaatataggcgagaaacacggccccgttcattgggccgtcgagcactaacggagcggtgatcgcatcgtgacgcagtcccgcaatgaaggtggtgctcttccagtggccgttgccgtctcatccagaaagactaggtgacggcaatcccaatgctgctgctcgcgggcccactcagttcgtgcctgacgtacgtctgtgcgcgattgctcgctggcgtgcagggttttttttaaaactcaaccccatttgttcagttgatgccatagcgccggcaccttgatctgaatgccttccgcagccaaacgttcactaagctcgataagcgttagatccggcgtggcttctatccattgccgaatctgcgcttccttgtgcgcaatgcgggatcgccgataacctcccatcggcaagctatggcgctggccctcttctttccatcgcttgcgtacctgatacacccacatgcgactcacctcaaagcgccgggcaattgccgttggaccttcgccacgatccaacgcacccagaatgcgatctcgaagatcttgtgaataggcatgcataaccttccccatcagttgtgatagaaaatagtctattacatgcatatatttaaatcaaaaatgctctagttacacagcagccctggtttaccagggtactttgcaatgagtcagcacggctgccttgtacgtattacctgactcaaagggcgtttttataattcctgaatttgaacacttccgtactgtgtggtaaggatatgagagtcatcgctgagaacacttgcacaaatattttcatcaattggattgaccttcacccttgggcatctttcgcctgaagtgccataattcggcaaaatctttggcttttttgtgtgaagaaccaaaacatagtcatttctcgatcgattatcatcatgtatgacagctaagtcagctttcagtacatggaaaaatcctggaaaaagggtttattttttatccccacatagaataactttcaaagtcggttatggatcctattacccatgggctcattggtgctaccactacgcagtcctttgctaataaacaaaatattcggcaaatatcccttgttggattttttggtgcactcttacctgatttagatgtatttattaatagtgctgctgatccattgttaactgtcgaattccatcggcagtttagccactctctattttttactccggttggcgctctaattgcaaccgtaatcatttggtggttagttagaaaaaagctaagcttcaaagaaacgtatttttatagtcttttggcttatggatctgcctgcctttcagatgccgcaaccagttacggggtgcaattgttgtggccttttacggatgagcggttttcgtggaatctaatctctatttttgatcctcttttttcgctgatattgattctggcggtaggttttgcattctataaaaagaaatctctatttgcatggattgggcttgggtggattgccatttatttggcatttggcttctctcagcaaaagagggtagaggatttggctcatgaaatagctagccaacaaggccacataattgagtatttaacagtcaaaccaaccatggccaatgaaattctgtggagtattcgttatacacaaggagatagtctttacacttatggagtgcgattgttacctttttcaaaaccaaaattatatgaaggggaagtagtggctttgttaaattggaaacaaaaatatgcgccattcaaaggcactactatgtatcaagatatccaacgatttagcaagctttcagacgggatactgattctacatcccgattatggctatgtaattggtgatgggcgatattccttattgccaacaacggctgctccgctttggggaattgagattgatgtcaccaaatcaaattctcatgtacctttcgacacctaccgcaatcttaccaaagaagttcgccaagactttatggatatgttattgggtaagtaaatgaacttatttcatttgaaatgaaataatggggggtttggagctaataaatacaatattccgggtgccggtgcgttaatgggtgattgcattgccgaactcaacgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgcgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggaatctttatcctttgccagacattccatggcttttggatatttagggctaaaacgttcaatacagttatcaaatgctttataagctttttcccgtgtttctgcctgccagatattgtgcagtgcctccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcaaagaaaggcacaacaatattgaggtttggtctgaattagcgatgatggtaacaggcacttagtttctttcttgatgacggcacaacacagctcaatgcctcaagtttgggtcgatccaataccttgatatgtccgcggttgtattcaatcacccccagtttctgcaattttctggcagctttgatgatgtgtctttgattattattattttgttagtggttacgagctagagttagctgtaaagagaacaggtatttatattatttaacactccgtgcgtcatcgcacataccacaagaaattcttgctgtagtatgcctttaacgcttgaagcagaaaaatacttgattttctgtggagtaggaatacagttatattttaattacacatcaatacaatagtaattggcagctgaaccagctttcaatatttttaagatttataggagagtttccatgaagtttacatttcccttatgtggcgctcttttggttgccagcgttgttaccaccactgcagttgctcaggacaagattgatccggctatcgaggcggcgatcaatgcacgtcagtcgcatatgacgctgtatgcgttcaacctggctccgctgggcgccatggccaagggcgagatcgcctataatgccgacgtcgctactgcggcagcagaaaaccttgctgcgctggcccgaatagatgaatcgcgctactggccaccaggatcggacacggcaaccctgggcgaagagcatactaaggcattgaaagagatttgggcagagggcagcaagatcggcagccatgtggagaaactgatcgagaccagcgccgacatggccaaggcggcaggcaacgggctggcatcattacgcgcggcaatgattccgctgggaaaatcctgcagtggttgccacgaggacttccgtgctgcgacggatgagtaagtcggcatagcgtcggccagaggtaactatggcaagattactgcgctacctgattgttttgatgctaattggcggcggcgcgttctggttcctgaccagtccgcagcgcgcagatgtcaatgtattcgcagataccagcggagatgccaaacgcggcgagacgatcttctgggctggaggctgtgcatcgtgtcatgcagcgcccggggccaaggatgaggctcggctggtactggcgggcggctatcggatcgtcagtccgtttggtacttttatagcacccaatatttcgccgtcagacgaaggtttggctggctggagcgtagcggatctgggaaacgcgctgttgtatggtacgtccccggatggccgacactactacccggctttcccctatagcagctatcagcacatgaagacgcaggacatcgcagatctgaaggcattcctggatacgttaccgtcctcggacaccccgaacaccccacatgagcttggatttccctttaccatccgacgcggcatcggtctgtggaagctgctgaacatgtcgcctaattggatgctggaagcagccgactcgccggagcttgagcgcggacgttacttggtcgaggcactggcccattgtggggaatgccatacaccgcgcaacgtgaccgggggactggatcgcagccgatggatggccggtgcacccaatccgtcgggagagggcaagataccgggaattacgccagacacgctggactggaatacaagggatatcgtcttttacctggaaaccggtctggacccggattatgacagcgcgggcgcgcagatggtgtcggtgattgccaatatgggccacctgacgatcgaggatcgcaccgcaatcgccgcttatctcaaggcattaccaccgagcaattagtagtgatgggagcgtacgctgccccctgctttgcggacttccccaggatgcttcgctgctcacagacgacatccagttcccttgcagccggcttggcaagtgaacttagcgttaaccgttctaaatggtgccgtttttctctattccagcattacctggggcaggagcaggcagatacaggcaagctgggatgacgatgatttgagcctctactagattctaatgatttatgcagcacatcaggaaactcagcttacccagtgggagagtgtgaatgtgttggaagtgtggctttattccctatccgtgtaggaagacgagaaacgtaactcgctaccagtacgatttccgtctttgatgaaggagactcagctggtccccctttcaccgcaagtaccagggttgctgcagcgggttgctttacgagtgattctattggacctggaatccgtttggcactggcaacggcccgtgggtcgacaccctttggacgtactatttccaaagggccgattggctcaatcggtaactgcccgtttaatgatggtggcgtcatccggtgacacgaccgggggcttggacgcgggacctcgtctggacgatcttatacgtgttaatgggcattgccgcataacaaagacctttgcataaccctgataattttgttgtagcggtgggggagggatttccaaatgatacttttatgtgtttttaacagaaaaatgaagttttactccttttccaaaggagtttttcacccttatgctgcattggggcagactgctccccttttgaatggctcatccacaaaaattttgttggcagcttttttcagattcatgcagatgcttttcagcacgacttggacattgacttttatcgtgccgaagtagctggcgcgccccattccaaataggtgtttggccgtgccaaaacattgttcgacgatatagcgttttttactgatcaatttgtttaccagcttctgtcgtgccgagagtggtttgttccttatatgcccggtgcatgatcgcgctcttgattttgtgctttttcagaaactgccgattggcgttggcttactgaacctttatccgcatacactcgattcgcctcgatgtgcgtgtgcgcgccaacgatggttgtttcgaaatgcaccatttcgctctggttggcaggggcggtgtgcaccccgcgcacgtagccgtcttccgcatccactccagtgtgatggtctttttaggacgcgccgccgactcaatcagtatggcatcaatcaccgcacccgtcgtacccttgaccatcaaactgtgtgattgaatctgttcattgatagaggccagaagaccatccagcctgtcgttgaccatcaggcggatgcgaaaccggcacagaatagtttcatccggtatcgcatccgacgaggacaaaccgcaaaaatgcagaaaatcaatctgcacacgcagcgcttgctccaatccgacaagctatgtcactgaccaagcaggatcaccttcaatatcatcagtgcgtcaaacggtttctgccctccaccatttgatagctcgcgcttgtataaaccagtcagcatcggacgtaatgctccccagtcaatcaacgcgtcaatcttcatcagcgcgttgttttgtttcagacgttgcgccagttccagggatccaaaactcatctgcatcttctacttctctcactttttatcttttgccagtttaggtgtttatttggctaacgtggcgaagttgtgcaggagtcttttcaatatgaatgggtcatccaggatcgggattctggtggttgatctatcagccaccatcgttcccaccgtaataaacagataattcctcctttactcgttgattaagatcaacttcaagcgcagcagaatacttgaaaccttatttctgaaatttcaaaggagttgattgactcctgatcagggtagcaagctgccgcgaagctgaccgaatgagcaaggcgtaatcaaaacaaaagattgcgatatttcattcaggaagttttttttaattcaaaatcttactgaataatgagatttgttatacacctattttcaaagaagtatgcaccgtttacggtgcatactgaacgttatgtccttgagatagtggagcaataggtagtcatggaatatcaattagacattaaagaaaacgcattagatagctttaatgaggcactggctaagtttgagcaaggtgaaagtggcgaattacgtcactacaaatttgctattttgcacctctcccattttttagaattagttctgaagctatatgttgcatccgttgacaaaaatctcgtttttagtaaatgctacaaacatgtcgagaagcgggctaaaaaggaaacgataaatttacttcaatcatatcaattactatgcagtgaaggcttcgacttcgaggcggtgctaaccaatattccccacccacacacaatcacgctcgatcaagcactagagttttctaaatgtgaaaaatgtggcgttactggtgtcgattttgttgacgtggatttttgtaatgacatcgagtggctgaaagggttgcgaaacaatatcgagcattatcaatttaggttgccgcctaaggaagttcgcctttgtataggccgtttagttcgtggtgtagcagaatttattgatatctttagcttgtttgatcttgaaagtgaggttggtaaagagagttatcacgtttttgaggtcttggcagatgaatatgcccagcttctgaaagaggctgaaagggaggttgtagaaaaagaagcagaaatatacaagggagtaagaccaaaacactacgtgtttatcgaatggaatgtttatcagtgcccagaatgctcgaataatacaatgataccttcagacgattctagcaccgggtataagtgcaccttctgttcaaatgaggaaagtgacgaaatagaaattccttgcgattgctgtggggcaatggcaacagttgaggatatggccacttgggaaatagatgatggcaccgtcgagaatcggtgttacttttgctcagggcagtactatgcagataaagatgactgacataacaatcgcatcaattgggactggttttccgctggcgttccaaaccagcccattacacgggcgttaggcgtcataagagagtgggctagtagatgaagcgattgatcgacctttccaacgaagaagcacgggctcatttccttaagggcagtagctactttaacggtgatatgccgcgttacattagcttcgagccgatactgaaagaggttgcggctattctcaacggaagaagcttcaacgaacataaggctaccaatcccgctgagctgtcgaacgtaaattacaacttcatcgccaataaagatggccggttcgcttggcgtccttacgagctaatgcatcccgcaatttatgtgtcgctggtgaacgtaatatgcgatgaggcaaattgggaaattattaaagcccgcgttgcagggttcgaagttggagtcgtcgattgttgtagcgcgccggtaatgtcggtcgatcatcaaactgatgtggcaactcagattaaaggttggtggcaagccgtcgaacaacggtcgctgacatattcgttggaattcagccacctgctccacaccgatgtcactgactgctacggctcgttatacacgcatagtatcgcctgggctgtgcatggccttgatgaagctaaaaagagcaaaggtaagaacggctttctaggaaacaaaatagattttcatattcaatcgagccgctatggccaaacaaacggcatctcacaaggttctgtcctcatggattttgtggcggagctggtactgggatatgttgatgaattgataaattctgaacttgggagctgcacggatatccgaatactccgataccgggatgactatcggatttttgcaaatagcgatgaacgtgcggaagttgttctaaaaatcgtgagtgacaaactccgatccgtaggaatgaagctaggcgtcacgaagacattttcgtgcagaaatgtggttgaaggctctataaaaccggacaaactggccggaattgagctgcaagatctagggaaggccaacgccaagacgattcagaagcaactaatgcggctgcatgcattcggtcagcgacatcccaatagtggggcattgcgccgtttggtcagcgagtttcactccagcgttacggcacaaactaaagctcccgacgatctagaggtgcaggtggcaatagcaaccgatatcgcttttgtctcgccagcaacattcccagcagttgccggtatcttgagtcacatgatttcactagcgtcggatgatgagaaattacgcctttggactaaggtgcgggataagatgaagcgtgtcccgtataacggatatttggaaatttggctgcagcgtgtcacccagccaaaggctgttggcattaatttcgagagtgatgagcccatctgtgaaattgtaaacggcggcacaccgcaattgtggaattgcgactggattgcaagtaacgcattgaaaaacgccattgacgtcaagaaaatactcattgaggatgcggctgacgcgaccgaggttatacagccggaagagatcgaactgttcaagcaaaatgcatgggcttactaaattgatgttacgtgtaagccagtgccaatgacgccgaacaaatcgttgcagcggacatttgacccgccacccatttttgctgccgcaaaaacaggcgtcgcctcaaatgccgctgaactcaggcgttatgtctatttgaattcacttcaacatctacataaatgggggaatagaaatggcaaaaataattgaagagcagcttaaaaactgcaagtcgtgcgggaaggtgacgaagcatcaccgtaatagctccaaatcgagtggcttcacgctgcttgtacatttggtgttaaccgtggccaccatgggcgcatggttggtgctggttattatttggaaaatattaaatactcagattggtgggtggcgctgcagtgaatgtggcaagtgattacataacaagccgcggcaattcgctccccgcggtcgccgaacgcgttccgcgccgttgcgctcagcgttatacgaaagagctaacacatgaatatttgggacgaaaataaactagcgctgtttatcgctttcgtggtaccaggcttcattgccattaaggtgtacgaactcttgtcaccatccaggcaagtcgacacttcaaaacaggtagtcgatgcagtttcgtatagctgcctgaactacgccatccttctttggcctatttatatcgtggaatctagcgatctcaggacaaaccatccccagacctatgcattgttttatatgggggtcttatttgttgcgcctgtgcttctcgcaatattctggaaatatttgcgtgaactggactggattcaaaaattcgtcccgcacccgacccaaaaaccgtgggatttcgtgtttgctcaacggcaaacatattgggttattgtaacgcttaaaaacggagagaagattggggggatgtatggccctagctcctttgcatcaagcgcaccatcggatgagcagatctacctagaagaacaatggctacttaatgaagatggcgggtttgatcgtaaagccgagcaaacatcggggataatcatcctatcttccgaaattcgatcagtagaatgacctttcaaacgtcctgtgcctctgtaggtttcacgacgtattatttgagcttggctattggtcacttggctcaagctacgatgtcatcgtaaagcccactttgcgggcatgggcgctgcaggcgcttctgcccgccaccatcgcgtttcgccgcccgggagcgttccagccaggcgggctgtatctggcgcaacaccgccagcgccatgcattcaatggtgcgtaggcgcataacaactcggtcaaccggacgcaaacccgctgcgcgggttacctcgggcgttaggcgtcactgagctcaggtattagacgtttcgccaaccaaaggagtggaccatgtcagatgcaaaagactttgaaaaaaggttctcggacaatggcttttgggacaaggttgttaaatatgccaaaacagccggccaaggagttatcgaaaaagcgctttggctttattacgctgcccaaaaccctcaaacaccaatgtgggctaaaacaaccatatatggtgccttaggttatttcatttccttcattgatgcggttcccgatatcactccagcagtcgggtatgtcgatgatcttggggttcttgcagccgcagttgctgctgtaagcatgtacattactgatgaagtaaaagcccaggcaacacaaaagctaagagactggttcggcgtgtaaatagtctaaccactcctcaaccggacgcttaaaagcagagcttggggttccctcgctaacgctcagtgccggttagctcaaacattagattgtaatcatgactgctcgcacaataggtcatctagctcagctctttaagggactggaaaaagacgttggctcatgccatggattcgtttggttcgcggctattccaatagtctttggcggctcctcccaggctacctaagaatctgttcaatatttcactgaagagtgcattatagcgttgaaattgaactcaaaatgctcacatacttcaagtatgcttcgctttcttgttcaattttgccttgcattgcatcccttgatcgggatcttgatcaggttctaagactacagtatgttgatcgtctcaattccgattctgattccggctaatctgaattttttcctgtgtaatttcctggatgctggcggtgccggtcagtgccatggtcagttccagttcatctcgcagcagtcgaatgatgtgcgccacgccaagggcgcctgctgtggccagtccccagatgtaggggcggccaaccatgactgcatctgcgcccaaggcgagtgccttgtaaatatcccgtccattacgaatgccgctgtcaaacagtactttccctcggccagaaatggcgctgacgattggcggcaggcaggcaaggcttgctggtgtgccatccaggacacgtcctccgtggttggaaaccaccagcccgtcacatcccaggttgatcactttttcggcatcctccgagtgcaggatacctttgactagcagtggtagcgaggtttgatcccgcaaccaggcgagatcctcccaacgtggggcttgcgccatccagccgttgaatacttggctttgttgcggtagcaacgcgggaaagggagcgggaagatccagatttatcggttggatggtcgtcggcagctggatggttgcctgtttaaccggggcatctaccgtaaatatgatggcgttgtaacctgctgcaatggttcgttgcagtaattttagtgttcgttcacgattttcctgccagtacagctgaaaccataagggttgtccggctgcgctgataatatcttccagcgtttggctcgccaggctgctgacacatgactgcccttcctgcgcactggctgccatggcgctagccgattccccatgtgggtgatagagttgttgatacgctaatggtgccagaatgacgggatgggcaagcgtctgcccaaacagggtgattttcgtatgaccgctacgtacatcggacagcggccgtggaatgaggtgaatggagtcaaatgcatgagggttagcttgcaagctgacattattagcgctgccttcctccagataacgccagatttcaggtggcaggcgttctttggcataagggaggtaatcggacgggctgtgtatgccttccgggacagttgagagtttaggtaacagctcattcattttaaaagtgctgacttattttgtcatcatgcggtcatcaggttgcggtgattcgcccatcgttgcgaaaatccacaggattgaagcaatccagttagcgtattatttttcaactctccgcccactgccgcagcaggttatggtaggtgcccgtcaggctgacaacagcttcagtttcgcctatattctggcgcaattgcagcaatgccatatccatttcatatagcaggcggcgttgattgggatcgcgcaccatactttggatgaacatgaaacaggcgatccgttctccgtgtgttactggcgttacctgatgaacagaagaagaagggtatatcaccatacttcccgcctgcagtttcacgctttgttgaccaaaggtatcgttaatgaccaattcaccaccatcgtaggtttgtgggttggacaggaacagggtggcggatacatccgcgcgcacgtagccgacgccatctggcaacatacgcatggcattgtccacgtgaaagccataatgattggtttttccgctgtagcggttgaaaaatggcggcatgattttctttggcagagttgccgtgaagaacagggcattacggttcaacgcccctaataccagtccgcgcagcgctgccatttgcggggaatcttccggcagttgctgattgtttttgactttggccgcctgggcgccggcggttaccaggccgctcacccaggcagattcagctaacagactgcttgctgctgcgagctcctcttcagttaatacattgtcgatcgtcagcagcacttgattatattttcggttaggactaaatcagaatttgtattcggctgtcatgataactctgcgacgctggccagggatagtaaatgggccgttgtcatagatggcatcataataggttgtgttgaacacgttctgtacattcagccgcatagcccatttcggttgttcataggccaccatcgcatcccagcgcatgtaggcaggtgcagtgttcggatggaacttggtttcacctggcaaggtagggattgggccggcgccacttggattgtaaccgtaacgcttgcctttgacctcgacaccgccgcctattttccagccataaggcagcctgtaagtggtccacaggttaaatgtgtagggcggggtgttgcgcggacgtttgcctttatattccgggttggctgaagtcagaacacctgttgtggcgttgacgttttcagcaacttccagaatctccggatccatcagagcaagcccggagaatacttcccagttgggtgtaatacggcctgccagttccagttcaatgccgtttgtacggcgctttttggtaagaattgccgcagtggattccagatcggtattacgctcccattttttttctgcatgatagagtgctgtacgcaatgcgaggtcaccatcaaacagtagccatttggcgccaatttctttgacattactgcgttccggtggcagaggttgaacggtgagttgatacaaatcggctgtcgggctgaatgagctgctggacgccatataaagatgggattgatcggaaaagtggtaggacagtgctgcgcgtgtactccattgaccataattcagcttgggagaggtcgcgctggaatatgttgcccgcatttcatcgcgtcttcctcccagtgtgagtttccatttggggataaattcaaccgtatcctgtacatatactgcgtaagtatcggaattaaattcgactggaattcctgctgagttggctttgtaaggccggaacagaggcggattggctgacgtggttccactgaagttttgtagagaatgacggaagctgtcttcattgagatattccccgcccagcaggaaatcgtgattcataccaaacaaatggaatcgatggttatagtctgtctgtaccgttatggttttgtaattcatggtgcgggttgggccgccattacacgatgtgggtgtgttacataccttgccttcggcattgggggcaatagtcaggctgggggtacgtgcccagtaactgcgttcatagtccgcataacgtacctgcgtgcgccattcactggcaggcgagaaatgatgggtaaaggtggcggttgagatattaactgtacctttgtcaaaattactgttggtaccccagtaatatttcactggaaatttttcttgtggtttgcgtgttgtgctgtcgaagttcacaccgtaatccggcttgtcatctactgtggtgtagatatggctcagaataagttcgttgtcggtgttaagcccgatccccaagctggcggcgaccccgtcccgttccagtgtcggtctgtcattggctgccgggtttttacgccagccgccatcaaaccgtttcattccattgaagcggaaggcgatggtgtcagtaatctgtttgttgaaatcaccggtcatctcgtagtaaccgtacatgcccacactaccggtaattttccccctgtctcccagatgcggcactttgctgacctggttgataacaccaccggcctgaccacgcccaaacatcattgctccggcaccacgcagtacatcgatttgttccagatagaaagtttcacgattgtactgcgccgtatcgcgaatgccatccagataaatatcaccaaaggtatagaagccacgcaacatcatattgtcgccagaacgtccaccctcggcagcgttgaaagtcaggccggcaacattgcgcagcgcatccttgagcgagctgacttgttggtcttccatcaactggttggtgacggtcgtcaccgcctgagggatgtcgtgcggatcctgcaacgttttgccgacacgggtggtggtggcacggtacccgtctttttcagcttcggcacctgcttctaccttgatggtagggagaacaggcgtttttttggggtaatcatctccttctgctgcaaaagcgctgattgacagcccgccggccatcagggcagcgccgagggggagtaatgttttgggtggttgtggcatttaatttccttctaacaagattattggctggcttgcagctggtagttgaaaaatacaaataaggattgttcgtgttcaggagttaactcttgactacagtaattaggttgatcccggagtgaggatgataaacatgcgcgcgttatcaactgcttgaatgcgcattcttcaaagcagttggcctatgtgtgcgtaatgtgtaaatcaaatattctttattatttaatttttaatgagaataattataattaatgttaacgttagtatcaatatttttatgctttatgggaactatttgaaattgataccttgccagatggggaaaaatacgtgattaaggcgggtagagagtggcagataagaagtgaatcccagatatttcactaggaaaggcagatgatagagatctgaatgtgagtcgagcggaaagcaccatactacttttccgcatttgtaaacatcagcaaaccttgactgcaaaccacgaacaaagtgtggcaagcagtggaataaagcaattcggaataatattgatggaatgtgcgagactacttatacgcctgttgcggtcaggtactttcacagcggttattccttaattgtttcgctctagaatattggcaacatctattccagacgaaaattcaggtataagaagatagtggttgaatcattgaaatagagatagtctgataaaaacggatattctttctgggtacaatgattaaaaccgggatgttgccaggttcgttttgatgcagaaaaatcgatttatttaaggctgattaatgttactgaagatagctttgctttttcctggcatgattttgactttctgggttagtgctatatgtggagggggggccagcctgattctgatcccgctgcttagcttgtttcttcctgcttcgctggtccctttttcgctgacgctgggtacatttgccagtgcagcatcacgtatcgttgttttcagaaaacacgtcaatacccggatatttctctggtttattccatttgccattccagcggtgcttctgggggcgtggttgatcaagtttattaatcccctatatcttcaatttggggtggctttttttctcttgtttaatattccacagctatttcagtcagggcaagaactgcaaaaaggtgaaaaaccttaccccaattatatactggctctggttggcttcctttgtggctttgtttcaggagtgatcggggcggtagggttactttttaatcgcttttatttgagatatggattaagcaaggaagagattatcgcaacccgggctgccaatgaggtatacctgcatgtgataaaactggttgtttatacttcacttgatctgtattcggaagcagccttgagtctggggctgctgatagcgctggcagctgtcgtatcttctttttccataaagtttatcttgcctctaatcagcaattttgtttttagaaaagttggatatggagtaatggtggcctcgggttttgtcatgttgttcagtacatcgtcacatgtcatcgagcaagataatctgcactttctttcacaaaatagagggtatgaaaacgagattgcgatttcatggcgtaacagtcattttgtactcgaatatgacgccaaggatggtgagtttggaattgaatggccggttggttatgaggatttgccccaggatctgaagcgatattttgatgaattgaaggatcaatatgacaaaatactgcttgaaaaagttttcaagttcaaaggagtatcaagctatgaattttactgctataagaacggtgcacttaccaggatggattttaaatctgttctgacagcgagctgaaatacggttagcaagtgatgtggcaatatggcatcaaaatttttattacggttgttctggttgttgctgtttccgagatcagtcggcgcagctcgttttggggtgcaattgttgcgtccttgccgattacttctctgcttgcgttcatatggctctacaccggcactgacgatattgaagtcgtggtgaagctctcatacagcattttctggcttgtcctggcatcattaccgttgttcctcgtgttgcccgccctgctcagacacgacatcatgttctggcctgcgcttgcaattgcgtgtggtgttacggttattatatacctcagtttgatctgggtactggggcgttttaatgtgcggctgtaatatttgctatacgccacttcactcaagatactgtccggccaggtagatgctggccggattttatttgactcgattatttttgttcgccactgggtttttgggaagctttctgtgaagcgcggaccgcttccagatttttgatggcttcttcatttccttgttcggcagctttttcaaaccattcgactgctttattggtgttttgctcgacgccttcccccaacaggtaaataacaccaagattattttgtgcgtcaatatttccttgttcggcagctttagtgaatagctctacggccttggttttgtcctgaggaacgccttcgccagtgaaatacagcaacccgaggttaaattgtgcgtcagcatgaccttgctctgctgcccggtagaaccaccctgccgcagcttctggatctttactcaaggggtttccctgggcgtcgtgtgaaacggcttctcctgaaaaatacatggaacccaggccattttgtgcttctgcatcaccagcttctgctttcttacgcagattcagaaagcgctgctcaggagtcagtccgtcatccagtgttggcatgatttttttcttcagttcatcttgctctttttctgacaaaccttctttcaggaatgatggaagttcgccggcggtggtggattcacccattaatgtaacttctgcttcattggttgctgttttttcggtggagctcttgttcccacagccggcggccaacaagagtgctgccaaaagaactgcgatagttttcatgctgttttccttttttctgatttattggataaagatcaaccggatagctccggtgttgttgcattggctggtttcatgtatttcgttgattggtaataaattagttcaatcttcaatgatggcaaacatgcgccggtattccttgattgcatagcgatcggtcatgccggcaatatagtcggcgattatctgatgcccatggtcgcgaaatttgtgctggtatttgggaggcaataatgcaggttcagccgcaaatgctgaaaacagtttttcaacgatatggtgtgctttattgctcatgcgcatcacctgataatgcttatagagatttttatgcagaaaacgtttcagctcctgttgctgttgcctgatcgtatcgctgaaaccgaccagggtcggcatttctcgcacgttgtccgggctgttcgggttggccgcttcaatgtggactttgctttgtgtcgtcaggtcagttgctaaagtattgatcatgccacgtacagtttcatgaaccagacgtcgtccggcaatatccgggtagtgttgctttacctgatgcaaatgccgagcgaatatttcgatttcttccagttgtgcctgtgtaatgaggccggaacgcaccccgtcatctacgtcatgattgttgtaggcgatttcgtctgccaggttagccagctgtgcttccagtgatgcactacggccatgcaggaaacgttcacccaattctcccagtgcttgggccttggatttcgtggctcttttcagaattccttcgcgggtctcaaaacataaatttaatccatcaaatcgggcataacgttcttccagtacatctactacccggagtgactgcaggttgtgttcgaatccaccatgggctttcatgcagttatccagggcatcctgcccggcatggccaaacggagtgtggcccagatcatgtgccagtgagatggcttccaccagctcttcgttgagttgtaagttgcgtgcgatggagcggccgatctgggcaacttctaaactgtgcgtcaggcgtgtgcggaacaggtcgccttcatgattgacgaatacttgggtcttgtattccagccgccggaatgcggtggaatgaatgacacgatcccgatcgcgctgaaactggctgcgcccgatcggcggatcttcatggatgcggcgaccgcgcgagttggtatcggatacggcgtaggggggcagattattacgcattggcaacacaggctgacaatgtttcaagcagcagcagagtgggaacagtgttgtccagtgaagccttgccgatccgatccagcaggatgaaacggattgcgccgtccttcacttttttatcgagttgcattgattccaggtagcgttcaggtgtgatacgtgggccttttactggcagtccggcattttcaaacaagtgctggatacgatcggtatcctgtgaagtgatgcgttgcaggcgcttggagagatcggccgccatgagggtgccggcagcaacggcttcaccatgcagccatgcgccatagcccatagtgttttcgatagcatggccaaatgtatgtccaagattgagcagtgcgcgcacaccgctttcacgttcatccagcgaaacaatttctgccttgatttcgcagctgcggcgtatggcataattcatcgtttcaggatcacgcgccagcagctgctgcatgtgacgctccagccaatcgaagaaatctgcatcatggatcaatccatatttgatgacttctgcaatcccggcacgtaattctctgtccggcagggtagtgagcgtggcggagtcggctaaaaccaggcgtggctggtaaaaagcgccgatcatgtttttacccaggggatgattaatgccggtttttccacctacggatgaatccacctgggcgagcagcgtggtgggaatctggataaagggtacgccacgcaaatagctggcagctgcaaaaccggtcagatcaccgactaccccgcctccgagtgcgatcagcggtgtcttgcgttcacagcgatgttctagcagcgcatcgaaaatcagattcagtgtttcccagtttttatattgctcaccgtccggcaggatgaccgcaaaggtttctacctggtgttcagccagcgcgctgcgcagtttttccagataaagcggcgcgatggtggtgttggtaacaattgcagctttcttgccgggcagatgagggagcaacaggtcaatcctggtgagcagctcctgtccgatatggatggtgtaactgcgattttccgggagagtatcaagtgcgacttcaactgattccatggcattcatctggtgctcttcaaaggttggtttgcctggtataaaattaacctgctgttatttcggctgtttaacggagggatgatttttcagctcagcgccggttgattcctgattgagctgatgcaatctctgcagcagtttctgtacgaaggcgcgggcgctttgtttgccgctgtccatgatgatgtgtgctgtttcacgatacagcgggtcgcgttgtgtaaacagcccggccagcttggcatgtgcatttcctgtttgcagcagtggacggtttttatcctgatgcgtacggcgacgcaactcggagacaggtgcgcatagataaatcacagtgccgtgttgccgcaataaagtgcgattatctggatataatattgcaccacctcctgtcgccaggacgatattctgctgctggacgacttcccgcagcacttcgctttcacgtttgcgaaacccggcctctccctctatttcgaagatcacggggatccccactcccgtacgttgctggatctcatgatcgacatcgatgaaagttttgccgacaagattggccagcaattttccaaccgttgttttaccagcgcccatcatcccgatcagaatgatattgcccggtatcaactcggcatcagaattttttgtggttggggttttactgcgttgcataatgcaattgtactgtaaatccacagccatcctgcgagttcccctagtgtggatcctgatttaatggaataaaaatacagcaaaaatagaattaaccgccagtttataaaaacctggcaacaaatgctttctcgacatttccggtgagtgggattttaacgcgatagccgctgccgggagcaacgctgacagtgttgccgtcaagatcctgcatgtattcgagctggatgatacgattaccggagggatgaacgatttccaggcgatcaccgatttgaaagcgatttttgaccagaatttcggccataccggaagcagcatcaacctgttcgatatctccgacatactggctgcgggaggattcggagtggccacgcaggtagttctgggtttcctcgctgtgatgacgctgatagaagccatcggtatagccgcgattggccagcccttccagctgacccagcaaggcgggatcaaaggggcgctggtgggtggcgtcgtcaattgcctgacgataaacctgtgcagtgcgcgcaacgtaataggttgatttggtacgcccttcaattttgagcgaatcaatgccaatctcggctaggcgtgcgacatgctcaactgcacgcaaatcttttgaattcatgatgtaggtaccatgttcgtcttccatgacgggcatcagttgtcccggccgtttgccttcttcaatcaggtaaacctgatcggcgttagggtggcgttgcgtgggaacattgtcaaagggagaagattgtgatgacaacagcgcttcattgaagtcgaagtcaattttttgcagtggctcgatgtctccactggcattttctgtggcaggctttaccttgtagtcccagcgacaagagttggtgcaggtaccctggttgggatcgcgatgattgaaataaccggacagcaggcatctaccagaataggcaatgcataaggcgccatgcacaaatacttccagttccatatccggacagagttcgcgaatttcggtaatttcctccagcgacagttcacgcgataggatcacgcgcggcagaccaagcgattgccagaatttgacggcggcgtaattgacggtattggcctggacagacagatgaatcgggacatccggccatttttcccggaccagcatgatcagacccgggtcggccatgatcagcgcatcgggttgcaactcaatgaccgattccatatcgcgcagataggttttgaccttggcgttatgcggcatcagattactggccacaaaaaactttttgccaagctgacgcgcttcggtaatcccggcacgcagttgtggcagtgtgaattcgttattgcgggcacgcagtgaatagcgtggctggccggcgtagactgcatctgcgccgaaggcataggcagcacgcattttttccagggagccggcgggcaggagtaattcgggggctttcagcatgatgtaaaatgaggtgatgtgtcagcaataatttccgccgcactgattatccggtttttcaaaatttcacttggtttttattgtatcaccatgctgattaaccctgtttttgttcatttgcggttgcacagtgaatattccgttgtagacggtattgtgcggattgaagaagcagttgccaaagcgcgcgatactggtatgccggcgctggcgctgactgatctgtctaaccttttcggattggtcaagttttatcagcatgcctgcaaggctggaatcaagccgattgccggatgtgatgtctggatcagtaatgagaatgatgcggaccggccgtttcgcttgctgctgttgtgccagtcattttccggttatttgctgctgagccgtctgctgtcgcgcgcctatcgggagaacatgcagcgtggtcgtgcggaactgaagaaagactggtttcgggagggagccgggacagaaggattgattgccctgtccggaggggagcagggcgaagtggagcgattgttgctggcggatccagccgccgcaacaacagctgctcaggaatgggcagcgttattccctgaaaggttttatctggaaattcagcgctgtggccggcctgatgaggaagtaacaaatcatgccatgctggagctggtttctggtctaaaactacctgtggtagcaacgcatccggtgcagtttatgcagccggaagatttcagagcgcatgaggcacgggtgtgtatcgcacagggttatgtgctgggagatcgccgacgcccccgggagtttaccgagcagcagtatttcaagacagcggcagaaatgagtgagctgtttggtgatgtgccggaagcactggccaatagcgtggaaattgcccgtcgctgttcactgatgctggaattgggagtcaaccggctgccggattttccaaccccggcgggaattagtgttgagcagtatttgcgtgatcgggcgcaagcagggctggttgtacggatgacacagctgtttccggaagcagcgcagcgtgatgaaaaatatccggcttatcaggcacggctggattttgaagtggaaactatcattcagatggggtttgccggttacttcctgattgtgtctgactttatcagctgggcgaagcagcacgatgtaccggtcggaccggggcgtggttccggagcgggctcgctggtggcctattcgctggatattactgatctggatccgctgcgttacgacttgctgtttgagcgtttcctcaatccagagcgggtttctatgccggattttgatattgatttctgtcaggatcggcgtgagcaggttattgaatatgtgcgtgatcgttacggtgcagagagcgtggcgcagatcgcaacattcggcacaatggcggccaaggcagtggtacgtgatgtcggtcgcgtgctcgatctgccttacaattttgtcgatcaactagccaagctggtgccattcgagttgggtatgaccctgcacaaggcgcgtgaaattgagccattacttaatcaacgtgcagaagcggaagaagatgtgcgcaatctgctggaactggccgagcgtctggagggattgacgcgcaacgtgggaatgcatgccgggggggtattgattgctccagggaaaataaccgatttttgcccggtttactgtgctgattcgggggatgcggtcgtcagccagtatgataaggatgatgtcgagaaaattgggctggtgaaattcgacttcctcgggctgcggacattaaccattctcgatcgggcggttgctgatatccgacagtaccagttggcttcattggatgggaaagatgctggtgagcaatctgtggaagaaaatcgcttttcactgggcgatatttcccttgaggatgcaacaacttttgcattaatggcaaaaggcaacaccgtcggaatttttcagtttgaatcacgcggcatgaaagatctgctgcagaaggcgaaaccggaccgctttgaagatctgattgcgctggtggcgctttatcggccgggaccgatggatctgattcccgatttcatcgagcgtaaacatggcaaacgggtggagtatctggatcctcgcttgcagccaattctcgggccgacttacggcatcatgatttatcaggaacaggtgatgcagattgcccaggtgattggcggttacagtctgggcggagctgatttactgcggcgcgccatgggtaaaaagaaagtggaggaaatggcgcagcagcgcgcggtttttgttgatggcgctatcagaaatggcatggtggaagcagatgccgtaacgttgttcagtctgatggaaaaattcgccggctacggctttaataaatcccacgcggcagcgtatgcgctgattgcttaccagactgcctatctcaaggcacattatcctgcagaattcatggcagcctgtatgtcatcggatatggatgacactgacaaggtgaatgtgttttatgaggattgtaagctgaacggtattgccattctgccgccggatattaatcagtctgcctattattttgttccggttgatcgcaaaactatccgctatgggttgggcgctatcaagggaacgggggaggcggctatttcggcaatcgtgcgggcacgggagcagggaatagcatttaccggcctgttcgatttctgtcaacgagttgatcggcgtattgttaatcgccgtaccattgaggcgctgatccgcgcaggggcatttgatacggttgaagctaatcgtgctgcacttatggcatctgtcgggatagcactcgaatacgcagaacattgcagcctgactgccagccaggtcagtctgtttgatgacaatgctgatctattgcagcagccggttataacggagatcgcacaatggccggagaaagaaaagctgcagtatgaaaaaatgtcattggggttttatctgagtggtcatccgtatgacagttatgccaaagaactaagccgttttatcccggcgcgccttggacggattgctcccgggcgtgagccgcagctgattgccggtgtgatctacgcgatccggacacaaatgtcccggcgtgggaagatggcgattgttacactggatgatggtatggcgagagttgaactcgtggtttacagtgatttgctaagtacgaattcgcagtttttgaaggcggatcagctgctggtggtaagcgctgtggtcagccatggtaatggagaaaatgctgaaaaacgtattgtggcaaaagaggtttttgattacgcgactgctcgctcaatgcatgccagaaaactgagaatcgtgattgatagcccggtgcttctcactcccgcgcaactcaaggaattattgactacatatcttccaggaagtagtgtgcataatgtgctgccttcagcagtttgtccggtgtcaattgattttcgcaatgagggggccggatgtgaaattgacttgagcagtcgctggcgtgttcatttgcatgaaaggctgatcgaggcgcttatggatagtcttggtcatgacaaggtggaggtgatttactgataaccggtctgcctcaggttccgtgaatgtactccacataaacccataacatcatgattgcaaacaatgtcagagatagtatgacgcgtgcggtgagcgccttgaccatccgcgtgctgttacccttgtctttgatcatgtaatacactgcagagccgagggtatacagaatggatagtaaaagcaggatggcgagtgttttcaaggattctcccggtggataatgatggtattagtaaaccattttaatattccttgttgtcatttgaaaacttcagctgacaacattaaaaatcatgattcgaacaaccgatcggttgttcacactttttattgtaactgataacagttggccgtgaatcttcctgatacagaatctccagcagccatttttctgatggggcctactgccagtggtaagtctggcttggcaatagaaatcgcacgtcacttcccggtagaagttgtcagtgttgattcagcgcaggtttaccggcatatggatatcggcagcgccaagccggacaaatcgattcagatagaaatcccgcatcatttgattaatttgattaaccctgatgaaagttattctgctgcgcaattcagggaggatgccttgtctgtcatgcatgggattacagcacgcggcagaataccgctgttagttggcggtaccatgctttatttcaaggtgttgcaacaaggattggccacactgcctgcagctgatgaggctgtgcgcaaggagctggaacaatcagcccgcgaacaaggatggcctgctatgcatactgttctgggtcggcttgatcctgtcatagcagaacgcatcaaaccgaatgacagtcagcgtattcagcgcgcactggaagtctgttatctgactggcagacctatgtcagcagtgctgaaacaacagcagagtcgtgattttccatatcgtgtttttaatatcgctctacttccgggtgatcgcagcgttttacatgctcgcatcagtcagcggtttgacaagatgctggaaatagggttggtgaatgaagtacgtatgatccgtgatcaattccaggtgactgctgatatgcccgcaatgcgttgcgtcggatatcgtcaggtatatatgtatctggagaatgaaatcagcttggctgaaatgcgggagagaagtgtttttgcgaccagacagctggccaagcgccaattaacctggctgagagcaatgaatgaattgcatggctttgattgcctggataatcagttagcccaacagattatcggctttatgcagaagcagcgtatctttgcctgagcagtgtttcagcagtggtggttgtctgttttgtgcctgcaactggaatgatgtttgcatcccgcagctacaacgctacacccgcgtcggaattgtatagtctgatttatcaatcacacaacgatatcaaggaagaatacgcagggattgcgcaatagaacaagatcgatttgccacccggcgtgctggacagattatatgaatattgatgacgccaggatttgttaatggcgtccccaaggggattcgaacccctgtacccaccgtgaaagggtggtgtcctaggcctctagacgatggggaccagtattgcggataaagtaaaaagctggtggagataagcgggatcgaaccgctgacctcttgcatgccatgcaagcgctctcccagctgagctatacccccggttaagacaagtcggcaattatactgatcgccctatttattgtaaagctgcctgttggaattgctaattttcatatggtcctgtattcagttaggattgaagattgctccccagttccgtgttcttttaataattttggctgcgcggcttgatgcccaatgttttaattttccggtaaagatgagtacgttccaagcctgcgcgctcagcaacacgggtcatgttgccgttttcctgttcgatcagtttctcaaaataattcttttcgaaaatatcccgtgcttcgcgcagcgatatgttgagcggaatatctgaaacaacagacacggcttcgcgtgaggagaatgccagggcctgttgtacagcatcgacagagatctcatcatccgcacaggttagcgccagtgaatgcacgatacttgtcagttgtgcaagattgcctggccagtcataattacgcagtgcattaagtgtagctgtactgaaatgcatgagaggtacttctcctgattcaatccagcttgaaagcaattggttggctatttccggcacatcttcgcggtgagcacgcaagggagggatggtgatacagagattgctcagtatttcaaacagttttgggtgataggctccctgcgccgtcaactctgccagagagcgtgttgttgcacaaaccagtcgtaccccatattgctccagcttgccgagcagcagcaacaagcctttctgttccagtttgctgagatctccaacttctccgaggaaaagtaatccgccttttgcctgttccaattgtgccaaagggctttctgcaaggaatgaacaggattccggagcaacccaggccgtgttaggacgatgcaggaatcgtgcgcagtgttccacgccaacccccggctcgccggttaacaagacgggaattttaaggttttccacttgctctagtttttttcgcagctccgtgattagtccgctgtgtcccaaatgtgatagggaaagagccggcgaagatttatgttgtctgccgccgcgcatgacctgcccgaccgtattgagtaatttctgcagtggaattggtttttccagataaccaactgcaccgacacgggttgcttctactgctgtatcaattgtaccgtggccagacatcatgacgaccggcatggtcaggaggccgttattcgcccaatctttcagcagtgtgatgccgtctgtatccggcatccagatatccagcaataccagatcggggcgtgtctggttgcgatagtttctcgcctgttctgcattttccgcgagtgcaacgctgtaaccttcatcccccagtatctcggataataattcgcgtatccccagctcatcatccacaacgagaatagtgttattggccatgtgatccttatcctttcatgtgactggggtacgagaatttgtttttgcgggcggtatccatccctgtttacgcttgttatggtgcagattcagatttgattccagccttctggtcgggtgttgtcccggagctctgttgttaagagttttcaattttgtaaatagcgacgaactgctttgggcagagcagttatctctatattgtgccttgcatgttttgcctgtgcaaaattttgtgaaaatgccaactgatttactttgcaatctgcaactggatcactgagcatctcaggcatgagctgcctcagacgaaacatgcgaactgttgtggaggaatgcaggcagaatgattgaaacctgtgcaccatgcggctgaatattttgtattttgacagtgccaccgtgctcatccacaatttttttgacaatcggcaacccgagcccggtacctcttggtttggtggtgacatagggctcaaatacatgtgttttgacctgctccgggaatcctttgccattatcagtcacgctcagctcgattccgttattaacggatctggtccgcacagtaatagcagcttcttttatattggccagtgcatcttgcgcgttctgcagcaagttgtgaatgacttgacgcaacctcgccggatctcctctgacaggggcaagctctcctgctagttctatcgtgattggcggcagtggtgattcgttttctgtgttgtcagttgtctgataaagcgccagaatctcccgtaccagccggttgatatctacctggtataactcgggttcaggtactcgtgcgtattcccggaattcgttcaccatttttttcagggcttcaacctgattcacgattgtttctgtagaacgcttcagaattctggcatctggctcgtcgagtttgctgatcagcttatgctgcaaacgctcagcggataactggatcggcgtaagtggatttttaatctcatgcgccaggcgtcgtgctacttctccccatgctacggtacgctggacttgtaacaggctggtgatgtcgtcgaataccacaacaccgccaccggatgcctggggtaggcgagagcctcgcagaagcagcacctgctccttatctgcattgaagtgcaatacttgtctttgccattcaccaacctcttcagaatcaaagccgcttcttatttccccggccaataatcgcaatcccgcttcctgtttggcgcattcttctatggttaatccctcgaaattggtcagcggaatttgcagtatttgctctgcactctgattgactgcacgtattctcaatactttatcaaagacgataacacctgatgacagattggccagaatattttcgagataggcacgtgcattttcaatttcctgttgatgctgctgtgcgatggtgcgtgcggcctccagttgttcagtcatgagattgaatgattcagtcaagataccgaattcatcagtactgtgaatctggtgtcgccggctgaaatcaccctgagctacggcgcgtgttccttctgccaatgaccccagtggcgcgcttaatttttcgctgatcagaaatgcaccggccagtgcggaaaacagagcaagcaacaaggccagggtcaatgttacgctgtacagccgagtcaatccctgacgagacagcattaattcctgataatcactaaagccagcctgaacgatttccgcgttgtgtgcgatggattgcggcacccgttgcagtacctgtagtactcggatatcttcgttggcgcttagtatgttgactggaacaagtactcgcagatacagcgtgttattcgcgagtgtttcgaccgcactgtaatccctctgcatccggatgcgccgcatcgcttctgtattggggatttcgggaaacaatacggtatcatccaaaccggtaaaggcgatgacctttccatcctggttgaacagggtagcttcctgtatttgtgattgaattagaagctgattcaaaacggtcaaaggaaatgatgacggttcagccagatcaattgcggcggcccgcgcctttttctgcaattcctccagcaggttatccagtatcgtttgccccagcgttagtccaccttccagtgcgcgatccactttgacatcaaaccaggattcaatactttttcccagaaactgtactgaaataccatacaccagcgcgccgggcagaatggccatcagggaaaaaaccatcagaagccgcagtgccaactttgaaccgaatacaccagtcttgagtctgcgccgtaatcgtccgagtagaaatccaacgattccaatcaagagcagcagaaaaattacgatgctgacaatcagccagcggtaatggcgttcaaaaaattcggtattggctccggctgaggccagcaggaatagcataatggtacttaatcctgcgacaacgaaaataacgtatttcataaacgggctctaacgataatcagattcgttgttagcttcaggggtaggcggaaatgtaacctgccagatttttttttcagaaatgagattccagtcctgagtatcaagccattccagttgaaacggtttagatagccgtgagacatccagccatacctgcagaactgcggtgtaagtggtgtccgggaggagtggggtgtgttccctgatcaaaagatctggctgatgtcccaaagcctgtaatgctgcttttagtgttggaaaattttgtgactggccgcgttgaaccaggcgatattgcctggttagtgcctgatagctgagcgtggttctttctttatagcgagcgacttcttcattcagccaataccagcgtggtttcataatcaaaagccgggtgacgaaataaagatcgaccccctttttcagggcttgcttcatcgttttgctcaaaccaatgtcagcctggacatcgatataaaagcgtttgcctgattctttaagctggaaagactctatttctatatgtcctttggcggcaagtgtggttgatgaaaacagcacgattaacaataaaacgatactgagccagggactccttatgtcagcgtgcatgtcagtttttttggagcaaggcataaaaaaagccatcatggtgcggtcccggcagcagctggccgttgttaatttcttcgtgggagcagggtaatctgctggcatcctgatggattgacaggaatttttcagtaatcaggttattttcttcattgaatacggagcaggtggcatacagcagttttcctccatgccgcagtaatggccacagttcattcaatatggttgtctgaatttgtgcgaagttatctgtgtcacctggtcttctgagccatttgatatccgggtggcggttgaccacgcctgaagcagaacacgggacatcagccaggattcgatcatacaattggccattccaccattgcgacggattcattgcatcgccacaaatcaactgataatcagttatttgcaggcgagagaaattttctgtcaacctggtaagccgatcttcatatttatccagcaccgtcaatttgatattttcagttaactcagccagatgggtgctttttccgcctggtgcggcacaggcatccagcacacgcatccctgctttgacatccagcaggggggcggcaaattgtgcgcccgcgtcctgtacagtcaccagtccttcggaaaacccgggtaatttctccacagagaccggcctgataagttgcagggcgctgccccccaaccattcggagccaatcccctgagcatccagcattgcctgataatgattaaccgaggtgcgtaacgaattaatgcgtaaaatcatagcagggtgctcattgcctgcgagcagaatggctttatagtcctgcggatattgctgacgcagtttgtcaatccaccattgcggataggaatagcgggcgacttcattgctcttgatttgatcaagcaataaagtgcgctgccgcatgaaattacgtaacacagcgttgatcaatcccgatgcggcaggattgcgtgtgattttgcgggaagatgacacggcgtgatcgacaatggcatgtgccggggctttgctgtaacaaagctggtagagtgcgattgccaacaggtaatgaagtgatttgtcttgtgccggtttatttaataattgatgaaggatggcgtcaagctgaccataatggcggagcgtgccataggcaatgtcctgaatggcgccgcgttgttggggcgtaagccgggaattgatctgccagatgttacgcaatacttcgttcagattggcgcctgcaaaaacctccccgattgcctgtatggccagtaattgaatttcaatcattttcaagaaaaatcacaggtgaccctgtgtggttttttggaaatgttctccaggttgtaaagggtgcccggcaaggaattgcgcggcagtcagtttttttccacctgctttttgcagaatgttgatggataaagcatctcgtccgcatgccacgattatcccgttatggtcagcagcaataatctcaccggcctgacgggtgtcgctgcgattgatgatattggcctgccatagtttgatcatgctgccatgcaggctggtaaatgcgccgggatacgggttaaatgtccggatcatccggtcaatatgggtggaatcacgtgtccaatcgatctcggcctcggattttctgatttttgctgcataacaggcgcttgcattatcctgtaacgtgggagttagtttgtcctgatccagcaatgtcagggtttccacaatacatttaccacccagatcagccagcttgtcgtgcaaggtggcggcagtgtcatgtggttctatgagaaatgcgcgttttagcagaactgctccggtatccagcccttgatccatttgcatgatggagataccggtttctgcgtcaccctccaaaagagcgcgttgaataggggcggcgccacgccagcgtggcagcagggaggcgtggatgttgatgcaaccgtgacgcgggatacgcaataccgcttccggtaatattagtccgtaggctgcgacaatcattacgtcaggcttgagtgtttcaagttgtgtttgtatatccggtgactttaatgtttctggttgtaatagtggaatgttgtattgctgcgccagtatcttaaccggacttgcctgtagtttcatgccgcgtccagccggtcgatccggttgggtcaggaccaggaggatatcgaatcctgatttttgtactgcctccagggctttcgccgcaaaaacgggagtgcctgcgaagatgattttcatgcgtgaccgtgctcgctggatcaatgtgagttaccggaatatgagcgctggttggtatctggtcaggcaatttgtttacgcgcctgtttttttagcttgctcagaatacgggattgcttgaaaggtgatagatattcgacaaataccttcccgataagatgatccatttcatgctgaatacaaaccgccagcaatccggttgcatccatttcaaatgattttccatcaatatcagttgcccggacagtaatctgttcggcgcgagaaactttgtcaaaaataccgggtacggaaagacagccttcctgtgtttccgattttcctgtgctggcgataatttccggattgattaaaaccagcagttcgtcacgagtttcggaggtatcaattacgacgactcgcttatgaacatccacttgggtggctgccaggccaacaccggcagcggcatacatggtttcggccatattgctggccaggatgcgtatttcccgagtgactgatggtacgacggctgcaattttatgcaatcgttcatcgggatatcgaagtatgttcagaattgccataacaaatttgcatagttcaaatactggagttttggggaaggttctatcattgtgcactggtcaatttttatgatcaatccggtgctctgtccagtctggtgattttgtggttcgtccggaacaaacaaaataactttacttttccgggtaccttgatggagatgaagaacccttatgcgtactttgacaattatatctgcgattttgtttatcaacctgttttccgggttgtcttctgcggctggtgaaaccagattgcgagagaatgcacctgagcattaccaggttgttcccggtgatacgctctggggcattgcttcccggtttctcagagagccgtggcgctggcctgaaatctggcggatgaaccgtgagcagatcaggaatccgcatcggatttatccaggagatgtcatcattgtggaaaatactttgtatggcagccgcctgagaatggcaagtgaaaaaggtaccgtccggctttctcccgggattcgcgttgagaagtcagcggtgcgggccattcctggtattcctgctgagaaaatagaaccttttctaagtcaaccactggtaatcgaaaagggtagattggatggagcccctgttattttaggagcaagtgatgatcgggtgattctgagcaccggtgacaaaatttatatacgtgatctgcccgttgatcagggtgtaatctggcaggtatttcgtgacgggaaggcattgactgatcctgatcgcgataatcgcatcctgggttatgaagcagtttatctggggactgttgaaattactgattttgcagctatcagtaccgcaagaatttcccgttcggtacaggaaattctgaaaggcgatcgtctgcttccgctttcatcagcaaaaatagataattacttgccgcatgcccctgatttttccgtggtcggtcgaatcatttcagtttatggtggagtgaatgaaattggcgagaatatgattgttacgcttaatctggggagcaacagtggaattgaaccggggcatgtattggctgtttatcacgagaacaatattcggtcgcatgagggaaagcagattggtttgcctgatgagcgggtgggtttagcgatggttttccgtgtatttgatacagtttcctatgcgctgattatgcagagtacccggtcaatcaaggtggcggatgttgtaaaaacgccctgacaaggtgatgtaaagttactatactcgcccgcgtgttaatttttgtagtacagcttttcggttgtttaaggttgttatcggggtgagttcttttttctatgcagattgaccgggatattgaatcttggctgcgccttggcctgacagagggtgtagggagtggaagcttgcgccgattgctggtcgcttttggcgatccagctgaggtgcttgctgcaaatcagcgtgcgcttgaaggtgtcgtaaaaaaaacagttgccaccagtatttttcagcgcaaagtggatggggataaatttgccaaaacgattgaatggctgcaagatccgcttaattcactgattacgttagcagatccggattatccgggacttctgctcaatattcctgatccccctccaatcctgtattttaaaggccagcggaaatttctggcgcgaccggccctggcaatagtcggcagtcgcaatgcaacgccacagggatttgcaaatgccgatgcttttgccgaggctgccagtaacgcaggattctgtgtgatcagtggtctggcgcaaggtattgatacagcggcccatcagggtgggctgcgcggtgcatcttccagcatggctattgttggcaccggacttgatctggtctatccctccaagaatcgtgaacttgctcataagctggcagatgagggtgctctgatttccgagtttcccttgggggtgcccgccatgagcaaaaattttccgcgcagaaatcgtatcatcagcggtatgtgtcatgcatgtttagttgtggaagctacgttgtatagtgggtcactcattactgccaggctggcgctggagcaagggcgtgatgtgatggccatacccggttctatccattctcctttgtcaaaaggctgccatgcgttgattaaacagggcgcgaaactggttgagaatatccaggatattctggatgaattgaatcatcagccgatacaacaaattgaagctgctccggttaatcataatgaaacgggtggattggtagatgcaagtagtgattgtattgatgataccgggctactaatatattttgactatgattccatcgatattgatacgctttgcatacgcagtggcttgacggttgaggcggtatccgccatgctactgatcttggaattggaaggtaagattggtagtcttcctggaggaagataccaacgtgttcattgattcattgagtgtttggtggtaattcgttaccctgtttaaggtgtcttgtagtaattttaatttgaggttgcagggtgggctatgttcgatattcttgtgtacttgtttgaaaattacttcgataccggaaactatccggattctgctacgttgacccggaaattaaccatggcgggctttgatgacgaagaaattacgctggcacttgactggttgtccgaattttctcatcacgatacggagggttatctggctgggctggctgaaagcaattcaatgcgccattttacaaaagaagagatggagattattgatacggaaggacgcggattcattttctttcttgaacaggctggtgtcattaatccgctgcaacgtgaattgttaatcgatcgggtcatccgcatggatggtgatacttccagcgtggaaaagataaaactggtggtgctgtttgatctttggatccagaatcagttggccgacagcaataccatcgaaaaattatttgtagtcagtgattcccatcagcggcactaatgccttgcaggtactctttccatccaacccgttcatgaccggcaaccaggagaccggatgatttgatcggctgacgtagcccgtgtgtcagttgttcattgtgtctatagcagtttataagtaccttatgagtaaaaaactaatcatcgccgagaaaccttctgttgctaatgatatagcgcgtgtcctgggcggatttaccaagcagggtgactatttcgagagtgatgaatatgtcttgtcctccgcaatcgggcatttgctggaattaattgtcccggaggaatatgaagttaagcgagggaaatggagttttgatcatttacccgttattcctccacgctttgatcttgctccgatcgagaaaaccatggatcgcctcaagctgttgagcaagctgatcaaacgcaaagatgttgatgtgttaattaatgcatgcgatgcaggacgtgaaggtgaactgatttttcgttatatcgtgcgtcatactggcagcaaaaaaccgattaaacgtttgtggttgcaatctatgacacccgtggccatacgggaagcttttacaaatctgctggaagatagcgaagtgcagcctttggcagatgcggccgtcagccgttctgaagcggattggctagtaggtattaatggcacgcgtgtcatgactgcattcaactcgcaggaaggtggatttcataaaacgacagtcgggcgtgtgcaaacgcctacactggccatactggttgaacgagaagaggcgatcaagaagtttgtggccagggactattgggagattcatgctgtttttcaggcagaaaatggttcctataaagcgaaatggtttgatgaaagctttagcaagcgtaaggatgaatctgaatccagggcggatcggatttgggatcatgccagggctgaagcgattcgggataaatgcgatgggcgaaccgggattgtttccgaagaaagcaaaccgaccagagagaactgccctttactatacgatctgaccagtctgcagcgggaggccaatagccgttttggtttttctgccaaaacgacgttaggacttgctcaggctttgtatgagaaacataaggtgctgacttatcctcgtactgattcgcgtgcacttcctgaagattattcggaaacagtcaaggatacgctgcaggcgctgaaagaatcacattatgatcagtttgccagccagattttaaaatctgactgggtgaagccgaacaaacggattttcaataatgcaaaggtttcagaccacttcgcaattatccctacagcgctggttccaaaaaaactcaatgaagcggaagagaagctctacgacctggtgaccaaacggtttctggcaattttctacccggcagccgagtttttggtcacaacccgcattactagggtggaagatgagccttttaaaacggaaggcaaggttttggtgcatgctggctggcagactgtttatggcaaggtggaatctgtccgggggcaggaagaagagtcagtgctggtggcagtgacaccgggcgaaacggttctagcccaggaagtaactgcagttgccaatcaaacgcgtcctcctgccagatataacgaatccacgttgttatccgcgatggagggtgccggaaaactggtggaagatgaagagttgcgtgcagccatgagtactaaagggttaggtacacccgctacacgtgctgccatcatagaaggcctgattcatgaaaattatgttgagcgttcagggagggagttgcaaccgacagccaaagcattctcgttagtgactttgctgcggggaatcaaggttcccgagctgatttcacccgagttgaccggagactgggaattcaagttgcgtcaaattgagcagggccagcttaagcgtgatgtcttcatggagaagattgccacgatgactcgtcatatcgtcgagcaagctaaaaatcatcgaggtaagactatcagcggagattttgcaaccctccaggtaccttgccctaaatgcagtggcgtaataaaggaaacctataaaaaatttcaatgtcagcaatgtgattttgcattgtggaagattctggcagggcggcagttcgaggtgaatgaaatggaaacgctgatttccacccgagaggttggtcctttgtcaggctttcgcagcaagatgggacgtgcattcaacgcccttgtcaggttgacagatgatcatgaaatgaagtttgattttggcaacgaagccacccaaacagaagaggaagtcgatttttcggcacagcaagtgcttggaaaatgtcctcagtgtggacattctgtatatgaacacaaattattttatgtttgtgaaaaggcagtagggccaagcccttcctgcagtttcagaaccggaaaaattattctgaatcgcgctatcgatacggaacaggtgatcaaactgcttcagacgggcagaaccgatttgctgacaggatttatttccaagaaagggcggcctttttctgcttacctagttgtagggacggaaggcaagatcggatttgagtttgagcagaaaaaagtgaagagcaagcgtgctgacgctgttccggaaaccggtaaagcagcttcttgatctgaccggtagatacctttcatttttttgtgttcccggaacagacgtcagattagccatatatataaataatatagcgaacgatgcctgaaacagcggtgataaggatggacaggctgcctaccagcgcaagtccttcgactacgaagaaagatagcgcgtgtcccaggctcctgtattctatttctcccgattcattgcggtgccggtctttgcgaattttaacccaatagagaaccataaaggcaatcggaagggccagtatcgaataaagcaagttggctatcggtgcagtatcttccatcagttaacctcgttgaatatgaataaagttattataagaaaagggttgtattgtatttgatctgaggtggctttagtagagtcggttgcgttaatgtttcggtgacagatgtaaattgttaatttacagataggttcattcagtaagggttatcagtacaaaaaatatccggggcttaagtgggtataaattcggctggataatctaaaaacagaattgccactttaatgtacatttgcctaatttgaaaatgattcacgaagctggatcaattattgttgaacgaatgaaaagaaatcattatgttttgattgattcctgccttttactggcagaaagtcgctagcttatggaatggcttgatctttctctggttcgttgtgcagcaggtaaggtacgtttgccgggttcgaaaagtatttccaaccgtgttcttctgttgtctgcacttgctgagggcactacaacgatcagtaatctgctcgaatctgatgataccgggcggatgttggatgctctgaagatgcttggggtagctgttactcgcactgatgaaggtcaatatctgataacggggtgcagtgggagattttctgtaaaggaagctgatctgtttctgggcaatgccggaacagcctttcgcccgttaactgcggtactgtcattgatgcatggtcattatcatctttcaggtgtgccacgcatgcatgagcggccgattggcgatttagtggatgcgttacgtcaagttggggctgtaattacctatcttgagcgagagcattttcccccattggagatccatccggctgcaatccacccagctgatattcttatcaatggaaatatttccagccagtttctcagtggattgctgatggcgttgcctctggctggtgagccagcaaccatcattgtcaacggtacacttatttcacagccctacgtaacactcaccattgcgcaaatggcctattttggcgtgcaggttgaacgggaatcctggctgcgttttatcgtgccagggaatcagatttatcacagcccgggaaagatcgctgttgaaggggatgcatcgtctgcttcctattttcttgctgccggagctatagcaggtggcccggtgcgtgttgatggcgtgggacgcgatagctgtcagggagatatccgctttgttgaagcgctggaagcgatgggagcttgcatcaaaatggggagtgactggatagaatccagtgccccaggctacagatctgacggcaaggttttaaaggcgattgattttgattgtaatcatatccctgatgctgctatgacactggctacgaccgcattgtttgcgcaagggacgactacgctcaggaatatagcgagttggcgggtcaaggaaacagaccggatcactgcgatgtcaacagaacttcgcaagctgggtgctcaagtggaatctggcgatgattttctgcggatcacgccgccggacggccctttggtggccaatactgtgattgatacctacgatgatcaccggatggcgatgtgcttttccctgatatccttgggtacaccggtgcgcatcaatgacccacattgtgtagctaaaactttcccggattattttgaaaaattcacagccattacacaccaataatttccagaagtgtattgaacccaaattttacaagcaacaatttaaataccggaagtatcttgcttggatcgagtgaaccatgaaaaatcaatatgttccggtaatcacactggatggtccttccgcatcagggaaaggtacaatcgcccgtcttgtatcacaggtgcttgggtttcattaccttgatagcggtgcactttatcgtctggtggcgctggctgccatgaagcgcggtgtagatgccggtgatgagcaaggagtggttggtattgcccggagtctggatgtgtcttttgcagattcatcaatccggctggacggaatagatgtaagtgatgagatccgcgcagaagcatgcggagagtatgcttctaaaatcgcacaatattctgcgctcagagtggagctgctggagcgtcagcgaggtttccgtaaactaccgggtctggtagctgacggacgcgacatgggatcagtcatttttcctgacgccactttgaaaatttatcttactgccaatgaagaagagcgcgcgcgtcggcgccataagcagttgatggagaagggaataaatgctagtatcgcgaatcttgtcctggctcttcgcgagcgtgatgagcgtgacagcaagcgtgttgcatcgccactgcaacagtgtgaagatacacgtttgctggatacaactggcctcaatatagatcaggttgtcggcaaggtattgggtatgtatgctgactccggtagtaggtagtattgagtgactttggaatttaagtttttcagttgttatttttattaaccaaccaacctgtccccttttgttttttagaggggaattgtttacgatcgggtattttttaaatgactattgcaaccagtgtagcggattctacagaaagctttgccgaacttttcaatgagagcctttcgcataaggaaatgcgtgtgggtgaagtaattactgctgaaattattcgtgttgattacaactttgttgtggttaatgcagggcttaaatccgagagctatatcccgattgaagaattcaagaatgacaggggcgaggttgaggctcatgagggcgactttgtcagtgttgctattgaagcgcttgaaaatggttacggtgaaagccgattgtcgagagataaggcaaagcgcctgaatgcttggtatgagctggaagatgccatggaaaaaggcacaattgttaccggcatggttaacggaaaagtaaaaggcgggttaacagccacaatcaatggtattcgtgcttttctgccaggttccttggtggatatccgtccggttaaagacatgacaccttatgaaaacaaggaaatggaattcaaggtgatcaagcttgatcgcaagcgtaataacgtggttgtatccaggcgtgcggtgctggaagagactcaaggagcagaccgggatgagttgctggccagtttgcaggagggggcggttgtccaagggattgtcaagaacattacggactacggtgcatttgtcgatctgggtggtattgatggattgttgcacattaccgatcttgcttggcgccgtgtcaaacatccaactgaagttatcaatgttggtgatgaagtttctgccaaaatcctgaaatttgatcaggaaaaaaatcgtgtgtccctgggactgaagcagctcacggaggatccgtggattggcctttccaggcgctatcctcaaggtacgcgcatgttcggcaaagttaccaatatgactgattatggtgcctttgttgaaattgaacagggtatcgaaggcttggtgcatgtctcggaaatggactggaccaacaagaatgtttatccgtccaaaattgtgcagttgggtgacgaagtcgaagtcatgattcttgagattgatgaagatcgtcggcgtatttcactgggcatgaaacagtgtaaacccaatccttgggaagaattttcactgagtcatgaaaaaggcaacaaagttactggtcaaattaaatctattacagatttcggtttattcatcggcttgccagggaatattgatggtttagtacatctgtccgatctttcctggattcagacaggtgaaaaagcaatcagtgaatttagaaaaggtgatgaggtggaagctgtagtgttgtccatcgatgtagaaaaagaacgtatttctttgggtatcaaacagttggaaggtgatccctttaatatttatgtcgcttcgcatgataaaggcagccttgtcaagggtaccgtgaaatctgtagatgccaagggtgccgttattgcactgacggatgatgtagagggttatttacgtgcttctgaattttctcgtgacaagatcgaagatattcgtactcgtgttaacgaaggggatgagcttgaggccgcgattattaatattgatcgtaagagccgaagtatcagtttgtcagttaaagctaggatccaggaggaagaagataaagcgatcagatcgctggctccatctccagccagtgcgggtactactaatctgggtgcattacttaaagccaagattgatagtaaatcttcagaagaataaaagctggtcatgacgaaatccgaactgatttccaagctggcggaacgctttcctcagctgctggcaaaggatgcagaattagtcgtcaagattattctggatgcgatggcgaaaagccttgccagaggggaacgtatcgagattcgtggatttggcagtttcgatctaaattacaggccttcacgtgtcgggcgcaaccctaaatcaggtgaaaaggttcatgtgccggagaaatatgttcctcacttcaaggcaggtaaaaaaatgcgagaactgattgattccagccataaacagcataacctgcttgatcaggctacaggctagaaatccgtgtctcttgaaaataacgttgcaccagaagaaagcgtgtctcatttctttccgattttttgttgcgtaaatctacaatatgctcggaaatcagtgaattactgatcacgctttcctgcgtgattacttggaataggcaggtgttccgagtatgttgcaatcagataaataagtgagagagcggcttaaggttgattttatgggtatttccgggaacactaatcggagttgctacagggtctttatgacctcgtgtctccctttgttttacttttctgagttgaatcagaagaaatgcacatatttatgacccttgtacgcctgattgtctttttgtttctactcagtgttgctgttaagaattccgagatggtgacaatacactattatcttggaatggaatgggaagtccctgtagtagtcgtgcttttcctctgtttcacagcaggtgccctattcgggtatttatcctgtctcattaaaaaaatccgtaggaaaccctgatattactggctgtatgaatgattcgcgcattatcgtcgcactggatttttctgaccaaggcacggcgttgaattttgcagccacgctggatagcagactttgtcggattaaggttggaaaagaactttttaccctggcaggtccgcagctgatcgagaaattgatgcgactgggctttgatgtttttcttgatttgaaatttcacgatattccgaacactgttgcggcggcctgtagtgttgcgtctagtttgggtgtatggatgatcaatgtacatgcgctgggaggaagcaaaatgttgcttgctgcccggcaggcgttggatggaaagagaaccagactcatcgctgtaaccttgcttaccagtatgaatcatgatgacttaagtgagctaggcatatctggctcgccggaaattatcgtgcagcgactggctctgcttgcacagcgctgtggtttggatggtgtggtttgctcggcgctggaagcagccagtctgagagagaaggcaggtaaggatttctggctggtaactcccggtattcgatcatcaaatgataatagggatgatcaggcaaggatttcgacgccgactatggcaatacggaacggggctagctaccttgttataggcaggccgattacccggtcaccagatccgcttaaagcgctccagcgatttaatgacgagattgtttcggctttataattcagtaatttgtacttccggcagctttctggaagatattgaaaaaacctttctaagtgcccaatcctgactggccagaaggctggtgattaaaacggttgctttgacgctcctgcgagaaatttttacctgtaccccagcagtaaaattacgcttgttattaattttattcaaagtaagtaccgccatacctattgcccacagacagaagcggcgtatccctgtttcatgcgatgggatcaggcaggtgtagatcatcgcgttgtgcagatgtgattttgcaataccaatcagggcacccagcccatcatgaaaaccttgtgcgcaacggcctggttgtaaattatcgagatcaaacccttcttccagaaaaatatctcttggtaaccagcatgcccctcgttttctgtcttcccagatatctttcagaatattggtcatctgtaatccctgaccaaaagatacagccagtttcatcagggtcgatttatgttgattgatttctggggagtaatcacagaataattcagtcagcatttcaccaaccacaccggcaacgtggtagcaataaagatccatctcggccaggttttcaaggcctgccaaagattctttttcctgatatgcggccattccttgccccatgatgcgaatacagcgttccagcgcctggcgctgcacagaattgaagctgtgtgtcattcgtatgacggcaggggtattcttgatgagatcatgctctgctggaatagtgtgttctgaaagtagagggtacagggcttgtgcaaaaatttcagcttcgacgctgccgctgacgacctcggtgaacattccggccagttcacgtgtttgctccaatgtgagggcgctatcatcctcaactgtatcgacaatgcgacataacagataggcatttcctatcactgcacgcaatgctggcggcaattgaggaatagtgagcgcgaaagtgcgtgatacgccttgtagaatgaattcctggtagcgcgcatcgtcgagtgtggtgatatccgacataattggagttatatgcgggtttcaggttggtatcttttccagagcatatagatcttctattgtttcacgtgcgcgaatgagatgtaccgagctgccgtccaccatgacttcaactgcacgtgggcgggtattgtaatttgagctcatactcataccatacgcgcctgcagacataacggccaataaatcattactttccagagtcaggttacggtcatggccgagaaaatcgcctgtctcgcaaacaggcccgacgatctggtaaatttttgtctctcctgtacgcttggcgattggtaatattgaatgataggcctgatacagagctggcctcaacatgtcgttcattgcagcatcaacaattgcgaaattgcggtgtggtgcgtgtttgagataatgcactcgggtcagcagtagtccggcgtttcctaccattgaacgtccgggctcgataagcaattgctgcggataattttctgtagccgcgcataatgccttgacatactcctctatcgtgggagggatttccagatcataacgaactcctagtcctccaccaagatccaggtgctcaatggaaatacctgttgtttgtaatcgtgccagcaaatccagcattttatgggctgcttcaatgaatggcgcaatttcagtcaattgcgagccaatatgacaatctagccctgagacacggatataggggagctgttgcgctattgcgtatatccgttcagcctctgcagccgggataccaaacttgttttccttcattcctgtggatatgtaagggtgagtgttggcatccacatcggggttgacgcgcagactgactggcgcgatctttcccatttgtccggcaatttcattcaatgcgatcagttccatttctgattcaacattgaaacagagaatattggccgccagtgctatacgaatttcctcaaatgttttgcctactccggagaaaactgttttttgcagatcgcctcctgctttcaatactcgctgcaattccccgccagagacgatatcaaagccgctgcccaagcgggcaagcaggttcaatacagcaagatttgaattggcttttactgcgtagcagatcagatggtttctctgaccgaaggcgcgatcaaagctttggtaagccgtgcggattgccgcacttgagtaaacatagcaaggggtaccaaattcagctgcaattgctgtcagtggaacttcttctgcaaaaagctggtggtctcgataattaaatgagctgaaatggctcatgacttttcctgcttattgtttttaacgggttgatcctgtgggagataaagtgaacttttatagccacaggcagacaggagcaactgtaataaaagaatcagaccaagtatgcgcatcattgattagccacagatactgtattcattattgacgaatgtcggataaccactgtaccagctcattcaacaagttgtcacttacctgaataaaggctgtaactgcacccgctgcatccgctgtttgagtttcttgccttcccagaaagcgctggtgtgcaattggcaagcgtgaggttggttcatatagagaagcacgtagttgaacaacaacctggctattacccggtgtattaaaaatctgggtgaactcacccagatcaatttttaacagatagtttacaggcgtatcgtctttatggcgtctgtcgatgtttccagtcgcaaaatactgcctgaagcgctcggtcaatagttctgctggtggtgcattccagcgactgtcggcataggtatagatgcgggcaggatcatggtaggcaagccggtaatggattgattgagtatccagccagacgggtgcggcgatatctataatctgaatagtcgcttgagaggacagagaagatccgagtgtgatagcagatggcgggccaagatcgtaaattgagacggaggatggtgctttgggtgtcaaggtacaccctgtcaacaaaatagccagaagggcaatagaaactttcgtcatcattttatcggctgtggtggcgtgaatcctggttcgccagggccaggcaaggcgggtggtttgccaaataccaggctttgtggatgtgcttccagcaaatttagtaattgattcagtttgcgcgtactttgcgtgacagcctggccagtttcattcaggctatccagggtgtgagccatctccagcgatccttgggtcaggttgtctattaatccttgctgctgattcagtttttgtaggacctggctggtattttccatgacctgacgagtttgcctgaatgtcgacgtgaattcgccagtcaactgcggcaaagcttgcaaaccattctggagctcttctgtcaatttgtcataatgctgaactgtctgttccaagtggcttaaaatcttgccaatatgcgcctgattttttttattaagcagattgtttatctgcttaattaccgtgtttgaattcttgaggatttcttccagagagtcggaaagggttttaataagtgaagatctcaggaaaatatgtgcctcgttttccaggtaaccggctcctgcttcagagacatcatcattcagttcgacataagtcaatccggtgataccctggctggccagctgtgcgtagatatttttgggaagcgtaacatgactgctgacagcgatacggacgatgatgttgcgtatattttccttatcaaagtaaatttcttcgactttcccaatatttactccacggtaacgaacggatgcttccggattcaatccggatacagagccaccagcagaaatcagaaaataatgattgtgattaatattgtcacgactaagccatttgaccgccatgaccgccgctactcccaggaggagtacgaacagaccggcagcaaatgcgtgtgctcggttctccatcaggttctcctgtgattaatctcaaattacttgggcaactcgcggttctcggcaagaagctgttcggtcagatggggggtgataatctgcagaagctgggagaagattttgggattgcctgcaacgatctgcccactttgcatgtaatgtccgttcccttccagatcaccaaccatacctcctgcttcgagaataagcagacatccggctgcaatgtcccacggcgccaacccggtttcccagaagccatcgtaacgtccggcggcaacgtaagcgagatccagtgccgcagagcccgggcggcgaatgccggctgttttaggaatcatgtctctgaacatggccagataggcatccatatgtgtgaaatctctaaacgggaatccagtgccgatcaggcattcgcctaactgtgctcgtttgccaacacgaatacggtgatcattgagaaaggcaccgctgccgcgcgtggcagtaaataattcatcgcttaccggatcgtagatgacagcttgtgacaaaattccacggtgtaacaacgcgatcgagacgcagtattttggaaatccgtgcaggaaattggtggtgccgtccaatggatctattatccactgatattccgatttgtttgcattcccgctggcaccgctttcttctgctagaatcgaatgatcagggtatgcatccagcaatattttgataatggcatcttcagcagctttgtccacttcgctgacaaaatcgctgtgagctttgcgcgaaacagtcagccgatccaaatccattgaggcacgattgataatgttgccggcccggcgagctgccttaattgcgatggtaagcgtgggatgcatggtaaaaaatttactttagaaacaaatgactggaaaaccgctattctaatatgaatcctgcctcgccgctcgataatgtccggattgtgttgagccataccagccatccgggcaatatcggtgcaacggcccgtgccatgaaaaccatggggctgaacaagctttacctgatcaacccgaaatcctttccggatagtgaggcggatgctcgcgcctccaatgcgcgcgacatacttgaaacggcgcacgtctgcagtaacctggaggaggcgctgggggatacttttctggctgctgccctgactgctcgccggcgtgatttgccgcacccgacctgtaatgccaggcaggcagccattgagctgatccggcatgcacagcatcatccggtagcgttgctgtttggccgggaaagtgccggattgaccgcagcggaaatcagtcattgccaggtaacggtgcagattccggctaaccctgattgttcttcgcttaacctggcagctgcggtacaagttatggcttatgagctgcgcatggtacttgaagaagatgctgctgcgcattattttgcatcccgattgccggatgccgccagcctgcatgaaattgaaggattacactatcacctggaacgggtcatgatccacagtggatttatggatcctgaccaacccaaacacctcatgcgccggatacgtcgtttgtttgcacgtacccggctggaaaaggaagaggtgaatcttttgcgtggtctgctgactgcggtcgatccgcataattcatccaaaagctgattttctccgggcgctcagcctattctggctgatgttcctaaagccacgctgtttcctggctctgtttttggtgattcggttgattaattcggagcaacggttgttttaaatgattgacgttctgccagtttattagccaaccgaacgagattggggtaagtatcacgccatttgacctcggcgaaacgagcatccagataaccgaatgcacagccgagtgcgatgtcagccaaggtcatggatgctccttcgcaccatgtttgatcacccagatccgatgaagctgcctgcagcccctggtcaattttcttttgctgacgttctatccattcctggctttgctgtgattcagggcgtttccgttcaagataaattgccacgcaggcgtcgatgatcccgtcagcaagcacttcccagcgcttgacgcgcagtcgttcaggtccggaagccggaatcagccgggtggaactggcgctgtcctggtcatccagatattcaacaatcacacgtgaatcaaacaggataaagccgtcatccataatcagagccggtaccttacccagcggattaacctgggcaaccttggtgtcagggctgaacggaggatcattggtaaattcatagtcgatgcttttttcaacaagcatgatgcgtaccttgcgtacatacgggctggtcagtgatccaataagctgcatttcattgtcctttttgtttttggaatattgattatgtcattttatcccagccggagagatgatggcgagctgtgataaaatgcgcgctcccgcaccgtgaatgaccgaattcaaacaatcatttaagtattaattgatggatatcccgacacttctctcactttctccattagatggccgataccagcagaaggtggcagccttgcgtcccttcttcagcgaatatgcattaatccgccaccggattcatgtggaaattgagtggtttaaagcagtagcgaatatcccggtcttgaccggtgtttcatcgctgtcagctagcgtaactgcacagttgaatcagctttcggagaatttttccattgccgatgcagaagctgtcaaagctatcgaagcgcgcaccaatcatgatgtaaaggcggtagagtactggctgaaggaaaaactggctggagatcaggaaattgtggcgctctccgagtttattcattttgcctgcacttcagaagatatcaacaacctgtcacacggtctgatgctcaaacatagtcgggatcaggtcatgctccccgcgcttgatgacatcattaaacaactcacaacgcttgccagggaattggctgatgttcccatgcttgcccgtacgcatggacaggcagccacgccgactaccatgggtaaggaaatggccaattttgtctaccggttgcgtcaggggcgtgagtgtcttgccgctatcaccatttccggtaaaatcaatggagcggtgggtaattacaatgcccacatgattgcccttccagaattcgactgggaaacgtttgctcgttcctttgttgagaagctcggcatcacctttaatccctatacgatccaaatcgaaccgcatgacaccatggccgagctgttcgatgcctacgctcgcatcaatacgatcctgcttgatctgaaccgtgacatctggggctacgtttcactgggttactttcggcagaaaaccaaagcagatgaggttggctcttccaccatgccacataaggtcaacccaattgattttgaaaattcggaaggcaatctgggtatcgccaatgccttgctcaggcatttgagtgaaaaattaccgatctcacgctggcagcgtgatcttaccgactcgaccgtgctgcgcaatatgggggtggcgcttggtcatacgttactggcctatgactcatgtcttaaggggcttggaaagctgcaagcagatccaatgcgtttatcggaggatttgcagcatgcctgggaagttctggccgaaccgattcaaaccgtgatgcgtcgttatggaatagtcaacccgtatgaacagctcaaggctttaacgcgcgggaaaacgggaatcgaccgcagcacacttcaacagtttatcgaacaacttgatattcccgtggctgaaagagaacgcctactgcagcttactcctgcaagttacattggtctggcagcgcacctggcaaaaaatattagcaactgatcccaggaagctgatcttccccgccgccaatctttacccattgaaaccgagtacagctccaatgatttttttgtgatttggggttgaaaagggaaatattgaccccaatatcaccggcaccgttataggaggaatctatgcaagagccacataaccaggaacctatcgaagaacagaaactgtcggaaatggaggatactctggaaaaacagcattccggtgcatcaacggaaaatacagaaagagccgaggagggtgttgttattccagatcttgagcaacagctgaaagaagcagagataagagcagccgagcatcatgatgcctggttgcgtgccaaggcagaaaccgagaatatccgcaaacgcgcgcaaacagatattgccaatgcacataagtatgctattgataattttgccacccagttgctggccgtgatggatagtctggatgctgcgctggctgtggaaaattccaccatcgagagtttgaaagatggtgtggagcttacgcgcaagcagcttgcagcagtctttgaaaaattcaacattcataccatcaatccacaaggagaaaagttcgacccacaccagcatgaagccatgtgcacagtggaatcggatatacctcccaacacagttacacaagtcatgcaaaaggggtatgtattacatgagcgggtaatccggcctgccatggttgctgtttccaaggcaaagagcacttgagattttcaggaagacccttatttcatgttggtaggataaatttcaacttttaaaggacatactatggcaaaaataattggcattgatcttggaacgaccaactcatgcgttgccgtcatggaaaacaacaaacctaaggtcatcgagaatgctgaaggtacaagaacgactccgtcgattgtggcttatgcagaagacaatgaagttctggtgggcgcatcggccaaacgtcaggcggttactaatccggaaaatactctgtttgccatcaagcgactgattggccgcaagttcgatgaagaagtagtgcaaaaggatatcagtgttacaccatacaagattgtgcgcgctgataacaacgatgcgtggatagaagtgcgcggcaggaaaattgctccaccagaggtttctgcacaagtgttgatgaagatgaaaaaaacagccgaggattatctgggtgaatcggttacggaggcggttatcactgttccggcatatttcaatgattctcagcggcaggccaccaaggatgcagggcgtattgcgggactggaagtcaagcgaatcattaatgagccaactgcagcagcgcttgcattcgggatggacaagaaggaaggtgatcgcaaaattgcggtatatgatctgggagggggtacgtttgatatttcaatcattgaaatcgcagaaatagaaggtgaacatcagtttgaagtactggcgaccaatggcgatacttttttgggaggagaggactttgactccagtgtgatcagttatctggtagaagagttcaggaaagagagtggaattgatctgaaaaaagacatgctggcactgcagcggctcaaggatgcggcagaaaaagctaagatcgagttgtcttccagtcagcagacggaagtaaatctgccatacattacagcagatgcttcgggtcccaaacatctggcagtcaagattacacgagccaaactggaaagtctggttgaagagctgatcgaacgcaccgcaggtccttgccggactgcgcttaaagatgcggggttgtctgtgtctgacattgatgacgtgattttggttggcggtcagactcgcatgccgaaagttcaggataaggttaaggaaatttttggaaaagagccgcgtaaggacgtcaatcctgacgaggcggttgcaattggcgccgcgattcaaggcggagtattgcagggagacgtcaaggatgtgctgctgttggatgttacgccgctatcattaggaatcgagacactgggtggtgtcatgaccaagctgatccagaaaaacaccactattccgaccaaggcccagcaaatattttcaacagcggaggatagccagacagcggttaccatccatgtgcttcagggtgaacgggaaatggcatctggcaataaaagtctgggtcagtttaacctgactgatattccgccggcacagcgcggaatgccgcagattgaggtgacttttgatattgatgccaatggaatcttgcatgtctcggccaaagataaggcaactggcaaagagaacaagatcaagatccaggcaagctccgggttatccgaggatgaaatccagaaaatggtaaaagacgccgagacacatgcggaagaggacaagaaggcgttggagctggttaacagccgtaatcagtgtgacgccatgattcattcagttaaaaaatcattgactgaatatggcgacaagctggaggcggatgaaaaatccaaaattgaggcagccttgaaagatgccgaggaagcgctcaagtctggggacaaagaggcaattgatgcgaaaacacaggtattgaccgaagcctcacacaagctggccgaaaaaatgtatgcccaggaacaggcacaagccggtcagcaggcaggtccgggtgccggatcagcctctgctggtcaatccggagaaaagccggttgaaggcgaggttgttgatgctgagttcgaggaagtcaaggataaaaaatgattttccgcagggctgatgcaaagttcacatagcagtaactcgtactgaaaatatacgcagagaaaagaggaaatgactattttctctgacctctgcgttttatatcccttattacaatggaccttttatcaaattgctggagtaatcggcacaacgatgtctggatgatttctaccagcaggaattttttatgagtcaacgtgattattatgaagtactcggtgtcggccgggatgcggatgagagcgagctgaagaaggtatatcggaagctggcaatgaaataccatcctgaccggaatgcgggtgatgccaaggcggaagaacgattcaaggaaatcaaggaagcctatgaggtgctgtctgattccaacaaacgtgctgcttacgatcagtttggtcatgccggcctgaatggcggagtgggcggagcgggagcgcagggattcagtgacgctttcagtgatattttcagtgatctgtttggcatgcgcggaggtggacgctccagtgtccatcgtggcgctgatctgcgctataacctggagattacactggaacaggcggcgcgtggtacagaaaccaaaatacgtattcccaggcaggaagcctgtgatacctgccatggcagcggtgcaaaaccggggacatctcccaaaacctgcccaacttgtaacggacatggccaggttcgtatgcaacagggttttttttcgattcagcaaacctgctcacattgtcatggcagcggcaagattgtttccgatccttgcacggattgccagggagcagggagagtcaagcgtcataaaaccctgtctgtcagaattccggctggtgtagatgagggcgacagtatacgcttgactggagaaggagaggctggtgcaagcggcgggttggcaggtgatctgtatgtggtcattcatctggccagccaccctgtttttcagagagagggaaaccacttgcattgcgagataccaatcagttttaccgtggcggcattggggggggaaatcgaagtgcccacgcttgatggtcatgctcgcatcaaggtaccaactggaacccagaccggtaagattttccgtttgcgcagcaagggaattaccggtgtacgtaatcagtcaacaggcgatctgctgtgccatgttgcagtggaaacaccagttaatctgactccgcgccagaaggaattgctcgaagaattcgagtctatcagccagaaagatggctcattgcatcatccacgtgcaaaatcctggatggagaaagcacgcgagttcttcactgagtgaagccaacttacgataatcagcggcggatatttccgcaaaccttaatccgccgctgattaccaagtgacctgaagggcgcctctgaaaatccagtagctattctgtctttttcgcttgatccatagctgtcttttctgtgctttctggttgcaaatgtacatccatctgcgggaatgcaatttcgattccttcttctgagaaatgttggttgattaacacatgcagctcatgcatcaatttcattctgtctgacaattgtccggcaaatacccacaattcaaagttcagagaactagcaccaaatcccaagagtaatgcggccggttctggatcgcgtaataccaacggatgatcatgtgcaattttcagtaacagtgcacgcgccttatcacaatccgagcggtaggcaatccctaccggaattattatgcgcgtagtcggatcactcaacgtccagttagtgaactgttgcgtgatgaatatcttgttgggcacgatgacttctttgcgatcaccgtcgatcaaggttgttgcacgaatgtgaatcttgctgacagtaccgctgatattgtttaatgtaatcacatctccgattctgatggggcgttcaaacaacagaatcagaccggaaacaaaattggcaaatacttcctgcaggccgaagcccaatccgacgctcagtgcagcgaccagccactgaatgtttgaccactgcatccccagtttctgaagagttaccatcaacccaatgatcacgattgtgtatcggagcaaggtggtcatggcatatcccgtaccacggtcgagcgataaatgtcgcaacaccaacagttcaagtgtgccgggcaggttatgcgcagcaatcatgacaaggctcagaataacgattgcagccagtaatgtttttaatgtaatgggttgtagaataacttcactatcgatttccaccgatgtacgccagatcgtgatcttctccaaaaaactgagtgcgggcagtacatcgatccagataaagccaagtccggtaatcagcaatgcccaaatgctgattttcagcacagtggcggactgcttgctgatcgttttgacatcaatgtagttgtcatcgagtatatccgcttcacttttgcctgatgctgaacgttgggcctgtatctcctcccgtttctcgattgcacgttcgaatgcgattctgcgctggatgattaacaggctgcgaaaacttacaaaaaaggtcaacgtgcagaatatgatccagctgatcgactggaatatgagcaggtattgataaatggcagcaaaatagtaaccaatggctgccatgatgatcatgccgatttgtaacacgaacaggagcgtcatccagaatctggggttgagcatcagatagaatgattcaccctgataaagtgccttgccggaacgtgtgacggctatccatcccgaagcgaacactgcgagtaccaggcacagcaggatgaaagtcagccggccaaagccattgcggacgagatcatcgtctagcgcgtcggtgaaggcgatgatgatgcacaataacgctatgacaggtgcaaagcgtctggtatcccggtgcattttatcgaccaatttttcggaacatctgaattgaccgatcagtaagccttccgggtgaaacagcaacaatatgaacgaccagataaaagcggcaattgctgctacatgtaggcttaccgagaatgcatggccgatttctgtattggtaccatgatgcagaatcaccgatgacaactgaaaaggcaggtaaaccaaccccgatatcagcagtgtagccaatagcatccctacgggatataacagcctgtcttgattgacctttccccgcaaactgtttccgatacgtgcccaggaaaggtaaacaggccagtatgtgtaccggaagatggtaattatcagcgcaaatatcgcataaacgatcaggatatttttccatgttgcattgattactttctcggttgctgcctgtgttttacttgaggttaaccaagtgatggcatcctgaatatcttgtacgacatctagagaaatgggttctgcgctgcgtgtcaccagcaggttctctttcagtaatagcttgtgctgaccaattttttcgataagctgttgttgaatggtaagaaggagttgcagttccttgatataaccgtgcagtacctgggaaaactggtcgattatctgctcgcgggattgtttcagttcatgaaacgcatcagtgagctgctggtaagcaggggtgttgtctgccggtatttcttccccgttcataatctgcttgaaatagccatgctcgttcagcatttgcaatttttcctgctcgagctggaatagctccaacctggcactattcaagtctttttcggtttgtgtgatagccggctcgaccatgatttccttgaattgctttctgacttccgttcccagagcagtatcctccaccttgagttcgagccgttgttgtagtgccgcataacttcgtgtgatgagagtaagacgcttttcactaccagttttctggttgatcaaccgggttgaaagttcggcgtagctgctgagctttttggccagtgactgattatccaaggcatatttctctagtcccggatactgccacgttttttcgaccagcaattgctgggatttttcgaccacttgttcagtttcagcacgctttttccgattgatttcttcagcgagtaactcggttttctgctctaacgcctgaattttgggctgcagggagagtttttcctgaagcgtggtgatttctatggcattgggcaataccagcgcttccaattccagcatgcgcgttttgtcagtcagcgcctgtaattgtgcttcacgatagttttccagcgcagtaagtatctttttgtctgttgttttgtgggtttcagaagaatcttctgtcagttctgcccgtaaagtgttgatggatgccagctcttcccgtatggtgactgcacgttgtcgcagtttggagatctcagccatcagcttctgttgctggttttgcagatcggataagtcagcctgtgctgcaatatggcgttgctctagttcttccggcggcaatttggccagcttgtccggcgtggtgatagcgattcctggcggtacctggctcttttttagattctccagctgttttggatactgttccagttgccgggaataattggcagtctttttcagatattcctgatgatcaagcaatacctgttgatggttattataaatttcgtgcaaccgcttcttttgtggcgtttcctcaccattgcccgatacgctgagttttgcttgaatcgcctggagttcttcatccagctcgctggcatggacgtatccaatacctgtcatgatcagtaataagaaaatcgtaatgtgaagcaatctgttcatgtattaatcgtaatgaaggaaatctgtcgaaccgatttttatcggccgctgaggtctgtgctggttctttatcagccaggatgaatgacttatgctaccagtttttttctggcgtggaattccggatatctcataacgacagttatcagtcccggaaaatatcaagctggcccagagagtcgcaggataattttccagacttctgaatacgcgcttcctgcgaaatgatgcctgatagatagctttcagcaggaattaattgataagcctttcgggtaggtttccgccgcttccccgcgtattgatatgaagctgcatgccgatcagtacaacacttgtcaccacgacaggagcaatgaagaggcgtttaatgttgatagataagttttcccagattgtgatcattttttcctccttatcctcggatttacatggttgctaagaaatcaaaaaaacatgaatttatttggagctgcgtaaaatatcggcagcggccagcttgccgacatgtgcaatctcaccattaccggtaaccatggccgctacaattgtcccgtcgatcaacaaattcagcttttccgtgaccatttcaggatcacgtgcaccactttctgccaccattgctacgagtctgtcagtaattttttctctgtgatcgttggcgatttcctgtatccagttgttacatttttcatgctcggcgacggcgttgatgaatacacagccgtaaaaaatttcactatcgaaccagtcctgcattaaatcgaacaaggccagaacgcgctcatctggtggacaggtcatttgcgggagatcgcagtcgaaccagtggaaccatatactggcctccgcctcaaatacggccttgagcagattctccttcgatccatagtgggtatagaggctacgccgggatacaccggattcttcgataatcctggcaatccccgttgcgtgaatacccacctggcagaacagacgtcgtgctgtctgcaggattttttcctcgacagagatttttttgggcattgtttttagattaaccagtgctttatcaggtagcagggaaaggtggaaaaattcctgttaattttcctactttgtaccgagttgttgactgagttttcgggtaattttgtcggcctccagccggatttcatttaactggccgctgagtggattgacctgtccgataaaatacaggcgtggtgcatccggaaactcctgatcacctgcaattttggctcggcctttttcatcagtaatgccaggtatttgaatgagctcagggaagccggtgcggaatccggtccctgcaacgatggtatccggctgcagagtcgtagtacccggattggtattttgtgctgttggaatggcgcttagaacttctactgttccacccgatattttctgaatcggcccgacaattttgatacgaccggcacggatatcatccacgaaaggccgataaagaattggtacgacattattaatggcgtactgctttaacgttgacatggtgggagagggaagcccgtaagcggacagatcaccaatcatggtgtgccgcaagaaactcagcacgctatccgccagtgaattcggcagttgccttaacactattccaagcccaacaaaaggaatacccaaaatactcttgggcagaagttgtggcggtgttctgacggacataatgactgaactggcgtattcggccagccgactggcaatttcggcggatgaattgccgctaccaaccaccagcacatgcttgtctgcatattcctgtgcatttttgaattgcgaggaatgaatgatttttccggcaaaagtattcttgccttcccattcaggaataaccggaatgcgattggtacctgttgcaataactacggcgcgggattcaaattgctggttatcgatactggtaatctgccagatatcgcgttcatggccgtagcggattttttcaatctcgatgctggtctgtaccgtaaaaccaccacgttcaggcatgttctcaagcagtgctaccacttcatcacgtgaaggccagccaccggctgacaggggaaatttgttacccggcaatgcagaacagaaacggcccgtattcaggcgtagcccgtcgtaatgattccgccagacatcgccgacagcaggcgtgcgttccagcaccagcggggtgaagcctgctttggtcagttcatgtgcggctgacagaccggccggaccggcgcccactatggctacattatggatatcactggtattcatctgttctctcctttcggtttcaatcagaactgcctcgtagatacatgattcgtggcatgctttacttcggctggtgatgaatttcgatattgaccggtaccgggcgcatgatggtatcgggtatcggcgcagtttgtttcagcttctctagtagtgcgagtactttttcttgtggtgtatcggtttgaatttccacgactacgttgatgtcctcaaatcccgggttgcctgcctcaactgcataagccacgccgaaattgacgcgccccgaaacatgtaatcgcaatgattccacgttgatacgggcagcagataatccgccgatataagaggcagccaggcagtgaccgacagcagtcagcaacatatcctgcggagagatgcccgtgcctttgccaccgtaacgcggaggttcatcgccgataatcgtctggccatcggtaacatttgcagtggtatggtagccgctatcccagacaaccgttgcctggtatttgggtttagccatatcaccgctgcgatcttcactgatttgtttttgtatgacaaaagattgttcaatattgattccattgacaatatttttagtatccggggcactcattgttaacctcctgatatgagctattgctataagtagaccgttcgttctctttcgggccgataatataccgggaagaatgaaatggcaaggttggggtgatctacttactctgtcattgtgaaaatccatgggattgaagcaatccagtaatgagcaagttgcgaaccctaacaggggaagcttatgaagaaagagagatcaagcaatgtccactaccaaagtcagacaatctttgaacggcatagatgttacgcggctggtagcattattggcaccattaaaaaatccagaaccgacctcctgccgctttcgtgcaaccagtatagtacccagctcaacggagggcgctcacggacagcgatttaaggtttctggggagccaagcgagaagatacttcccgtatccagcctttctatttggatggtgatgaaccatcggcattattgggtaccaatcacgggcctaatgcggtagaagcagtgttacacagtttggcctcgggtctggctgcgcgcgttgcttataatgctgcagcgcgtggtatattgattcaaaactttaagtttgatctggagggagcttgatatacagacatttctcggtctttctgatgaaatcaggcctggttatagctaaattcaggtgatttatcggataagaacctgttctaagttgttttacggatgttccaactctgctgagagagacgttaacgtgtactgaagacacgcaaaaataccctttagttcaggctcttgctcaccacctcgtaaacatccttgcttaattcacgttgcgacagtgattccagcgcttttcgcattaatatggcgtgctcgtcaataaactgattccaatgtgttaatggtgtcaacaagcgagcagctatttgcgggttgcgatgatcaatgtcggcgatctggtcagctaggaattggtaggctttaccggagcgattatgaaaactggcaaagttttgattggcaaaagcagcgatcacggcacgcaatttattcgggttgcgggcatcaaacgccgcatggtttaagagctcgtgtactgcctgcaatacattaccccaaggccgtgtgacctgtacctggaaccacatattgacgaccagtgtttcgtgctgccattgctggtaaaaagcctgcagcgcttcctgtgcggttgatccggcgtgttcagcatgcaccagtgctcgcaaggcagcaaattgatcggtcatgttgtttgcctgggcaaattgctgctgcgctagattgcggtagcgcgcatcattaatatgcagcaaataagccagtgcacggttacgtaaactgcgcgctgccatcgctggtgcggataatccttgtaccttgtcctgcaaagtctgataacaacccagcagttctggctgtaactgtatggcaagctgttgctgtaattgctttctggcctggctgatcgctgtcgggttggctttatcgtacaggctggccagatactgttcgctgggtaagtccagcatgcaggccaataaagccacatccatggatgcatggtcagccagcaattgtttgagtgtatccaccagcataatttgttctgcatggttatccttgccgtcgatagcgttgcacaacactatgcgcatcaggctttgcatggcatcccagcgacaaaagccatcgctatccagcagaatcaattgctgcaattgtgctaactgataagcatagaaaatcttcactggtgctgaaaagccacgtaataaagatggtaccggattctcagccacctgctcaaagatgatggtttgctgatcctgacaaatatccagtacggtttctgtgcctttgttctgtccatcaatcaccaaagcaagcacacccttgctaccataaagcgcgattttgaggggaatgtgcagcgcttgcttttctgtttgtccgggcgttgcgggcgtatgctggcggacggtcaggctgtattgctggcgagcagcatcgtagctgtcgctgatatacagttgcggggtgccggcttgtgaataccacagacaaaactggcgcaaatccttgccggatactgcttccatacactggacaaaatcatcgcaggtgactgcctggccatcgaagcggctgaaatacaaatcagtagcacgacgatactgttctggccccagaatattggctagcatgcgcactacttcagcacctttctcataaattgttacggtatagaaattggatatttctatataggaatccggccgtaccgggtgtgccatcgggccggcatcttcaacaaactgcacgctgcgtatcacattggcatcttcgatgcgcttgactgcacggctgttcatgtccgctgaaaattcagaatcacgataaacggttaagccttctttcaggcttaactgaaaccagtcgcggcaagtgatccggttgccggaccagttatgaaaatattcgtgaccaattactctttccacacgctggaatgccgcatcggtggtgctggccgggtgagccaatacgcaggaagtgttgaatatattcagccccttattttccattgcccccatattaaaatcatctacggcgacaatcataaaacgatccagatcatattcccggccataggtttgctcatcccagcgcatggctttttttaatgaccgcatggcaaagtggcatttatcgctgtcttttgcttcagtatagatttgcagcaaaacctgacggcctgactgggtagaaaagtgatcttccaggcagactaaattacctgcaaccagcgcaaacagatagctgggtttcttgaaaggatcgtgccagtgtacgatgcgcttgccagcgtgcactgtatcagacaggcagttgccgttggaaagcatagtcgaaaaagtaccttcctcagcaatgatgactgtttcaaattcgctcataacatccgggcgatccagatagtaggtaatcttgcggaaaccctcggcttcgcattgtgtgcaatacatgccgctagagcgatacagcccttccaatgcagtgtttttctcgggatagatacgtgttttgcactgtaggacaaagcgttcaggcacgttgtgaacggtcatgttttgcggggtgatctggtaatccccgacaccaagtgggcgttcatcaattgccagagaaagtaattccagttgctcgccgtgtagaaccaggtgatcggcgtgagtgctgtgcgggttgcggacaatggtcagctgactattgacatcggtatagccttcatgcaacttgaaggtcagatgggttttttcaattagaaattcaggtgcgcggtaatcagcaaggtaggtaacagtggtggtagacatgatcagccatgagaaaaatagttctaaacaggtattaacccacttcagccttctgatttcaagttacgcagatcaatccggcacaaacttcaggacattgccgttgatgcagtagcgtttatgactggggggagggccgtcattgaatacatggccgagatgaatgccagagctggcactgcgcacttcaatccgctgcatatagccggagttgtctttgtgataggtgacagatccttcagccggttcaaagaaactgggccagccggttccgctgttaaatttggtctggctacgaaacagcgtgacaccagtgatcgggtcaacaaacctgcccggacgtttctcgtccagattggagccggtgaaagcgcgctcggtcccctgctcgaaagcaattttctgttgttccggtgtcaataattgaaacccaagccactgccagaatttttccttttctccgttgtaaccagtataacgcgccacctccttgcctttgctgaacaacaccattgtgggagacgcaaataagggtttgtccagtacccaatcggtaggcgggttggcattcattgtcacgatcatgggaacgtctgcctgccagtggtcgaggatatcctgtttgaattgtacgcaaaattcgcagttttctgattcaaacaccaccagttgccgatcaaagtttaaatccttgctgtcaagcagctgtacggaaggggcggctgaagttgtggttgtatcttttgtatgatctgcagcagggtatttcacacctatgccgcccaagccacagtagccatccggatttttcttcaaataattttgatggtattcttccgcggtgatgtagtttttgagaggcaggatttcagtcgtaatctggccatatccagctgctgtcagcgcttgctggtaggtatcacgtgtggccagcgcgagggttttttgatcctcatcgtgatagtagatagcgctacgataattactgccgatgtcattcccttggcgatcaccctgagtgggattatgactttcccagaattttgccagcacgctttccaatgatacttgttcaggagcaaacgtcactttaactacttcggcatgattgcgtccggcagctctgccgatacgcaacgcgcgttcaaaattcagaatatcctcataacctacaccggcgtggtcaccacctgcatagccgctttccacatcaaccaccccgggcagctctcccatgcgcttctcggcaccccagaaacaacccatgcccagaacaatataatttgattttgaatcagtagtttgatttgagtttacagagctgggtgtcacgattttctccattgcaaagacagttataaccattgttattatcaagataattaatgcagcaataattgttttcatttttagtgtgctttaacaaatatatttttcagacatcctggagtatcgcaagttctcgttttatcaggttgtcatgataagttcatacttgccgaagcgttattcctgttgccgtgaagcgacagaaatatttgatatgcctgtgattccagagccatttcttatattatcgagccggtcaattttgatagttctatggatgtggcataacaagtgacgatttgccagggtaatttgctcaattgagtaatcaacaataatgcgtgttctttatatctcatgcagtcaaagtgatgttgatagcgtacaacgtgcattagtgcaggaggcagccgggattaagttggctacggtgacgaatgtgcaggatgcgctggcgctcttgcccgctggtccggaacgaactgctgatttcgatgtactgctggtcgattattgtttgccggggatggatggtcttgaatttatcaggttgttgcgcaaagagcgcaaactggacattcctgttgtgctgatgaccggccaggacaccgatgcggcaactgcactggcacagtgtccggaggtggaaggttatctgatcaagcataaaaactatctctccgggattcttgcaacattagagaaggcgcagtggctggccgagttgacgcgtgagcgagtcaatacaaaacgggcaaatttgcgcctctcccatttgctggcagctagcccggtgattctgtacaacctgcattttacagaggatttgccgcgacttgtctgggttagtgagaacgttgaacaggtacttggctataccccggaagaagcatgtattcctgactggtggatttcacatttatacccggatgaccgggatcaggcagtggcgcgccagtcaattctgatatccgaggggcaactggtgcatgattaccgtttttatcatcgagacgggcggatcgtctggttgctggatcaattgcagctaattcgggatgccggtgaccgaccatatgaagttgtcggtacctgtctggatatcagtgaacgaaaacgaactgaactgatccggcaagcgcagcagtcagcattggatctgattgttaccaaccagtcgcttccagtaattttgagtgatatcgcgaagcatctcgaagcgatcaatcccgacatgctggtttccattttgttgctggataagcaaacaaagcgcctgaagctgggagccgcacccagtttgccggatgattacaatgcggcagtcaacggccaggagattggtgaaggggtaggctcctgtggtacggctgccttccggggtgaaacggtcatcgtgtctgatattgatcatcatccgcactggcagcattttctggatttgacacgcaaggctgatcttcatgcttgctggtccctgccgttcaaggatgagcacaatgatgtgctgggtatttttgccatctatcatcatatcgcgtgtgaaccatcgccaaaggatctggaactgatccgggaatttgcgtcctttacggcgctggccgtgcaaaaggttcgggcaacagaagctttgcgactttctgccacggtatttgcatccatccgtgaaggggtcgtgattacagatctggagccacgtatcgttgcagtcaatcgggcatacatgaggataactggctacagtgaggaacaggtgctgggcaagaatcccaagattatcaaatcaggtctccacgacaagacgttttaccaggcaatgtgggctaccttgaaggcaacagggcactggagtggagaggtctggaatcgtcgcaaaaatggtgagatctatccacaatggctgacgatcaatgcggtatgtatcgattcatcctgttgtgatgaaagcaattcctgtaattatgttggtgtatttaccgatatttctcaaataaaacaatctgaagcacaactggcacaactggcgcattacgatccgttgactggtttgcccaaccggctgttggcacagtcacagctgcatcaagccatagagcgggcgcaacgacatggccggctggttggtgtgctctatatcgatcttgatcgtttcaaaaatgttaacgatagtctgggccatccagtcggagatgagctgctgatcaaactggccgagcgcatgaagaagcgggtacgtgaagaagatacactggcacgcctgggcggggatgaatttttgctggtgctggaagatgtccgtgatttgggtgatccagcatttgttgcgcaaagcctgatcaatctgcttacttctccgtttgtgctgcctagcgggcatgagatctttattaatgccagtatcggcatcagtctgttcccagaggatgcgagcaatgcgactgagttgattcagcattctgatatggctatgtatcaggcaaaaaaagagggccgcaatacctatcgttatcatacggaagctttgagcgttgcggcgaatgagcggctgattatggaaaatcgtttgcgttatgccctctcggccgaggaacttatcttgcattatcagccgttagtagatgcacgtaccggttatgtggttggggtagaagcattggtgcgctggcagccgccaggaaaagccatggtgccaccaggaaaatttatacccattgcagaagaaacgggcctgatcgtgccgctgggagaatgggtgttacgcaccgcctgcaagcaggctcgtgcctggattgatgctggtttgtccccacttgttatggcggttaacttgtcggtacggcaattccagtcagaaaatctggtcggcatggtgcagcggatactggaagaaacgcagcttccggctgattacctggaacttgaattgaccgagagcatgttcatggagcatgtggaacagtcgattgaaacgttgaataagttgaagacgcttggagttcacctggcgattgatgattttggtacgggttattcatcattgatttatctgaagcgctttcccatcgacaagctgaaaattgatcaacgttttgtgcgcgatctggcggatgatcacaatgatcgtgaaattgctgcaacgattatcgccatggcgcgcgggctaaagctgggtgtcctggcagaaggtattgaatcagagcagcaactggctttcctgcgccagcaggactgtgattattatcaaggatatctgtttcaccggccggtaccggcaatagaactagaagcctggttgcgtgagcattcagtgcccaatagataggcgttaccgtaaatctggttttcccgatatcctccgtactttctgcaatgaaagcagatgaaggatacggaatcctgattcctcaatggaatagaggtgcgccacaagtgccgctgcacatcaagttcaccagagggtatttcttgtcattggccaccagccggttaacccagtctttcaagtaaatgccgccagcacttttttcagtgtagaaaacacccggggcaaatacatccagtaatccaacgtgataggttcctgcgctgatatagtacttcgagttgttgttgatcagcgcattggcattcaacgtggccagcattcttaaatgccactcaacagtggttacaggtcccacatccggccactgattgggatcattaattccctgatctgtttttctcatgatattgagaaataacgtttgaacgccatcccaggcagtcgtgatatatgcaaacttgctttttgtgaaatggcgctcaatgccagttgccagattggtgaaaaaattaagggaattatagttgctaatctggctgatgcctggtacccaggttgcgagcgtgtgttcagtgccccatgggccatcaggtttgaaaactgtgcctagaaaattattggtaaggactcctgtccctgcgtcggagaggagtgatattttcgtgctgcccggataaatgctatgtatccggggaaaattcattaaggcagcgtaagcgcctgcactggaccctgataccagcacttgcttggtattcgatcgatccggtctttgttttaaccattcacgcacggccatgaagttgtcaaaaccgcggtgatgcactatcacgggacttcctccaccaataatccctaaaggatcgatgtaaaattcatctttggagccgatatgtatatcgcctgtacaataaggaataaaaaccatgttccaatcttttaatggattatctgcgcgcgtgtaatccattattccgcccgctccttcagggctgttttcagccgcaagtgaaggattataggcaggccgggttgttggggtgaccggggtagtcagcgaagtcagacaggttgcaccattccagcaggcacccccaccattaaaataaatgagcgtttgcggtttggtgcctttccggtagtaaaaatgaaactgctcctgtggatcagttggatcactgaatgcacaaccaggttgaatatctttatagttaccgtcatcatccagaatggtttgtgcggacactttcacttcttcccaccctgccgcatacactcccggaaaaaagaaaagcagtaatacagaaattaaggtaattcgattgtatttcaacatcttaccctccctactttatttaaggtgaacttgttatttatattcttcttcacgaccatcacctgtatggctgctagtattcatagtaatacaaagtcataaattccggaaagatatgatagatcatgagcctattattcttcatccctgattggtatacagagagagttccaatcacggatcattctcacaagcatatggaaaattgtgcaaggctagcgtatccgcaataacgaatatggatttattctggagttcctttaagattgcctgcatgttatccggccaacagccgacactccagtttattttgaaagaggaaaatgtaatgaagcgagaaacacttgctattcatggtggttttgccggtgatccacagacgcattcggtcgctgttcctatttatcagactaccagctactattttgacgatacccagcatggggcagatctgtttgatctcaaggtgcaagggaatatctacacgcgcatcatgaacccgactactgctgtgctggaagaaagagtggcattactggaagggggagtgggggcgctggcgctggcttccggcatggctgctattacggcctgtgtacagacgctggccagggcgggcgataacatcatctccactagtcaggtttatggtggaacctataatttcttttgtcatacactgcccaatcagggaattgaagtgcgcatggtggatggtcgtaatccggctgcttttgcggatgcgatcgatgacaagaccaggatggttttttgtgaatcgattggcaacccggccggtaatgtggtggacattgctgcattggctgaagcggcacacacggcgggtgtgccgctggtcgtggataacactgtggcttccccggtattgtgccgtccttttgagcatggcgccgatattgttgtccatgcgctgactaaatacatgggtggccacggtaccagcattggcggaatcattgtggattccggcaaatttccctggaaagacagtccgcgttttccacaattcaacaagcctgatcccagctatcacggcgtggtatatgtggatgcatttggcccggctgcgtttattggtcgtgcgcgcgttgttccgttgcgcaacatgggtgcggctatttctccctttaattccttcctgattctgcaaggaattgaaacgctaccactgagaatggagcgccactgtttcaatgctttggagattgcacgctacttgaaagcacacccaaaagttggctgggttaattttgccggtcttgaagacagccgtgactatgttttggcacaaaaatacatggatggcggtattccatcatcaattctaagctttggtattaaaggtgggcgtgatgcctgtgctcgcttcatggacaagctcgggctgattaaacgactggtaaatatcggagacgccaaaacgctggcctgccacccggctaccacgactcaccgccaacttaatgatgaagagctggccaaagctggtgtcagtatcgatttggtacgtttgtgcgtcggcattgagcatattgatgatctgattgccgatatagaccaggcctttcaggaagtgtgagtatttgtttttgttgtattacgttgctcgtctgaaagtgcgttacgcaaggttttgctggtgtcatcggctggtggggttctggccggttttatacgtggggcagtaaaccccgctaatacaatgtagagcgcaaacaggaaggcaatactccaggttgatgcagctactgtcagtaatatttcccggtagctgctaaaatctgccaccatacgtgtgatcgcggcgattgacatgaatccggtcatgaccacgataaacgtgatgcgtgaaggatattgtttgatgtgcagcagcgtgacacgcacgataacgtttgttgccagcgtacccagtgcgccgacggtaatggcgtgcacggcggtgctgaaatggctgccgccattcagttttgtccaccccagcaggatcaggcccagtgccaaccagccgtagcccagcccgagacagagcagatccgggcgtgcccgacagtgccataattgccagcggaacaggcggatgcctgccagcattccgctgctgatcagcagaacaccggaaagtgacgctgcaataggggccagaatgtatgcagcggcaatggtaagaatcaacccggcttcgatattgggctgcactctcgcagtcagctccatgccttggcgatagaattcccccgcagcagcgggtgccagcatacggccgccgataaataacatcagcaacgcgaacaattgtaggctttcattgattaaataacgatgcagcagatatgcatcaagccgcccagccagcaggattacggttgtgagggcgcagattaaaccgagcaaaggaacaagtgagcggttacgccattttttagcagcccacaggcggggaagcaactgtcgagcgagcaggatagcaaacagcgcgttgaatgccaaagttggccaggcgaagggagcaatcaggtcagcaactcttgccagcagccagaagcccagaaaccagaccagccgccgggcgggcatgggacccaataagtagccggcaatcagtgccggagccaggccgaacaacatttcaaacgcatgccctgctggcgtgactagtatgaccggtccgtaaccatacctggccagtatggttagcgggatgattaatatcgcatgcaggcacgctgccgtaaaaaaccactgatgagcgtatgccttggtttctcctgggaaaaaccgtgagaatagatttcctgattgtgcactattcatttttatattggctggctgctgcaagccggtttgcagaaaatagaatacggcaaaaggaagaggtgcctgtgttgtggagaggtgatggattggctgtgtttcagtcgttatgtgttcgcgcttgagtgattcggctgccgggaggcacactgcgtgtcagccagacattgccaccaatggtggagcctttgccgatagtaatacgccccagaatagtcgctcccgcataaatgacaacatcatcttcaacaatagggtggcggtcgattccctttaccagcgaaccgtgttcatctacctgaaaactttttgcaccgagagtcaccgcctggtacaagcgcacgttgttgccaatgaccgtggtttcaccaataacgacgccggtgccatggtcaataaagaagcttccgccgatttgtgcacccggatggatttctatgccagtttgtgaatgagcgatttcagaaatcatacgtgcgatcagtggggttcccaactgatatagttcatgcgccagccgatgccaggtaatggcggcaacgccgggatagcataccagcacttcatcgatcccgcgggcagccggatcaccttcataggcagcgagcacatcatcatcgagcagtcgacggattacgggcagccgtttggcgaacgtttgggtgatttccgttgcttgtgcgtaagtttcctgatcgagttcttcggttcctgaattgaagtgcagttcgtgctgaatctggatcagcaaggcgcgtaacgttgaattcaggatatggccaacataatgatcaacgccttccaccgccagatcggatgggccgaggcggttagggaataatgctgttcgcagaccttcaataattccggccaacactttgcgggaaggcagccggggcggtctgagatgtccttgtcggttgatcagtgcagtggtgcgtacatcccgtaattcagctaccacgtcgttgatctgcaagtgtgtgcttttcaacagtaaatcacctgccccattgatatctgtcacaatacctctccgtttcttattgtggacacttctaaaaattggctcttcaggcgatcgtggcgttgtatgccttgccgccttgcctgtttattgggtatgtttcgttgttgcgctctgtgtgcttttatcttgtactaccggatttttaggggtgtccttatgatcaaaggacatccctgaattaatagccgagaattgatacccggaataaacctgctagtaatatctggatgaacctgacccgttggcagcagagctggagaaacaggaggtctattgtacctgcccgcattactttttctaccatgagatttctggcttttttatgagcctgtgtttcaatggggttacatgttttaatgatcttgtcatcattatgtgtcaggaggaaagcaactgatggatcaatatctattatatggcgacattggtggaaccaagaccttgttgcgctctgttgtgatcaagaatgaggaagttgagcttcattatgagcatcgttacgatagtcgtcagtacggtgattttgacagtattctggaagatttcttaaagcaatctgactgtcagccggttgctgtctgtttggcagtcgccgggccgattgttgatcaacaggtgcacctgaccaatttgccctggacaatcaatgcctccgcccttgcggaaaaattttcaatttctgctgtgaaaattgtcaatgattttgaggggatggcagcttctatcgaagtactgccgcaggatgatctggttatgctgcaagccggggaaccttcttcttctgcgatgcgtgttgtactgggggcgggtaccgggatgggagttgcttggttgatcaagcgtggacgatactacgaaccgcttgccaccgaagcaggtcatgttgattttgcaccgaccagcgccattcagattgaattgctcagatatctgatgacaaagtatcagagggtttcaattgaacgattgctttctggtcagggattgactcacatttttaattttttgcaagctgatgcggcggctggcgctcacttgaaaagtattgaactggatgctgatgatggcgcaaccgttactcggctggctttcgagcaccaatacccgattgctctaaaagcgcttgatctgtttgccgagatttatggtgcttatgcaggcaatctggcgctgacagggttatgccggggtggcgtctatattgcaggcggcatcgcgccgcgcattatccaaattttgcaacaacccggttttatccaggcattctgcaacaaagggcgatacagtgaactggtgcgcgagattccggtttatgtggtgatgaatccgaaagctggtttgctgggtgccgggttgctcgcacagcgcatgctgcatcagtcaacgatatctcttgcggaataactgggatcggctgaatgagtagttatgaaagcctgatcgcaacactggccttgaccatggggagttcctgggcaagcgggataaatctgtatgctgcgttgctgatactcggcctgggcggcgtcactggtaatattgctttgccgcatgaactggcagtactggaaaatccctttattatcggggcggcaggtaccatgtatcttgttcaattttttgctgacaagataccgggtgtggatagcatttcagatgctctgcataccttcgtgcgtatcccggcgggtgccatgctggcagcaggggcagtgggggatgtttctcccgccttggaaattgcagcgggcatactcggtggcggtgcagcgacaaccagccatgctgccaaaaccggcacacgtctgatgatcaacacctcgcccgaacccgtatctaactggactgcctcgatcagtgaagatttaatagtgattggtgggctgtggacagccctaaatcatccgatattgtttctgatcttgtttattatatttgttggcttggcaatctggttgttgccaaaattgtggaagctaatcagggcattgatgataaaaacagcccgatttctgaggatcatatctcctcctgtagtggctgatgatgatactccgggggataaaaagtctttttaggctcttggagattgattgatcagttgatcagttgcctatatctactatctcactgcggaaaatgaagtacaccgcgccaaggatgcacagccccgcccagagataatcaagctttagcggttcttccatatagagcaagctgaaaggcacgaatacagacagggtgatgacttcctgcaggattttgagctgcccgagggataaaacactgaacccaatgcggtttgccggcacctgtaacatatattcgaagaaggcgattccccagctgataagggctgccaccagccatggtttactgtttaaatcctttagatgcgcataccaggcaaatgtcatgaagacgttgctgattgagagcaatacgactgtaagccaaatttcgcgcatgatgaaattcggtgtctaactaatccgtttcgaacaattctaccggtctggattgcatcagctgtacaaacggtatggctggatcaggggatgcaatgagctgatcaaccagttgtcttttttctttccctgtaatgaccagtacgatgcggctactgttgataagtgcctgcaagctcaggctgatacgcggggaaggtgcagcgggaggtgtagcagcctggcacagattagctgaattcatatctagcgtcatgccaggaaacagagaggcaatatggccgtctgcccccaggccaaggatgatcagactgaatggcaagggtaacccggccaggcgcatatcgaggtcagcaattgcctcatcagggtgagcgtgtttggttttgagagggataaaatgaggctgttgctgcatgtgttgcaggaaatgctcacgcactagccgttcgttggattgctcgctggttggttctacccagcgttcatcgcttagcgttacaaagacgtgttgccaggggaggtttatttgtgccagtcgaggaaggtaaacagtgggtgttcttccaccaggtaccaccagactggcttggccgtgctgtgtgattgcattacgcaatgtgacggcaactgattctgccaatgcttcagataacgagggaagatcgttgaaaacgtgacgttcgatcaagtggttagtggacataggtcaggaataatttcaactgatttaggaaaaggattgtcatcgcctgggcggacgcgaccaagaaatataacgccgttctgctgggcactttcataatccaccagcgcatcgccgaccatcagcacgcgctcaggatcaagcgggtgggctgacaaaatatctgccactagcgcttccttgagtcggggagagccgtgtaccctggtgaagtagcgtgacagtttgcgccgttcaacaattgtgcgcagttcattttccggcgtaccggaggcaacgaataatggaatctggtttaccattttatccagtagtgtttccgctccagctaccgcttgacaggcaatgactgcattcatgaccagttcggaaaatcgccgatccagttcctgctcttcttccttggtaaggggagggttatttagcagattttgctggaaataatgaaatttgagatagcgtgacataccgccgttggtgcggtgataatctactgcggcctgtgcgatcgtttcaccatgatggcgatacagttcagcaaaggcctgtgccttgatatccccagattccacgatgacaccatcgaaatcaaagataatggcttgccagtagtcagtcgggcggcttgttatgttcatgcctgattataccgcggaagaaggggttgcatcttcttcttggccatgattgatctgctggtgaatttcctggatacagtcgagcaatccctgcccaagatcaacatgctcattgagtaccagtttgcggccaacacggggctgaaatgcatacggcgtaatctggtaatgatgccctggtttgtcctgatccaaatgcagagcgacatcccacggcatcatttccgagatcatggtcatgacgtcacgaatgcgcattttttcctggccagtcagaatcaggtggcggttggcaaattccgaagcaagcacttgtacgctcatgcgggcggcgtcttcgacatgaatatattcccggatggattccccactgccatgataggtgatggaatgttgttgtacggcctcgtgcagcatgcgataaataccgttgcgtttgtccgaacgtcggccatagagcgatccatagcgcagaatggtgtattccagtccatagcgttcatgataggtttcagtgaaacgttcggctgcctgtttgctggcgcgatagaacgagccggattcagagtaaacgtaaatgctgctggcaaagataaagcggcgtacacccgccagtcgggctgattcgagtgcatgcatgttaccgatgacattgatgctggctgtggccagaggcttatcattggcctcatcaatatcagcgatggcggcaaaattatagacaaccgcagcaccctgaacggcgttggatacctggttgatatccatcagatcaccaatgatcatttcctgatcaggccgccggaacggggaaagatggcgatcgaacagacgcacctgatagccagcattggacagggcatcggcaacgtggctgcccagaaagccgcctgcgcccagtacaactgcaatttgccccggctgtattgcttcactcattgatcaaacctgcctcgaccattccccgccacaaattctcagccgcttcgatttccatgcgctgccgtgtttctcgcgcaagtgatccgatatgagaagtcagtatcgcctgtttgcattcgcgcagaggtccctggtagggctcctgttcgaagctgtctagtgcagccgcttcaatgtgccctgaattgagcgctgtgcataaagcggtttcatcgaccaatccgccacgggcggcgttgataaagattgttcccggttgcatatgcgcaatggcttcggcattaattaaatggcgaacatctggagagtagggcaagtggagtgtcacaatatcagcctgttcgagcaaagtattcaatgaaacgagttcgatgccgccgggtgcttgctgaagatgagggtcatgtgcgatgacctttgcctcgaatgcctgacatagtttagcaacccgtcggccaatatgccccaggccaacaatgcccactgtgcatgcagccagcagccgtccctgtgtgcgtggccattcaccttcgcgcacggaacgatcagtgtgattgatctggcgcaggcaatcaagcatcagccctagtgtcagttctgcaacagcctgagcgggcgcttcaggggtattggaaaccttgatgtttctttgttgagcagctttcagatcaacactatccatgccagtgccgcaacgtgcaatgacacgcaaagcactggcgcttgtcaacacatgttctgtcagcggttcaactcccgccagcagggcgacggtatcggtgctgagtaaatcaataatttcatcttcggtgagcttgcgtcggtaaggattgccggtgacggtgaagccttgtgcctgcagtcgctgtatggcggggttgtgatcaaaatcgaaagaggaagtggaaacgacgatcttgttcatgaagatgttctgatcatgttcagatgggtgcggcaaagggaatcgagcatgcggatatcaaggctgtatcccagaaatgaaaatccctgtttgatccgttgttgcagcgcggctgtgtcgggttcaacgacatggatgccacctgctttgtgatggtggataccagcttgcaatacttgctgaatggctgcctgtacatcgggatgattcagctcacccggttgccccattgatccagatagatcataagggccgatgatgtaagcatcaataccaggagtggacaaaatggcatcgatgttttcaatagcgcggatatgctcaatcatcacgatgacaaccgcattgtcacgcaaccattgctggtatgcctgaaaacttgtgccatagccctgagcacgcgctaaccctacaccacgggttccttcaggcggataataaacagcatcgactgcagcgcgagcatcttctgcagatttgatcatcggcaccatgattccggttgcaccggcatccatgacgcgtttgatctgatcgggatggttggaggtcaatcgtacgattgccggacattgttggccatctagcacttgaataagtgcttgtacttcgctcagctccagtacgctgtgttcggtatccagtaccagccagtcaaaaccggctttggccatgatctcagcaattgaggggtgtccgagcgtgatccatgagccaatggtcagttcatgatgggtgagacgggctttcagtgacataagcgctccagttagattctttgatatttgcccagtagcggatcattagccatcagctgcgcaacacgcgccagatctgcctcggtatcaactgcctgtgtatcgtattcagtttccaccatcctgacgcggcggccgtgttccagcaggcgcagcatatcaattgattcgaggcgttccagtggggtgggcgataactggctgtattcgagcagacaggtgcgtgtaaaaggaatgatacagacctgcttgtaagtggcagttgctccaaagccaccaggagccaatgtcggaatcggctgacgggtcatatataacgcatttccctgctgatccgtaaccactttgatggtgttggggctgcgaaaatcggcttcatcgtcgattcgcttcgtcagattgacgcattccagtttggaatcattgtggaaaggtgcgatggcggtgtcgatcatggaaggatgtgtcatcggttcatctccctgcaccatgacgatcagatcagcatcggtgtgtgcggctgcttccgcgatgcggtcactggctcgttcgtggctgtctgcagtcatgatgacgggcgctccgaaagcggttgctgcctgtcggattgcttcgtcacaagtggcaatataagttgcgcttagcgatttgctcatggcaacacgctggtaaacatgctccagcatggtgcagtccagcagctgtgctaacggttttccgggaaaacgcgaagaatccatgcgtgccggaatgatggcgattgttttcatagttatgggaaaagtgactggctaaaaatatgcagatatgatggggcgaataaaatatttttgcagtgtgtgttgcggctggtttgctggattcataggtattatacgctgtgtataatgccactttgcagtcaaccttaatccttccttgtcaatattttgcataataacacaggtttatttgacagctctttcggctatcgcttggctgaataggctgttgaacagtgcaaccattatggcaaaaggccatctgggttctgttgtcctgcgactgctgctgatacataccggagacaaaggatgatagatattaggaaatttgtaatacctgctgacaaaacaatagatgtcgttattccggtttataacgctcccgattggacacggcgctgtattgattccattgtcgcgcatcttaatcagtccattagacgcattatcgttcaggatgatgcgtctggccacgaaacgagggagatgctggataacctgccgtatgattgtgttgacgttcaccatgcggagaaaaaccagggctttggtctttcagtaaatacagcagtcagtcgatctgacgcttactatgtatttattcttaactcagacaccgaagtcagccaggattttctgccattgttatgtgcaacattcgccgctgatcctgaattagcagccattgttcctgccggtaacagttacgcccaatataatcttgggcgctatatgctgcgggaagcaggctatatacccaattactatcttcgtggacacgccatactaatccgccgtgatgtttttcaggaaatcggaggcttcgatccagcatttgggcgaggttattatgaagatattgatcttggccgccggcttgatcttcacggatggcgtttcggcatacaccctggtgtctgtatttatcataagagaaggggttcgtttggtaatggacgatcacagaagcaactttcacgacgtaaccgtgccttttatctttcacgttaccctgatgcacgacaaaatatcctgctgttttcgactaatggatcacttgtaaattttccttcgtctgttctgattacaattgaaaatgtatttcgtaaaggaggttatgtacattggcttacctcggcgcgatcacccacgttgctatgtctgcaaatgtatagtcagccgttgcgcttatccgcggtaatctggacaacgtttagaaactggtggcgtgcggacagacgtatctcggctatctggatgatggatgatatcccgtttttattacgcaccttgctaatcgtctggggtcgtgtgttcaggctggaagtaaaagagctatcatttgatgaatctcctttttcttttgagggagcaatattaaagaagtaactgtaatatcgtcagaatagggaagcactgtcattgtaaatgctcgtcaacctgttgatttgaaaggatctattttgagtagtgggattgtattgagttggcgtgagttgctggtgcggtttgtattggtatttttttgtcttgcactttggcccagtgggttggtgtattggggaataggtttgctggttgttgcctggctggtggatggaggattatccagatttcctgatctgttaaaagagcctttaatacaaggtgttcttgttttttgtggggtatggggagttggcttgctctggagtgatttttctgtatcccttacagggaaatgggaaaaatattttattctgctgataattatcccattcttttcattgttaaataaagagcgtttaccttgggtgacgggggcgctgattagtagttatctgggagtggttgtgctgggtggctatcagtatgcagtacttggtgggcaaggaatttctttgtttggtatgtcttatttgaatttctcatccacactaggaatcggcgttattttggctgtttatggtggatgggttactttgtccagaatgcgctggtttttatcggctttgttatggataaccgctttgttgttgctatttcttcagtttcgtgagaatgcaagaggtatattgctctcaaccgtaatgatactcttgttaatgttttgtctgcgttatcaagtaaaaggtaaagtgttagcgagttgcctagcttcaattattgcagtaactgtattgttcgccgcgagcagtgatgtttttcatgaaagactggaagcaatcggctcagatcttcagttatttcaacaagggaattatcaaaccagtgtaggttatcggctggcaatctgggatattggtttgcatggtcttgttgacgctcctgtcatagggcatggttctggtatggcgaagcattatctccaaaatagttttatgtcctataaagaagggatttaccaggatttgcctgagtttcatgaagcaaaacatttccataatgaactaattgaaattggcgtacatctgggattgcttggtatattggcttttatattcttattatggtgctggttcaaaacattcaagcaacatcagatggctttgttgggtggtgcaattgtgtgtttcacttttttgtccggcctgactgatactttcttactatacagcagaattccaccatttttactcgcagtgacggccatagctgtttgctggcagagggatgaaggaagccttgatctaatcgatcgaaagagtccgcaaatcaagggtggaattcgtaaacgttccagtatggctcgataatgccaatcctgcagccaccggttgttgataatccagatggattgatccctgttaatccgatgattgaacattatatgtacactctgacagagcagtttgatcatcccatcctcgatgaaatggaagcatttgcccgaatgagaaattttccaattgtaggcaggctcgttgggatctcgctggaaatcctcgcaaaaatgataggtgcacatagagtttttgagtttggcagcgggtacgggtattccgcttattggtttggcaaggcggttggacctgatggccaaattgtctgtacagacagcaatccggttaatcaggaaagggcagagcaatatctctctgccattggaatatgggagcgggtgaagttttgcacgggctatgctcaggatatatttgcacagactgatgggatgttcgatatttgctacaacgatgcggataaaggaggatatccggatatctggcgcatggccaaagaacgtatccgccctggtgggttgtatattgccgacaacgtattatggcgtgggcgagtggccgtggatggctctgcagatattaaaccaggctggactgaagcaatcagagagcataatcagctaatttgtaaggatccggagtttgatgcctttatcaatccaacgcgtgatggcgttatcgtggcgcgcagaaaaatggcataatacagctttgaattatttgtctttctattattaatcagtaaggagaacttttatgcagatccatgtgtacgatacctatgtcaaatccaagcgcggacacactatgcattttgatgtgtttactgatgtaagggatgataagaaagcgattgaatttgccaaggaatggcttgcttcgattggagaagagggtgcgacggtaaccagtgaggaatgtcgtttttgccacagccagaaagcacctgatgaggtgattgaagcgatcaagcagaaaggatattacatttataaaatggaagggtgtgattagcagattatcggcaagtcgaagtattgcgataattatggagctttatacgatgagatggatattcgcaaaaatactgatactgtcagctgttttttttatgacgagtattacagcgcatgcggctgaaccaaaatcaatcggagaatttggtgattggatcgcctatgtgtacatggaggaaagtaacaaggtttgttatatggtcagcacacccagtaaggaggaaggtaactacaccaagcgcgggagtgtttatgcgctgatcacccatcgtcccgctgagaagagcaaaaatgtgttcagtttcgttgcaggttactcatttaaaccaaacagcgaggtgacagtcagtatcggcggccagcgtttcaaattgtttactcagaatgaaactgcctgggcatctgattcagcaacagataacaaactgatgtcagcgatacgcgggggcaatcagatggtggttaacggggtttctgcgcaggggacggcaacaactgatactttcggtttaaaaggatcaagtgcagcttatgctgccatttccagggaatgcggaattaaatgaggcgaggcggttatgggcgatagaataactatttatcaaaaacccacctgcagtaaatgccatgaagcattaactattcttaaggaaagtggtaatgaattcgacagtattaattactacgatacccgactgaccatcgacatgttgcgcgagattgttcgtaagttgggtattccagcaagaggtttgctgcgtgcggatgagccacttgctatgggttcggaatcagcgaatgatgaggaattattacaactgatggcggccaatcctgatctgattcagcgcccaattgtgattcgcggggatagtgcggtactggggcgaccccctgaaaagataaaaaagttactagatggctgaaagttctattttcagagtgcaggtaattctaattgcctgcactctgaagtctggtggttaatctgcagcaacacttctttgttgaattctgcgtgcaggtaacttctctcggattcttgcagctttgccggttctatctctcaggtaatagagctttgctcgacgtactgcaccgcgccgtttgacttccatgcttgcaatgagaggagagtaagtttggaacgtgcgttctactgcttccccgctggatatttttctcacaataaatgaggaattgagtccacggttgcgtttggcgataacgaccccttcaaaggcctgggtacgtttacgatcaccttctacgacatttacgttgaccacgagtgtatcgcccggcgaaaaatcgggaattattttccccagcctttctatttcttcacgttccagttgttcgatcaagttcatttcgttgctcctgttcttttattgtatctgtcgcctggttggtaatcgtcaaacattgtaattgcttaaactccgccagtaattccttttccttgccagggaggccttctggatatttttttgctaacaaatcaggcctttttagccaagttctaccaattgcctgttgctggcgccaacgctctatttttgcgtggtcaccggacaacagcacttcgggtactggtttttctttatagatatcgggccgggtatagtgtggatattccagtaaatgatcaacgtgggaatcttggctggctgattgtgtatcacccaatgcgccaggtaattgcctgatcaccgcatcaattaagaccatggccgccagctctccaccagaaattacgtaatccccgattgaaatttcttcgtctacctgatcttctattaatctttcatcaattccttcgtaacgaccacaaagcaatatgactccatctagtttggaaatctgcagaattttttcatgatccaatcgcttgccctgaggggaaaggtaaatgacgctggttctgctggttccattcttggtctgccgaatttttgcatctgtgatggccagatccagcggttcagccatcatgaccatgccaggacctccaccataaggtgcatcatctaccgtccgataacggtttgtggcatagtcgcgagggttccaggtatgcagatgatataagttatttttttttgctctgcctgtgactccgtgttgtgtgacggcatcaaacatgtcgggcaacaacgtaatgacgtcaaattcaaacggcatcatacaaaattcaataatccagctcccaatccaccatgatttgtcgtgatctcagatctacttgcctgacaacctgatctacaaaaggaatcaattcttctttgccgccggggagctgaatgcgcaatacgtcatttgcccctgtttcaaataagccggccacagtcccgataaattcaccttccgtgttaacaacactgattccaatcaaatctgaccagtagtagccctctttgccatcttctgatagttgaggcagttgactgcgtggtacggcaatcagccaccccttcagtccagaggcattcgtccggtcgctatattcttccaacgtaataatcagcaagctgtcgtgaacagagaaagaggtcggatgtactatttgccagcttttctcatcattgctgagccaccacgcaggatattccatcaatccatcaatatgctcggtgaagggagtaaccttgatctggcctctaatcccgtgtggaccaataaccctacccaatacaaccattgactcctcgtttatgagaagcccggcttcactctgatggctaggcgggtttttgctgtctgccaaactgtttaacgagcctggagacggtactagatagctgtgctccttgggattgccagtggttcaggcgatccatctgaatacgcaaactttcttcgccacccgtagcccgagggttgtagaatcccacgcgttctataaattttccgtcccgatggcgacgggaatcggccactaccatattgtaaaaaggacgcttcttagcaccacctcgtgccagtcttactactaccatgttgccccttgtgtaaagtggttatttgttaactaaaacctgtaattctatggcaattttcatatacttagcaagtaataaattaaattgcaatccggtggctatgtatttaaaagggatcggccaaattaaggtaatcggtgatattaatataatcattcaagtaaaagtgtatcgtgaacaatacaatgatttgattctaataaggtagttgtaaaagtcatgaaaaattcagatcagagttattacttgattaaagagctgcttgcagaggccaatcgttgcgtggcatgtggattgtgtttgccgcattgtcctacttatcacttgacgcattccgaggcggattctccgcgaggacgtattgcactgatgagtggggttgctaataagcatattccattgaatgagagatttgttcagcatatggatcgctgtcttacttgtcgtgcctgcgagagtgtgtgtccaagtaacgtcgcctatggtcgcttgattaataatgcgcgtgccatgattcgcgaaaactcatcctttgttcaaaaagaaaatcaaagtggaaagagttggttgagggatttgctggaacgagagctggttgcgaaatctgctcgatttgacatattgcggccagcgttgcgtctattggtcaggaatggtttgctgtcgttgttgttacggttgaatgtactgaaaagaaatgccctggctcagtctctgctatttctgacaacacgcaatctaccggggcaaatatggcgtggctcatacccggccaagggttttctgcgcggcgaggtggcgttgtttctgggttgtgttgcaaggctggttgataccgaaacactgctttcaaccatatccatattgaaccagctgggttatacagtgcatgtgccaagtgcacaaacgtgttgtggagcgctttatcaacatagtggtcaggttgatgcggcaatgtcgctggctcaacaaaatctccgtgcttttgaggggttgaatattcaggcaattatcagtactgcttccggttgtggtgttcaattggcagagtattcgtcacgattagaagatgccgggttttctgtgccggtaatggatattagtcaattcctcgatgcgcaggtatgggatgaaatcagttttgtgcccttgtcgcgaaaaatagcggtgcatgagccttgtacgttgcgcaatacactgcgtgcttcaggctatctgtattctgtgctgcaacatattccgggaattgaagtagtggaacttcctggtaacgatcggtgttgcggcgcggccggtacctattttcttgatcagccagaatttgcaggagctttgcttgatgaaaaattacaaatttttgaacagaccggggctgattgcctggtgacggcgaatatcggttgtgccttgcatattgctaacgggttggtgagaaaggggagaaatatagaggttttgcatccggtaacgttgcttgcacggcaaatgcgtataaaatgaaaagtagattgttctggctcaagacgggaaaaagagattaatggaggaatttttatgttgaatgttgataaattgattattagttttgataacgctctgcgtacattactggctcctgcagctactttgcgtccgattccggggaaggatctgcctgagaatgagttgagtaagattgaaaaacgtgaatctgcagcactgatgcgaattaatcatgtaggtgaggtctgtgcccaggcgctttatcaggggcaggcgttgacggcacgcaatgagcaggtacgtcaagcactggatcaggctgcgcgtgaggaaacggaacatcttgcttggacagagcgccgaattgcggagctgggcgggcataaaagttttctgaatccgttgtggtatggaggatcctttgcgctgggattggtggcaggtgcgcttggagataaatggaatcttggttttctggctgaaacagagcgtcaggttgaagcgcatctggcagaccatttgcagcgattgcctcatcaggatgttcgcagccgggccatcgtgtcgcagatgaaggtcgatgaagcatgccatgctaccatggcggtttcgtatggaggtggaccattgcctgtgccggttaaggccgtcatgaaattcagctccggaatcatgacacgtaccgcatactgggtataagtgcggtaaatttttatagatgtcgcaatcgtaatgcaaaccatcaacctgaccgatcattttctgattgctatgccgagattggaggactcgttctttgccaaaacgttaacctatatttgcgagcataacgaacagggtgctttgggcatggttgtgaatcgaccgactgatttatcggtgggaaaactgctgatgcaattaggtatatccccccaggaccccgctctttccaatttgccggtattgttgggggggccggtgcaagtcgataatggatttgtattgcacgaaccggttggagcatggaggtttacgttgtcttccaatgtggtgactggtctgaccgcttctattgatattttgcaagcggttgctgattgtcaggggccagagaaaatcctggttgcgctcggttattcaggctgggcggctgggcaactcgaacaggagctggcgcagaatgcctggctgactgtacccgctcaatcccggatattgtttgaactctcttttgaagagcgactacctgctgccatgaaattgctggggattgattttttcaatttgtccaatgaagttggccatgcctgattctgccgaagaaactatatctgacatggcaagcgttattttatccggcactgtgcttgctttcgattttggtgtgcgacgtataggggtggctattggcgaatatgaattgcgattagctcatcctttgatgacaattgatcaggcgatgactaagccccgttttgaaaagattgccgaattaatcgagacatggcaaccggttttgctggtggtggggttatcggttcatgccgatggtgctgaacatgagataacccgattatgtcaacgttttgcgaggcgactggaaggacgattcggaattccggtggcgatggaagacgagcgttatacgacagcgattgctcgtttaacgttggaagaagtaggcattacaggcagaaaacagcggccaatgcttgatcagattgcagcacaacatatccttcaaactttctttgattcatctcatgcagcttcctgatgccgaacagctactgacactgcttatcgaaaaaatccgattggatgtcactgataaaacgactattgtgggtattcataccgggggggcttggctggctaggcgtattcatcaggcattgaagatcacgcagccggtaggggtgctggatatttctttttaccgtgatgattacagtaaaatcggccttcatccacaggtcaggccttcccagctcccttttgaagctgaaaatagtcacatcattctggtggatgatgtgctctatacaggtagaaccatccgtgctgcgataaatgaattgtttgattacggtcgaccggccagtatccatctggctgttctggtggatcgtggcggacgggagttaccgattgctgcacggtatacaggagccgtactgactttgccggaaagcagcatgcttgaactgagacaggcggatgatggaaaactgagcctggatttgcgtagcatagtaactgagtaatgtatattctgggagcctaccagcagattacctcccttgtactttcatcaatattgccggtctgctttaaatcgcggattatgctgttgttatccagatgactcggactgttttgtgcgaacagattttatttgttgatatttaaaacaaatatgtattgttgtaattctttcggaattcctgcgtaatgagtatacatccgcagttgaataaaaatggggagctgcagcatctgcttacgacagaggggttacctgctgcgattttgcaccatatccttgatacagcggagtcattcaccggcgtgacagagcgggatatcaagaaaattcccctgctgcgaggtaaatcagtattcaacctgttttttgagccgagtacccgcactcgcacaactttcgaaattgcggcaaaacgcctttcagcggatgtaatcaatcttagtatggcagtttcatcccagaccaaaggggaaactttactggatacggtgaacaacctgtctgctatgcatgcggatatgtttgtggtgcgccacaaccagagtggtgcagcgcatctgatcgctcgtcatgtcggcccggaaattcatgttattaatgccggtgatggatggcatgcgcaccctacgcaggcattgcttgatatgtttaccatccgtcgttacaaacaggattttcatacactgcgtgtggcaattattggagatattctgcattcccgagtagcgcgttcacagattcacgcactgacaacactgggggtaccggaaattcgtgttattgcacccaagacgttgttgccggcacgggttgagcggcttggtgtgcatgtttaccacaacatgacacaaggcttgaaagatgtagatgtgctgatgatgctgcgattgcagcatgaacgtatggaatctgcgcatttacccagcaccgaagaatatttcaagtattacggactaacaccgggaaaacttttgttggccagatctgatgcgattgtgatgcaccctggtccgatgaatcgcggtgtggaaattgattcggaggtggctgacggctctcaatcggtcattctaccccaggtaggttttggtattgctgttcgcatggcagtcatgtcgattctcgctggaaattaacgctcgtatcctcttatgcatatttgtatccgaaatggccgtctgattgaccctgacagcggtatggatcgtattggcgatctttatctggctgaaggcaagattatgtcaatcgattcccggcctgaacattttcatgatgatcgggagattgatgcaagcggattggttgtatgccccggtttggttgatttatccgcacgtttgcgtgaacctgggcttgagtatatggccaccctggagtcggagctggaagccgcagtagcgggaggagtaaccagcctcgcgtgccccccggatacagatccaccattggatgaaccgggtctggtggagatgctgaagcatcgtgcgcgtaatcttgatcgggcacgagtctacccggtaggagcgctgactcaaggacttaaaggtgaacgattaacggaaatggttgagttgcatgatgccgggtgtgttgcttttagccaggcagatgcaccgattgccaacctgcatgtattgatgcgagccatgcagtatgctgccactttcggtttcaaagtctggttgcgccctcaggatatgtatctggccaatcatggtgttgcccatgatggggaggttgccactcgtttaggattgtcagcaatacctgtatgtgcggagacaattgcgctcacggatattttgtccctgatgaaagaaactggtgccagcgcacatctatgccgtatttccagtgccgagggcgtagcgctggtacgtgcagccaagcagcaaggtttgccgctaacttgtgatgtttccatccaccatgtacatctggttgatatggatattggcttttttgatgcgaactgtcatcttatgccaccactcagaggtctggcggacagggatgcattacgcgcagggctgatggatggggcgattgatacgatctgctcggatcatgcacccgtggatgatgatgccaagctgctaccctttgcccaggccgaaactggcgcaaccggattggagctgttgctgccgcttacgctgaaatgggcaatggaaagcagattatcattaccagaagcgctggcaagaattacatcgtatccggctcgtatactgggaattgatgccgggcgattggtggcaggtgctccagctgatttatgtatttttgatcctgatgcgtactgggttgtcagtaatgctgagttgaaaagtcagggcaagaatacaccttttcttggaatggagctatgtggtcgcacccggtttacgttgattagcgggcatgttgtgtatggctagtagcacatatgcctgaagcctatagatttcatccagatcatattgaaatcaggatgattcgataactaacaaaataccctgagaccgcacattaataataaaccctttgaatatataactgatatgaagaatccgttacttgatttttccacgttgccacattatgaagaaatccgaaatgaacatattgcgccagccatagatgagctattgcgtgattgccgtgcagtgatgaatgcagtcaaaaatacatcggaagtcccgaattggcaggattttgtgcaaccaatggtggatgtgaatgaacgtctgtcgcgtgcatgggggcaggtgacacatttgaatgcagtcatgaataatccggagttgcgtgaaatctataatgccaatctgccgcgtgttacgcagtactatgctgagttatcacaagacccagtattatttgagaaatttaagcaattgcgaacagattcggcgttcaataatttgagtcaggcacgcaggaaaattgtagaaaaccaattgcgagattttcggttggggggggctgaattatcacttgaagataaagcacggtttatgcaaattcaagaagagctgtcagcattgagtgcaaaattcagtgataacctgcttgatgcaaccaatgcatttttcttgttgatagaaaaccggagtgagctggccgggatcccggaagatatattgcaggcagccagtgaagcagcagctaaagataccttaattactgtgccgagctggaaatttacgctacatgctccatcctatctgccggttatgcagtacgcagataaccgtggtttgcgcgaacagatgtaccgggcatatacaacgcgagccagtgagcttgaagtcagtccagatcagactgtgaagcgtgacaacatgcctttgatcgaacagatcctgcgtttgcgtcaggaagaagccaaattgctaggttatgattgctatgcgcaggtatctcttgcccccaagatggcagaaacaccgcagcaggtgctggattttttgaatgaactggctgctaaagcgagaccctatgcggaaagagatctggtggaactacgtcagtttgcagctgataaactaaagctgacccaacttgaggcgtgggatattgcctatgttagtgaaaagctgcggatcgagcgttatgctttttctgatcaggaagtcaaacaatattttccagaaaacaaggtgttatccggtatgttcgggttggtggaaacgctgtacgggatacatatcagtgaagcagagcaggcgcgtaatgttcagcgttggcaccaggatgtaaggtttttcgatattactgacggtgaaggcgatgtgttgggacaattctatctggatctttatgctcgtcctggcaagcgtggaggagcgtggatggatgatgccgtaacgcggcgacgaattgaggtgccagaaatcggccgttctgaaatccaggtgccagttgcttacctcacctgtaatttttctgcgccggtgacgatcaatggccatttgcgccctgcgttgtttacgcatgatgaggtcattacactgtttcacgagtttggtcatggattgcaccacttgctgacgcagatggatgaactgggggtttccggtattaacggcgtcgagtgggatgcggtcgaactgccaagccagttcatggagaacttttgctgggaatgggaggtgttgcgcgatatggctgcgcatgtggaaactggtgattcgttaccgcgcacattattcgacaagatgctcgcagccaagaattttcagagcggtcttcaaactttacgtcagatcgaatttgccttgtttgacatgcatctgcacactgattttgatccgctgggcagcgagaccgtgttgcagcgtctggataaaatccgtcagcaggtagcagttattattccgccagctttccaccggtttccgagcagctttggacatatatttgctgggggttatgcagctggttattacagctataaatgggcggaagtattgtctgccgatgcttatagcctgtttgaggaaaatggtgttggccaagtggttaatgcgaagactggcgagcgtttctggcatgaaattcttgctgtaggcggtagccgtcctgcgcttgagtcatttgttgcgtttcgcggacgcgagccaaaaattgatgcgctattgcgccatcatgggatggtggtttgagtaatttttgtatctttggcgtgttcaatattgttgtcaaataatctagtgagaagctttgccgaaaacagtagtgctatttctctgacaggtagcgcgatgctcagtgtaaagggcgagcagtttctggaaaagctcccgtactcatgtataattaactttagcggtgcggaatcaattcgaaccgctttttttctgtctgtctgcgttttgctacaaatcattggggagtcctgtgtctaaccgtccgcgcgctgtactcgttttggctgatggtacttcttttcatggggactcaattggtgccgaaggtgtggctaccggggaagtggccttcaatacggctatgaccggctaccaggaaattcttaccgatccgtcttactgccgtcagattgttacactgacttatccgcatattggcaataccggtgttaatgacgaagatattgaatctacgatagattccaaagtcattcatgtggcagggttggtgattcgagatttgccgctcattgccagcagttggcgcagtcgccaattattgccagattttctcaagcagcataatgttccagcgattgccgagatcgatactcgtaagctcacacgtattttaagaatcaaaggtgctcaggcaggttgcatcatggctggtcatatcgatgaaatcgaggctttacaacaagcacggacttttcccggtctgactggaatggatctggcgcgcgtggttagctgtaaccaatcatgggaattcagtgaaggggaatgggatccgaaaacaggctatcagactgtaagtgagcgtcaataccgggttgttgtgttggattttggtgtcaagcgtacgattttgcgtaaactagttgagcgaggttgtcacgttattgtctatcctgctcaaacgcggattgaggagattcttgctgccaaacctgatggagtagtgctttccaatggcccgggtgatccggaagcctgtggttatgcgattgctactacacgtgcattgctggaaagtggagttcctgtatttggaatttgtctgggccatcagctggttgctttagcgattggtgccaaaacgatcaagatgcgatttggtcatcatggtgctaatcacccggtgttggatgttgatagcaatcgggtgatgattaccagccagaatcacgggtttgcagtcgctaccgacaccttacctgctaatgcacgcgttactcatcattcattgttcgacgggagtcttcagggtttcgaactgacagatcatcctgttttctgtttccaaggacatcctgaagcaagtccaggtcctcaggatgttgattatttattcagtcgtttcgtcagtcggatggcggaaaacaagcaaccagcctgagtcatcagaacaatcttctacttaaatgcctaagcgtaccgatctgaaatccatcctcattattggtgccgggccgattgttatcggtcaggcatgtgaatttgactattctggtgtgcaagcctgccgggcattacgagaagaaggttatcgtgtcattctgatcaattccaatccggcgacgatcatgactgatccggagttgaccgatgctacctatatagaaccgattacttggcaggtagtagaaaaggtaatcgagatagaacgaccggatgcattactgccgactatgggtgggcaaactgcacttaattgtgctttggacctggttcgacatggcgtactggaaaaatacggtgtggtacttattggcgcttctcgtgaagccattgatatggcggaggatcgtgagaaatttaagcaggcgatgacgcggatagggttgcaatcggcgcgttctgctatggcgcacagtatggaagaagccatgcgggcgcaagcagtgattggttacccggtaattatccgaccttcttttacgttaggggggagtggtggcggtattgcctataatcgggaagaatttgtagagatctgtgagcgtggcctggaggcttcacccacacgggaattgttgatcgaagaatctgttatcggctggaaagaatttgaaatggaagttatccgtgataaacaggataactgcatcattgtctgcgccatcgagaatgttgatcctatgggtgttcatacgggcgattcgatcactgttgcacctgcccagacactgacagacaaagaatatcagcgcatgcgtgatgcttccattgcggtgcttagggagatcggagtggaaacgggtggttccaacgtccagtttgccattaatcctgaaaatggaaacatgcttgtgatcgaaatgaatccacgggtatcacgttcatctgcgctggcttcgaaagcgacgggttttcctattgccaaggttgcagccaaattggcggttggttatacacttaatgagctgggtaacgatatagcagatggtgttattccggcctcgtttgagccgactattgattatgtggtaaccaaggtgccgcgttttgcgttcgagaagtttccacaggcgaatgatcgtctgacgacacaaatgaaatcagtaggtgaggtcatggcgattggccgcacttttcaggagtcactacagaaggcattgcgcggattagaaaccggtgtggatggattggatgaaaaaactgcagataccgagatcattaaagctgaattgggccacccggggccagaacggttatggtatgttgctgatgccttccgttgcaatgttccttttgatgaggttcatgcgcttacccgaattgacccctggtttctggtgcagattgaggatctggtaaggcaagagcaagcacttacgggcaggcagctggctacgctagaccggagcgaactgcgccaattgaagcgcagtggcttctcggatcggcgtttggcggtgctgcttgatacaagccaaagcaaggtgcgtgccagacgacatcagctggacttgcgcccggtctacaagcgagtagatacttgtgcagccgaatttgatacgcagacagcctacatgtactcaacctatgaggaagagtgcgaatctcgcccatctgataaaaagaaaatcatggtactgggcggtgggccgaatcgtatcggtcagggtattgaatttgattattgttgtgtacacgcagccttggcattgcgtgaagaccagtatgaaacaatcatgattaactgtaatccggaaaccgtttcaacggattatgatgtttcggatcggctgtattttgagccccttacgcttgaagatgtgctggaaattgtcgcagtagaaaaaccggttggtgtcattgtgcaatatggcggtcagactccgctgaagctggcgcgtgagctggaagaaaatgaagtgcctattattggtacaagcccggatatgattgactgtgccgaggatcgtgagcgattccaggcgatgctgcagggtttggggcttaagcaacctcctaattttaccgcgcgtactccagaaacagctttggcagcagcggataatatcggttatccacttgtcgtcagaccaagctatgtattgggcggacgcgctatggaaattgtgcatgaggcgcgtgatctggagcgttatatgcaggaagccgtgaaggtatccaatgattcacccgtgctgttggatcattatcttaacaatgcgattgaggtggatgttgatgcgatttttgacggagaaaccgttctggtaggcgggattatggaacatattgagcaggctggcgttcattctggcgactctgcctgttcgttacctccttttagtctttccacttctttgcaagatgagttgcgtaggcaaaccggggccatggcacgtgcgctgaatgtcagagggctgatgaacatacagttcgccatacaggataatgttgtatatgtactggaagttaaccccagagcatcgcgcacagttccctttgtttctaaagcgaccggtttgcagctggctaaaattgcggcccgttgtatggcgggaagaacattggctgatcagggtattaccagagaagtccacctagcccatttttcagtaaaagaggctgttttcccatttgctaagttttcaggagtcgataccatacttgggccggagatgaaatcgactggtgaggtaatgggaatcggtaaaacctttgcagaagcatttttcaaatcacaacttgcagcaggtgttcaattacctgtttcaggcaatgtgtttatcagtgtcagggatggtgacaagccggaggttgtttcgatcgctgcgagattgatcaaactgggattttcgctttatgctacgaaaggtacggcatacagcctatctcaggctggattgccagttgtgactgtcaataaagtggctgagggccggccgcatattgtagatatgatcaagaatgatgaaatctctctgatcctcaatacagtctccaataagaggagtgctgtgcgtgactcatattcgattcggcgtgccgctttacaggccagaacgacttattacacaacggtagctggtgcgcgtgccgcctgtacaggcatggcaaattgccaggagttgcgggtttatcgtttgcaaaatcttgtctcctaggcaacaatactcttcaagttttatgaattcctgcttaaagctatttctggaaattaatcccttgcttcttcaatcagatgtggctatgaattcataatttgtaacattaaaatgattcgttattatttaacagattcaacagattctgttttttattgtttttcatagaaagagaaattaagttatgaatgctattccaattacgcaatctggtgcagagaagttgcgtgctgagttgcatgaaatgaagactgttcatcgtcctgcaataattgctgctattgcagaagctcgttcccatggagatttgtccgagaatgctgaatatgatgctgcaaaagaaaagcagggattcatagaaggacgtattgcggagttggaaagtaagctatctaatgctcagattattaatcctgcggcattgaatgcagatggtgcatgtgtatttggcgcaactgttgatctcgtggatctggatactaacacagcagttacctatcaggttgtgggagatgatgaagctgatattaaggaaggcaaaatctctatcagctctcctattgcgcgggcattaattggtaaatatgcgggagatgtggctgaagttcaagctcctggtggtatccgggaatatgaaatattggatgttaaatatatttgagtatcagtctcttgttaatcttcagaaattaaagtgggtataccatctctggcttgaattgctgactccagagcttgttggtcgattttgatattccgtgtcattctaccgtcagtatccttcgatgttctttcaaagaattccaaaattgtgcgatggatttcctgttcaaagtcgagaggtgtaatattttcttcctccagtggtgggtgaagctcgatgtataagagatcaccctgccatcccagtttgataggctgattgactatttgtaccggcgtgcctgtaggaataagattaaacagttcctcgatatcttccggatatagacgcatgcagccatgtgtgacacgcatccctacaccaagcggcttgttggtgccgtggatgaggtatccaggcaagcccagatagagtgcatatttcccgagagggttgtccggtccggctggaacgacatccaataacggaggtctgccttcctctattgcttctttccggagtgattgggggggggtccatgtagggtctttttgttttctgacgatagtggttttgcccagcggtgtgttccaatccatcctgccaatactgacaggatgagtaataatctctggtttttgcccttttattggtttggggaaataataaagccgcatttctggtagatttattacaagtccggtacgttcagcctgaggaatgataaagcgcagtggcaaaataacttttgccccttcttcaggcagccagcgatttacattggggttggccagcatcatttcatcttggccaatgtcataacggcgcgccacatcgagtagagtttcagagcgactggctgtgactgtctgaatttgcccaagaatgtctatgtcatcgggtgggcgtacccagctgccagcataaacacaaggcatgagtgacaacatcatgaacagtagcaataagctgattctaagtgtctgtatattttgttgtttcattttatatcgtgttgtttgcctgagggtgatagcatcattaagtttatttccgtttgaatagcaggttggttattttacctatactggccgaatatttagaagcatcagattagttataaaaatttatgacatcgcctatatgatattcgcgagaatactacaaatgagtatgtacagatgtatctgtttaacgttgatgaatcgcggtaaatctaactactgaaggagtttttaatcaagccctttgcaagacattacagaaaaattcgtgaggaatggactccatggatggatccgtgatattgcgctggttatgaatatgaatttattgccttcgttgcagcagtcatcccatttcacagaacgcagtgtgtgaccagtgtgaccatatagatgaaccaagtaagcatgctgcgtaaacgtttattttggaagtgactgttgctataaaacaacactaaattcggtgttgtcttgacagttaaacagcgcttctataagctcgcagcccatacatatcatgaagtgaatacggtgcgtggagcaagataggcttttgattatcttggctaaattaattaattctttagtgtgcgcattcgatctattcagcaaattggccataaaatatttctaggggaagattttgagttcgataatagccaaattggatgttctgccggcgcaagaaggtgattccctatcttccgaagcaggtgttgtttcggcaacgcccacaattaatttgttgagccagagaagagctgattttacaacattggtggagtcgcttgagtacgcagcacaaggagaaactggacataacttctatgacgcaaaaggtaatctcaagtctgtacttacatataaaaatttatgcgctaatgcaaaaataattgcaagacggctgtctggccttgggctggcacgcaacagccgcgttgctctgatcgctgatactactccggagtttgttgagctgttttttgcctgccggtttgcgggccttgttccatttgccatgccggtgcccgttaatcttggtagccgtgcgatttatgtacagcagttaaaagggatgcttgggggcagtggggcaagcgttgcaatagctaatcttgattttattgagtttctcaatgaggtagttgagagtctgggaagcagtgaactcaaatggagtggcacacctgagcaattgaatctactacctgaagctgatgtggcgctttctccaaataccccggatgaaacggcttatctgcaatttacttccggcagtactcgtttgccgagaggagtagttattactgagcgggctttaatgactaatctgcgtggtatcgtttgcaatggtcttgatgtgagacccggtgatcgatgcgcttcgtggctgcctttttaccatgatatgggtttggttggcttggtgttggctcctttggctgcccagttatccgttgattatttggcaacccgggatttcgctgttcgtcctttgcaatggcttaaattgatcagtcgtaatcgctgtactattgcctttagtcagccttttggtctcaagttatgcactttgcgcgcacgcgattctgatttaatggatctggacttaagttgctggcgtgccgctggtgttggtgctgagatgatccggctcgatacattgaaaagtttttcagccaagttttcagcagcgggatttaatgaagatgctttcttgccttgttatggtctggctgaatctactttggctgtgtctttccctgatatcaatcagggggtgaaaagtttacgtgtagatgccaagactttgatcgaaaaaaagatagcagtaagagttcaggcagatggcaggaaatttaatgagtttgtgaattgcggacgtccgttgccaggccatgaaatcagagttgtcgatgacactgatcaggaagtaccccatttgatggtgggtagtattctagttaaaggggaaagtgtgatgaatggctactttaacaacgcagaagagactgccagagcgatcagatcagatggatggttagatactggagatattggttttctgtttgaaggtgatttatatatcacagggagacgaacagatgtcattattgttaatggtagaaatattcgagcgcaggatgtggaagagctggctgaacagcagccagaagtcagaacccgtgaagcttctgcttttggaatcagcgatgaaaatggctcgacgtcagtcgttttggttgtggaatgcaggctggcttcagcagtagatcgacaagcactcattaacaggcttcagcagatggtatatatggcatttggggtaagttgtttggttgagctggtgcccccacatactttgccacggacatcttcaggaaaattatcgcgctttgcggcacgacaggggtttttgcggcgtacaaatatggaacaacctgctgctaccagttatacagtcggctaatagaatagctaatccttcatcagtaaaatctgcttatttctttaggggaaggagtcaaaagatttcttctcgcatccggtagtactttatggttagaactgttgcagtaacaggtgctacaggatttattggccgcatacttattgctaagttggctgaatctggatggaaaatccgtgcattggcaagatgtatatcttcacaaaaagatagtccattcatagagtggatttctggagatcttggttgtaataatgcgttgcgtgaccttgtttctggcgctgaagctgttatacattgtgccggtgtagtcaaaggaaaatcttgggatgatttctaccagaccaatgtaattggaacgagaaatatattacgggtagcttctgactcaacttcttgctcaagatttttacacatttcttctctggcagcgcgtgaaccacttctttcctggtatgcacgaagcaaatttgaggccgaagaacaaatcccgagattttctggacggttagcatctgttatatacaggccagctgcagtttacggccctggtgacaaagcgatgctacctttttttcgatctatgcgatacggtatactccctgttcctggaaatccggataatcgtttcggcttgatacatgttgatgatttggttgctgctatttattgctggcttgagacaacccgtcccgtgggcggtatttatgcaattgatgacggcacatcagatgggtacaactatacatcgatagccatgattgcacagcaagttctagggaagccggtacgttgtttccagataccggcaagcagtatatgtatgttggctcgttttaatttgtggttggctcatcttttgaattacgctccaatgctgacaccaggaaaggtgatggaacttcagcattctgactggacctgtgatatttctttcctgaggaaagagctagttggttggcatccgacaatcaagttacaaacagccttgccatcacttgtcaaaatgtaacaatatttattcctgaagcattcgaaaatacttcatgcgacaatacgcgactttcatgtttctcgatccggaaataaatttgttgatatacactgttccgagattgatctcatgtctaaaataacccaaacacaaattactggactgctttgtcagcgtctggcttgttttacagatgttgaagcagagatatctccagaaactaatctcattacacatcttgcgattgattcagtcaaactgttgaatctcataatggaaattgaagatcagttcgatatctcagttccgttgaatgcacttgtggatgtcctgacggttcaggatcttgccaatctgatttataaaattaaatcatcatcataatgaatctgctggaaaaacttgatgcagctgcagcagcaaggaaagcacaattacccgaggggctcgctgcttttggtatccccatagatgaatcctactctgcgacggaagccagaatcggggagcgtcgagtattaatgctgggtacgaacaactatcttgggctcagcttttcttctgaatgcagagaggctgctcataaggctattgatcgggaaggtactggtaccaccggttcacgtatggccaatggtaattattacgggcatcgggcgctggaacgcgagttggcagagttttatcactgccgcgaatgtattgtttttacaacaggctatcaagctaatctgggaactatttctgggttggcgggggttggtgatgttgtgctgattgatggggatgcacatgccagtatctatgatggatgtattctaagtggagcggatgttatccgttttcgccataatgatgtagtcgatcttgagaaacgccttcgcaggctgggtgatcgcagccgtaatacactgatcgttattgagggtatttacagcatgctgggtgatcaggctcctctggctgagatcgtgaaattgaaaaatgtctaccagagcactctgctacttgatgaggcgcattcactcggtgttcttggagaaaccgggcaggggttggtagaaaaagccaggatgattgacgaagttgattttataactggaacttttagtaaaagtctgtgtggtatcggcggcttttgcgtcagtaatcatccccagcttaatcagcttcggtatataagccatccgtacatatttacagcttccccttccccagcaacaattgcttccacacgtgctgctttgaagttgttgcgtgatgggtattcattacgtgaacagctatggaggaatgctcaccagctttattcctgccttaaagaaactgggtattgtctgggcccagagcccggacctatagtagccgttttacttgacagccctaaacaggcgctgaccctgtggaacggattgatggcgcacgatatctatgtaaatttggtgttgcctcctgctgctccggaaggaaaatcattggtacgttgcagcattaatgcggcgcatactgctgaacaaattggccgggtttgtgagaccttctctaaactgtatccagctgtgacgcagtgagtggatgcgattactaaatttagatcctgtaatgacaagaattcttggttaatgattgataggattgtaccggactggccttctcccgcaaatgttcgcgccatgtttaccacccgtaatgttgggagggttacgactgaaaaaagagcttacactggcttgaatctggcggttcatgttgatgataatccacacgttgttcaactaaatcgaaaccagttgcgtcaatatttacccgatcatccccgctggttgacccaggttcatggttccagggcaatttgggtagattctgatagtgaagcgctggagggggatgctgcaatgagccgatatcccggagtggtatgtgcagttctggtggcggattgtctcccggtattattgtgtgacatggcaggtagtgtagtgggcgttgcccatgccgggtggcgtgggttggccaagggaattatcgaaaacacagttcaggcattacgcgaattcagccatagtgatcaaataatcgcatggcttggtccggcaatcagttcacagcactttgaagtcggtgacgaggtgcgaacgacatttaccgagtatgattgtcaggcagcgcgggcattttttccaggaaaagaaaaaggaaaatggtatgcagatctttttgaactggcacgccaaaggctgtctcatgccggggtctcccaaatctatggtggtaatttgtgtacgtacagcaatcctgaaaagttttattcgtaccgtcgtgatggtaaaacgggaaggatggctggtttattgtggatgacgcagtttcctgataagtaattcttgtttaatacccgccaagatgggagcatgtgaagtaacacgcctgttttacagttcctgagcatggatttacctaaaagatcttgacgaattttcttccttactaatgctcgattgcacataatccgtgagcgatatagtgtgcctgttctgcatatttctgacccatctggaaacataatttatgtcggtgttagcctggattgtgcttgccagcgtagcaagtggtttgctgagcattggacttgcagcattatttgctttaaatgtccgtagtgataaatggatcaatatactgatttcatatgctatcggcgcgcttcttggagcggcatttctgaatgcgttacctgaagcattggagctcactgatacaccgaagcaactgacgtttattttgttacttggtattcttgttttttttattctggaaaaacttttgttatggcgccattgccatttatcagaatgtgaagcacatgagcccacatcgcaggtagtttctacagctggcagaggtgtagtaggtgttcacgatcacggccgcagtggcatgatgattatactgggtgacacttttcataattttgtagatggtatcctgattgcaacagcctttatggctgatattcaattgggaatggttacggctattgcgattactgcacatgagattccacaagaagcaggggattttattattttgctcaattcagggtttacacgagcgggagcactctggtctaacctgctatccagcacagcaactgtgtttggagggttgctggggtattttatgctgaatcaattggatcatctgattgctccaatacttgctattgctgcagcaagcatgatttatgtagcaatgtcggatctgattcccagcttgcataagcgtcccgagatcggtgcaactgttcaacaggtcacgcttatcgttctggggatcagtacgatatggttgatagggctattttttggccataatcactaagcgcggctacctgttttctacagaagcagatgttgatgatggagtgagattattgccgcgatatccttctgcagtacgataatagagagtacgcaataaaacgccatcatgtcgatagatttcacgagtattcgtacttccaggttttatcagcattctttcaaaatttccttcggccgagcctgattctaatgcctgccgtttcattccaatcagcagaatggaccggttagtaggggattcggacgggtaccaaaaactgtacatggccgcgtgttcgccaaacagattgcgggatcggatatcaagggcagggtgattattattgtaaaacgcaagcgcactggctattgaccatttgctcatgccgaccacaattggtgcttctcctgttgtttgcctgatttcatcagcaattttttcgacttctgctgtggtttccctccagaaataatgctcgctcagaaattgataagggagtccaggtattcccagcgtgacataatgcaaaatgaaggcgtaggtcagtaatgacacggtgatcattggctgccaggcagcgctcagccatcccgagatattcttgaatatattcttttgtccgatcatccaggccatggtgggtatcaacgctaaccagagtggaccagtccagtggaagcgcaaagaaccgaaggtactggctatcagaaagaccattagtggaaccccagtgaatacgccaatgaaaagagatttacgggttgtctgggggtagctcagaaaaactgaacgcaatgcaagtaccgctgcggccagtccaactggcgtaagcataattgcaatttgaagtattaacttaggcgttgcaaattcgtggtgtgttttgccaactctattggtctgaaacaggaaggaagcccagtcattttccatattccagatgatcacggggctgaacaatatcagcgcaattaatacagctacatagggatgtgggcgcaagagccagcggcgcgcaactggatccaggatagcgaaaaccagtgcagcgatgccaagcagtccaagtgtgtatttggacagaatcccaagaccgaaagcaatacctaccccgagccatgctcgattctgatttgcgagcaaggctcgctccatgtagtaaagtgtggctgcccaagcagcaaccagtggtgcatctggtgtcattgccagtcctgctgcaaagccaaaaggtacgatggcaagcagcaatactgagcgcatagcggtagatttatcgtagaggttgcgtgcaagggcgtataaataagccattgcgatcaatccgcacaagaaggcgccgattcttactccaaattcattctggccagccagcgcggttcccagccagatcaaccaggccaccatcggcggatgatcaaaaaagctcaaatccatatgttgtgcgtattgccagtaataagcttcatcggggattagctgcgccacactcatgtaaaccaggcgcaacaggatgacgaaacagacaatacctacggcagcaatgcgccatcgcgtatcggtagaaacagcgggcttggttcgtgggaatacgtaaaaagcagatccaaggtaatttacaatagctgtcgcgataatcgcagggaaaatagcccattcagttgatatgttccaggtatagaccagccaggccagaacggctcctctcaggagcattgcaaatattccaacgatcagaaagcgagagaactggctccaatgtaaatgtcctgaatgctgcagccggaatgaccatttggtattcaaagcatagttgaagctggctgctgcgatgaaactggaaatatgtgcggttgccagactgataccctgcccggtcatccattgaaaaatcaatacatcgacaaagacacctaaaaatccaaccatggcaaagcggcttgctgtgtagaaagagacggtgccaccagccagtgtaatgagttgctgcagataagtaagatgatgtgaaagggagagcttggagcttccgtgcagtcgattgtgaaagtggatcgggatttcttttacacgcagctgttcacgccctgtcatcagcagttccagtaggattttatagccgcgagcattttctgtaatatttttgatcagctcctttcggaaagcaaagaagcccgaagttgcgtcatttacatcacaaatagtgcgtgcaagccagccccctgcccgggacagccagagacgatagaaaggccagccgatagtatcgccaccagctatgtaacgactgccgatcgttatgtcgtgagtgccatccagaatcggctggatcagtgaggccaatcgttctggcggatggctcaaatcagcatccatgactgcaatgacttcatacttggcggctgctgttccgtcgagaatagaagcagttagatcgggccgtgcatgcctttcaatcaaatgtacgttatgagtgttttgccattttctgactttgtcaggagtgccatccgtggaactgtcatccacgataatgacttcaaactgatctcccaagttatcatgagagaaaatactcgttagtaggaggtcgatatttccagcttcgttcagggtaggaataatgagtgaaaattgcatgttaagctcaagttattcccggggcctgttgacatgggtttagagttggcttcccgggggtgacaacgtattagagaaagatcatcttgattcaggatcaggatattctatggacgatttttctggtatttcagaacagcacggttatgttcttcaagcgtagatgagaagtgcgaagttccgtcacctttggcaacaaagtagagcttatcagtaatagcagggttaaaagctgcccggatggaagccagtcccggcatggcaatgggggtggggggcaggccgggccgggtataggtattgtatgcatgatcggtctgcagatcgatcttgcgcagattcccaccgaacttatctcccatgccataaattactgttggatcagtctggagtttcatgttgtggcgtaaacgattgacaaacacacctgcaatccaggcgcgctcattgtctcttcccgtttctttctctatgatcgaagcaagaatcaggccttcatactggttcttcaacgggagtgatttttgtcttgaaatccattctgtttcaaggtgtcgctgcatggcatggtaggcacgtttcagaattgtcagatcgctgctgtttttggtaaaaaaataagtatccggaaaaaaaatgccctcgactcctggttcttttgccccgattagctccagtagttttaaattgctgaattcgcttgatacatgatggatagccgggtgttcatccagtacttttctaaattgcgagaaagtccatccctcaagaaaagtaatcgtatgttgcttgactcttccctgagtcaggtattccagcagatccagtggtgacaaattttgggtaagctcatattcacccgctttgagcgatgcgttatatcctgtcatgtgtgcaagaagtatgaaagaccatgcattagggagaatatccgcattggttaattgttgagcgatattacgcagactacctcggggttcaattgaaaactcgcagggtatgactggaagttctactggtgttgtgaccaggcggtagaaccatatggaaaatagcgtgctgacaaccagaatgactaaaagaacgaaactcagaagtcgtagtgaacgtgtcgattcaggcatgtcagtacactcaggtattcggttaactgatcatgccagatatttccccggaaagcataatcagttattctcatatgtatttcgattattcccaaataccacatcccagaaacacgggaaatgatattcaggtttttcgaaagactaatgtaccgttagttccaccaaatccgaatgagtttgacagcgcggtgtcaattttcatttctctggcagtgttgggtacataatccagatcacattcaggatcaggctcatcaagattaatggtgggtggagcaatctgatggaaaatggccagagtagagaaaattgcttccacacctcctgccgcacccagcaaatgcccggtcatcgatttggtggaactgattgccaggcttccggcgtgtgctccaaagcaacgtttgactgcaactgtttctgcaatgtcgcccaaaggcgttgatgttccgtgtgcattgatatagtggatatcttccagattcaactgcgcgtcagataatgcgttcttcatgcagcgagcggcaccttcaccatcttcacagggggctgtcatatgataagcatccgcactcatgccgaatccggccagctccgcataaatctttgcgccacgttttttggcgtgttccatctcttccagaaccaggatgcctgcaccttctcccaagacaaatccgtctcttttgagatcccatggccggcttgctgtcgccggatcgtcattgtttgatgacagggcgcgggcggaggcaaatcccccaacagccagcggagttatgcatgattctgcaccaccacagatcataatatccgcgtcaccgtgctcaatcattctggcagagctgccaatgcagtgtgtagcggtggtgcaggcagtaacaatggcaagattgggccctttatacccaaacatgatggataaattaccggccaccatgttgataatggtgctggggataaagaagggagagatttttcgggggccacccgcatgataggctgcgttggtattttcaatcatgggcaggccaccgattccggagccgatattaacaccgatacgctcagcatcgaatcgagttacatcactgattccggcatccttgacagcttgaatagccgctgccatcccgtactggataaaaatatccatacggcgtgcttccttggcagagagatactctgttatctcgaattctttgacctccccagcaatttttgaggaaaaatctgatgtatcaaaatgtgtgatttgtgtaataccggatttcccggcaattacgtttccccatgcttcgggaaccgtattgccgataggtgagacaatgcctaacccggtaatggctattttacgcttggacaaaacgactccgctgaatcattgaaaaaaattattcttactgagttgtattagcagctacgaaatcaatagcctcttgaactgtattgattttttcggcttgttcatcaggaatttcgcattcaaattcttcttccagtgccatgacgagttcaactgtatcaagtgaatccgctcccagatcgttgacgaaagaggattcgttcttaacttctgactcgttaacacctagctgctcggctacaattttcttgatacgctgttctatttcagtaatttccattgaatacccatccttatcaggtaaaaaactctcgcaagtttaacaaatttcaaacaaccggcaaaatctacccggtcatataggccagatgccatttactgctacaaaaaaataatgaatgttccataatcttgaaagggtttgctaaaaatatcagaaatcaggtcattccatatacattccaccgtttacatgtagtgtggctccagtaatatagtctgcagctggggaggctaggaaaacaacagccgcagcaacatcttccggacgacccaatctcccaagagggatatgctggatgagtgattgctgcagatctgatgagagcgaacgggtcatgtcggtatctataaaccccggggctacacagtttacggtaatgtttctgctaccaatttcttttgcaagcgatttgctgaagcccatcattccagccttggccgctgcataattggtctgcccgggattcccggtagtaccgactactgacgagatattaataatgcggccactgcgtgctttcatcatggcgcgcaggacagcgcggcttaaacaaaacacggattttaagttggtctgcaagacactatcccattcgtcatccttcatgcgggcaagcaggttgtcacgcgtaataccggcgttgttgaccagtattgcaacatcacccaacgatttttgtatggtttcaataccattattaatatgctcgatattgctaacatccataaccagacccatacctgatacatgagcctcacccagatactgattgatatggtcagctccgctctcggaagttgcagtgccaataacagttgcaccgtactttcccagctccagagcgatagctttaccgatgccgcgactcgctcctgttaccagtgtaattttatgttccagtatcattccgagagtttatgaattgatggaagggttatttctaatgatgtattactgacgtactatttcaacgttcctaccgttttgagaaaggagttggaatcagttagtgcaatattctccagattcttatcaatgcgtcgcgtcagtccggataacactttgcctggaccacactccacaacatgtcttacacccagtcccgcaagggcttgaattgtctctgtccagcgaaccggattatcgagctggtgcgcaagtatctcacgaatagaagctatttctgggtgctgctggacatcgacgttgtgcaaaacaggaatccggggaggttggaatgtgattttttccagcagaagtgcaaatttctcggctgctggttgcatgagtgagcagtgtgaaggaatactcattggcagtataaccgccagttttgctccttttgattttgcgagtgttactgcttgtgcaattgcctgagaatggccagcgatgacgacctggcctggggcattgaagttcgctggttccagtgatgtatctggcagcatatttattacttcagcgcatactgaagaaatggtgtcattatccagcccgacaatggctgccatgcctcctgttccttcgggaacagtttcttgcatgacttctgcgcgatgacgaaccaatttcagggcatcacccaaactaagcgattcggcagctaccagcgcagcatattcgccaagactatgaccggccagataatgtggttgggtacctcctgcctgctgccatgcacggtagatggccacgtcagcggttaacatgacaggctgggtattggttgtgagattcaaagtgtctgctggtccgttactggctaacgaccacagatcctgttgcagaatatctgatgcttcattgaacgtctcacgtattgatggaagttctgaataaccatccatcataccgactgactgagatccctgcccgggaaaaataaaagcaatcttcatgttttaccagcgtaccagaactgatccccaggtgaatccacctcccacaccttccagcacaacatgctggcctgactggacacgcccgtctcgaactgcctgatccagtgccagcggtacagaagcagctgaagtattgccatgttgtgtaacagtcactactaccttctcttcaggtatacccagctttttcgctgttgaggtgataatacggatattggcctgatgagggatcagccagtcgatatcggaagattgtagatcatttgcatgcaatgcttctagtaccgcttcttccaggactttaacggcaaatttgaataccgtgctgccttccattgtgatgaagggtgtgccttgtatctttccggaatgaatagaggcaggggctgaaagaacctgactatagcttccatctgcgtgtaaatgggatgagagaattcccggtttttgatcccgggtaagaactaccgcacctgcgccatctccaaacagaacacaagtgctgcggtcgttccaatccataatccgggaatatacttcgctgccaactatcagtgcgttacgggattttccggagctgacgaacatatccgctgtagccaaggcataaataaacccactacagacggcctgaacatcaaatgcagggctaccagatatgccgagtttattttgcagaatacaagctgtgcttgggaaaatcatatccggcgttgtggttgcaacaattaccagatcaatatcacttgcctgaatacctgcagcctcgatggcatttcgactggcctccaaagcaaggtcgctggccatctggcccggcgcagcaatatgacgttgtttgatgccagtccgtgcctgtatccattcatcactggtatcaaccatggattcaagctccaggttggtcaggattttttccggcagatagcttccggtaccaattatgcgtgaatacatagccatgttcagttgctcactctactgatgccggttgtgtaatgttttgctcaatgttgtatcgcagtgtttcaatatgttcgacaatgcgtcgcaaggtgccaccgcgtatttcatctacagcacgtttgatggcgcagcgaaatgcaaagctatcggcagatccgtgactttttatgacagtaccacgcaatcccagcagactggcgccattgtactgtcgatgatcaacgcgccgcctgaaggcattgattaccggcagagctaccaaccctgctagcttgctgaataaagagcgtctgaattcctcacgcaggtagctggccagcatctgagccaatccttccgaagtcttgagcgcgacattgccaacgaaaccatcgcatactacgacgttggtcgtcccgcgataaatatcatccccctcaatgttgccgtaaaaattcaggccgctgctacggaataatcccgctgcctgtttgacgacatcattacccttgatatcttcctcaccaatatttaagagtccaatacttggattgggcttgttctcgacagatgaaaccagtgttgcacccattacaccaaactggaacaggtgttcagccgtgcagttgacattagcccccagatccagcacataggtatgtcctgaaatagtaggcagaacgactgccaatgcggggcgatctattcccgggatggttttgagtacaaagcgtgaggttgccagcaatgctcccgtatttcctgcgctgatgcatgcttgcgcctcaccgtttttgaccaggttaagcgctacacgcatggaagagtcttttttgttgcgtagagcgatagccggatgttcatccataccaacgatctcgcttgccggatacagcctgagtcgcgagtcaggcgatatgttaagcgcattcaattccttcgtgaggatctctggcctgccaaccaggataatgttggtgtcgcggtcatgacgcagatattcaacagccgacggaaccgtgacatgcgggccgtgatcaccacccatgcaatcaattgctactgttatgctcacgtgtcaaaaaggggtggatggcagatatgatgaagaaccagctggggtcatcaatcgtcgtttttagttttaattacttttttcccacggtaaaaaccgttcgggctgatgtgatgccgtaaatgtgtttctccggtagtcggttcgatcgcgagtggcgggttggttaatgcatcatgggaacgatgcatcccgcgcttggaaggagatttcttattttgttgtacagccataatttaactcccaaaaatatcaatttagtgtgttcgtttcaacgatgccaatatggtaaaaggatgctcttttgcggcggttgcatgtattccggtttcggttgacaggcagcacccggtatcctgatgacgaggagatatcggcaggccaagaatgacttcgtcctctaccagagttagaacactcagttcgttcgcagcataaatcgcatccacaaaaatatcttcgtcataacgtgacagctcatccgcacttctggccagaagcagtcctgtttccagatcaagttcatattccattttccccaggcagcgctggcaatttaaagcaacgcttccgctgactgatattttcagcataggcctgttgtgctcatcaaacagcccggagatcagatagactagctctcctgatgtatttgccagataactgtacagtcgttcaaggttaactaaagggatgcttccttgaaggaatctgttgctgcggacaaaatccagcgtattgataataagttggtcagacataaggcgcgcatgttatattttttatggaaaagtgtcaaaattaccaatcagtatactactataatattttgaaaagtcgcactatttacccccggcttgtgctgggttccagctcggtttatcggcgtgaactgcttcagcatttacaaatcccttttgaaaccgcaaatccggccattgatgagtctgccttgcctgaagagacgccggatgtgacagcactgcgcctggcaaaagaaaaggcgtatgcattggtaaagcagtttcctgatgcactcattatcacggcggatcaggttgctacgttggataaaatacaattaggcaaaccactgaatcatgaaaatgctgttcggcagctgcgcttgatgcgtggcagggaggttgtttttcatacggcgctatgtttatttaacagtcgtacagcttgtctgcaagcgcgtattgttccttgctcggtgaagtatcgtgagttaaatgatgatcagattgaaggttatctcgcgagagaacagccttaccattgtgcgggcagtgcaaaatcggaaggattgggtattgccctgatcgaacgtataaccggggaagatcccaatgcgttgatcgggttaccgttaatagcgctggtagagatgttaatgatggaaggcgtggagatactgtaaccacttgggcttttacttgagaaagccgaatggtttttctggttttctcctgttaatcctgagatgacggatactcgaatttacgtgttagtgttatattaccagctgttaaattgatgtatgccaatgtttttcaaatgaataaacctcttgctgccagattcatcgttctgacatttcttgtcagcatgctggcaaatacatttggatggtcattcaacagtaagatattcgcacacgaactggctcatctgcatcacggggagttgtttctgatgtaccccgataaacatcttgaattacatcaaacgcttgatagcaccatagattgggatgctgctacccatttgtgcctgcatgctgccggccagtttcaacctttctatttgcatccggctttgcagatagtcactgttgctaccagggaggtgatggtcgaaagtgtagttaatgctttcccggaatcggttcctgatcctttttttcgtccgccccgctttttctcctgagtcaattttttaccggtatggcggtttcggcatgccggatgattatctggatgccgtccgacgctgttgcagaaacagtcttgtattttgaatattgaggttgttttcgtgatatccggtgtgtacttacggcatgactgttcatggggaatcatcgtgattgagtatcagacagcgaaggcaatattgcgacaacttcgtacaaggcagatggtgctggtctttgcatcattctttgcgggaattatacctatcttggggcatggtatggcttatgccgatactcatccagtcatcaatatatcggctgagaaaggtgaggatctgaccttgcgtcaggcgttgcagcaggttttgcagaataatcctgaactggcagctttttccagagaagtggctgcttatgaagggacaaaattacaggccggtttgctgaaaaatcctgaattcagtgttggggcagaaagtattgattcctctaacccgaatatagaaaggtttacaactttccgtatcagtcagttgattgagcttggtggtaagcgatctgcccgggtgaatgtggcaacactggggcaggagctggccgatcaggcttatgctgccaaacggttggaagttgttgcccgtactgctaatgcttttattgatgtgctggaaaatcaggtgcatgtaagcgtgatggacgacactttgcgtctgatgcaaaaggcaatgaaaacagttgtgaaacgggtcgaagcggggaaagcgccgccaattgaagctactcgttcaaaggtggcattatccgctgcgagtattgaactggaacagggtagacgcaatttgtcagcggcgcgggcaaagttggcgcttctctggggggaggcggagccgcgctttggccgggctctgggagaactggaatcatttgttgagataccggaatttgatcagctgataaaacgtcttgaagaaaacccgatcatgctgcaaagccttaaaaatatcgcgcagcgtgaggcgatggtcgagttgcaaaaagcgaataaaattcctgatgtaacagttggtgcaggtattcagcgctatttcgggataggcaagactactgctgtgctggatatatctattcctattccaattttcgatcgtaatcagggaaatgaattggaagcccgccagcgcctgaataaagcaatggatgaacgcacgtcagtggaattgcaacttagaacagaatttgcacgtaactacgagaatctgctggctgcccggaatgagattcgggtattgcatgatgaggtgttgccgggtgcgcagaatgcctttgagattaccaatcggggttaccagctgggtaaattcagttttctggaaatgctggatactcagcgcgcttttttccagaatcgtattctttatgtgcgggcactggccaattatcagcgtctggtcaatatcatcgagcagttgattgcagcgccgcttgctgattcagttgcagattacacaaagctcaatactcaagggaaggagcgtaatcaatgaacgttagcggacgattacccattgtggcagttattctggttggcattttgctaggggcgttgcttttgatccaggataaattcaggctgccggatgctgaagagtcatctcattcttttgcagggacaactgaacatcaatcaacgattggaccgaagggtggagagctgttctcggaagatgatttaagccttgagttgactattcaggagagtggcacgtttccacaattcaggctctatccatatcgacagaaacaaccactggcaccgactgaagtaaaggtaacgattgcattgtcccgtcttggcagaccagcgcaactgtttcacttcaggccggaaagtgactatctggttagcgatcaggaagtgggagaacctcattctttcgagctggtcattgtcgttgaatatcagggcaagacctatcgctggcatcacagcgaggttgaggcgcgtgtagaaatgtccgatacggcgatgcaaagcaacggtattgaactggccacagctggtcctgccgtcattcactctaaaattacgctgccgggcgaaattattttcaatgaacatcatatcgtgcatgtcgtgccgcgcttgcccggcatggtggtgtcgattaaacgccatcacggacaaagagtgaaaaagggagaagtgcttgcgatcatggaaagtgccatgctggccgatttgcgcagtcaatatctgcttgcccgcaagcgcctggtgctggcacaaacaatttatgatcgggaagagcagttgtggcgggaaaaaatcacagcaaaacaggattaccttgtagcacaacagcaacgggaagaggccagcatagcaacccagttggcagccgagcgcttgcgagcgctgggcgtacaaccagaatccgggttgtcttgggaaaatattgcgcattataaaatccgttctcctatttccgggattgtcattgatgaagcaattgttacaggagaggtcgtcaaggaggataagactgcgtatatcgttgctgacatttccacagtctgggcggctgtcaaggtattcccccggaatctgcatcaggttcacataggtcagcaggctgtcatccgggcaaatgcttatgatttgacacgggaaggtaaggtaatttacgtgacgacactgcttgacgagcaaacacgcacagccattgcccgggtgcagctcgataatcgggatgaacaatggcgccctggcatgttcgtcaaggccgatttgcagaccgaagcagtcgaagtcccggtggcggtgtcgtgggaagcgatacagacactgaatgaccagtcggtagtgtttggtcgctacggagaatatttcgaaatgcgtccgctcaaactaggccgcagcgatagccagatggctgaggtagtcgaaggcttgtttgcaggcgaagactatgcagcgagtaacagcttcatcattaaatcagagctggggaaggctggagcagtacatgaccattgaggaaacatgggttgatcgtttgcataaccgggctatattgcctgtttcctgtcttatcttatttctggcggcaacaatcggatgagcggagatactattcatgtttgaacatattctgcatgtcgtgattcgccatcgtggattggtgttgttggccgttctggctatggccatgctgggtttgcatagctaccagcgattgccgattgatgccgtacctgacattaccaatgtgcaggtgcagatcaatacggccgcacccggctattcacccatggaagtcgagcaacgcattactttcccggtagaaaccattatggcagggttgcccgggctggattacacacgctcgttgtctcgctacgggttatcccaggtaacggtgatatttcaggatggaacggacattcattttgcccgtcaattggtcggtcagcgtatccaggaggcgaaagggcaattgccggttggtgtcgagccggtaatggggcctgtttccactggcttaggggaaatattcatgtggacggtcgaaagtattgcgggtgcgcgtaaaccggatggcgcactctatacgtccactgatctgcgtgaaattcaggactggatcatccgaccgcaattacgcatggtgaaaggggtgacagagatcaacaccatcggcggattcgtcaagcaatatcacgtcacaccctatccggaaaaactcatcgcctatggcctgaccctgcaggaaattgttactgcactggagcgcaacaacctcaatctgggggcgggttacatcgagaagcgtggcgagcagtacctggtacgtttaccggggcaggttactaatctggatgagattggcgagattacgctgggcagtaggcaaggcacgccgctgcacatcaaggatgtggccgatatcctgattggcaaggagttgcgtacaggtgctgctacccgtaatagtgaagaggtggtgctgggaactgcccatatgctgatcggagagaatagccgtaccgtagcgcatgcagttgccaataagctgatggaaattaaccgttcgctgccagctggagtggtggctgttccggtgtacgatcgaaccacgttgattgatggcacgattcataccgtggccagtaatctggttgaaggggcctttcttgtgatcgtcgtcttgttcctgtttctgggcaatatccgtgcggcgataattgccgcactcgttatcccgttgtcgatgctgtttacgtttagcggcatggcggctaatcacgtcagcgctaatctgatgagtctgggcgcactggatttcggcatcatcgtggatggcgttatcgtcatcattgagaactgtatccgctgtttttcccaggaacaagccaggttgggacggacgttaagccgggaagaacgactgaaactggttttcacagcaactcagcaggtaaggcgtgcgctgatttacggacaggtgatcatcatgatcgtctatctgccgatttttgccttgtctggcgtcgaaggtaagatgtttcatcccatggcgtttactgtggtggcagcattgctgggtgcgttgattctatcggtgacttttgtaccggcagcgatagccctgtttctgactggcaaggtgacagaaaaggaaagctggatcgttgtgtggtgtaaacgcttctatcggccgatgctcgcgacagttatgcgcaatcagggcctaaccattaccgttgctgcagtcatcatggttttatcgatattattggcaacccgcctgggcagcgaatttgtacctaacctgaatgaaggggatattgcattgcacgcgatccggattcccgggacgagcctttctactgctatcgccatgcaaagcgagttggaaaaagtaatccaatcgtttcctgaagtggagcgggtatttagcaagattggaacggcagaggttgcaacggatccgatgcctcccagtgtggctgatatttttgtcatgctaaaaccgcgatcggaatggtctggccgctaccggaccaaggatgagctgattgccgcaatggaaaaggcagtattgcaggtaccagggaacaattatgaatttacccagccggttgaaatgcgtttcaatgagttgatcgccggtgtgagagccgatgtggcgatcaaggtattcggtgacgatctggataagttgttcactgtggggaaacgtattgaagcgttggtggcaaccgtgccaggtgctgcggatgtgaaagtggaacaagtaaccggactgccggtattgtctattcaagccaatcgcacaaatatctcacgttatggtttgaatgttgcagatgtgcaagatactgtggccattgcggttggtggcaagagtgcaggcttgatttttgaaggagatcgccgctttgagctgcaggtgcggctacccgaatcattacgtacggatattgaagcattacgctacctgccgattggtctgccggttcagtttggggtgcaggaggggatgctggctggccagatgccatcagctggatcggctgcctttgtgacgctgggcgaggtggccgattttgaaattgcgcaggggccgaaccagattagccgtgagaacgggaagcggcgggtggtggtatctgccaatgtgcgcgggcgtgatcttggttccttcgtcaaggaagcacagatgttggtgaatgaagaaatacagattcccccagggtattggctggcgtggggggggcagtttgaacaaatgatttcagctgcggaacgtctgcaaattgtggtgccggtcgcgctaacgctgatttttgttgtgctctacattgtgttcggtaattttcgggatggcatgctggtatttaccggcgtgccattcgcactgacaggtggaatactggctttatggttgcgtgatattccgctgtctatttctgctggtatcgggtttatcgccctgtcaggaattgcagtgatgaacgggctggtcatgctgacatttatccgggaattgcgtcagaatgggcatgcgctgatggatgctgtccaaactggtgcactgacacggctgcggccagtattgatgactgcgctcaccgatgcggttggcttcattcccatggcgctagcaaccggtctgggtgcagaagtgcagcgtccattggctacagtggtgatcggtggcatcctttcctcgactatcctgacattactggtgttaccagtgctgtaccatatgctttacaaacactgggaaacggatcatcagctaaaaacagaaatgctgctggctgcaaaagccggatgaggttatttccgacggatctattgttgagacaagttgccattttttgaaacatctgggtgtcgagtttttttacatctcgatgagccaggaattttttagataggtaaataaatttatctttttgttttttatgatataaaaaatactgtttggatatggcatgaaatatgcttgtttatagaattaaagacatattaagaacctattttttgccggctattgttatactggcaactgatttttcctgaaactttgcatgagaggtgactgaacatgtcggaaaaaaatataccggaacaattgaagcaggatgcagttggtgaacagacgacggctgttcttcctccccagccggctcgcagacgattactcaaaagtaccgttgccattccagtcatcatgaccttacatagtggggcggcactggcacggacgagtaatctggtaggcgcggttacagatctggattcggcggcgaagaagatgaatgatctggaacaagcacgaatcgtgtgcgtcaatcccggagatggtcctattgaagaaagtagctccacttatgatttaggcatgaatccgacagcagccttgggtgatgcatcgcaagatttggcaacacaggcagagaattgccaaacgggcggaggcattctgatttcagtgactgcgtttcaatctcttcaaggcagaggttttttcagcgatctataataattggcagtagtggtaaattgaatgaatagctggtattcatctcatgtttcgtcactgtacatagaaaactgggatggtgaatttaccgtgttccagcctgaatccgggaaaacccattttttgaatgaaatggggttgcacattctgacgatgcttgatggctctcccctcggactcaatacaatttgtcaggagttatcagtacatttttcattacagcctgatactcaatttttcgggaaaattgcccagaccttacagcgttatgaggtgttaggactgatcgagagggtaaaagaaaacgagtgaaggtcgaacagctttcactggatgaattgcgtgtattgctcgctggccaaggtctgcgggtaaagatgggtccgttcaatctatctgttcaagcccggttaccatcacttattcatcagcttcaccagatgtatgctcactattcactagtggatgaggaagagattgttgaatttcatgtccgagtcattcccaagcgctcgatcagacagccatttgcgcgattgatccgattcgaagttgatggccgctccccgtttccgcctgttcccgtagagcaggcactggcgaccctggaatggggagtgaatcttgtcattgccatgcgcatcaatcatctgttgctgtttcattctgccgcagtggaacgtaacggccatgtactgctgctgccggcctggccgggcagcggcaagacaactttgagcgctatgctcatgcaccgtggttatcgtctgttttctgatgaattcggactgatggctcctgaaatcggtgatttttttccacttccccggctgatgccgctcaaaaatcaatctattaaagtcattcgtgattatctgccagaagccgtactggggccagaaatacctggcacattgaagggcacggttgcgcatatacgtccaccgcaagaaagtattgagcgggtagatgaggctgcccaaccccgctggattgttttcccgaaatgggtagctggtgctgctttgcggctggagtctttgccacaatccgaggcgtttctgttgcttgcaacaaacgcatttaactacgaagtgctgggggaagctgcatttgatgcggtaacgcgactggttcggggctgcgagtgtcgcaaactagtgtattccgattttgacagtgcattggctgcattggatgaactgaccgatggctgagtttaaggttgataccaggctggatcatcaccagttactgctggaagcgattatccggcctgctgtcctgatcgattacagtaattcgcaatgggagttgctgttgcgagtggcaaggcgcgcaaagttgcttggttaccttgctgcctggctggaaaaagatggattgctggataaaattccgcagcgagctgtcaatctgttgcgctccagtttgattcaggtaaaaaaacagcagcaatcggtaaattgggagttgagtcggatattatgggcgctcgatggccgagagatcctgatcatcgtacttaaaggcatggcgtatcagctacaagacttgccgaatgctgccgggcgcatctttgctgatctggatttactggtttcgaaggaagctcttggtcagattgaatccgtgctatcggaaaaaggctggcagcaccacgcgctcaccaattatgacgagcgctattaccgtgaatggagccacgaaattcctgcgttggtgcatcctgagcgcggggttgaggtagatgtgcatcacacgctttcctcaccgctgggcaatctgaaaattgatccgctaccgttccaggaagcagcgatcaaagtggaggatgaaggtgtttatgtgctgagtccggaagacatgctgttacactgcgcagtcaatctgtttcagaacaatgaattggccgatgatctacgtcatttgctggattttcatgaaattttgcaatttttcagccagcaacagttgtctttccaggagaagctgatcaatcgcgccaaccggcttgggctgggtagaccgcttttttacagcctctattttagtcgtttattactgcactcatcggttccggatcaactgaaaaaacggttaaatcatcaacctggctggctggcattacgcatcatgcataattgcgtgccgctggcgttgctgccgcaacatcctgatcagccatcaaaacgggcggaactcgcgcgtttgttgctctacttgcgcagccactggctgcgcatgccgttgtatcgcctgttgccacatctgatctacaagttttatttgtcagtatttcctggtaagagcgctcgtgccaggcggaacgggtgattctggaaaattacagcaaaaaaagtgttgccagccccagaaaaatgaaaaatcctccactatcagtgacggcagtaatcatgacactggagccaagtgctggatcacgccccagttttttgcgtgtcagcgggatgagtaccccgacaaatgcagcgagaaggaggtttaacagcatggcaagcgacattaccaggccgagctgtatattctgatagatggcataagtaaatacccctacgagccctccccagacgataccattaacgatactgacactgatttccttggtgatcagtttgagggtgctgccttgactgacctgccccagtgcaagggcgcgcacgatcatggtgatcgtttgattgccggagttaccgccaacaccggctacgataggcatcagggcagccagtgcaaccagtttttcaattgaattttcaaaaagtccgatcacgcgggaagcaaagaatgctgtaaccagattgatcgctagccaggcccaccggttgcggacacttttccagacgggagcgaataaatcttcttcttcgcttaacccgacctgattgcgtgcttcaagatcagccttttcacgcatgaaatcaatgaccgcattaacagttactctgcctagcagctttccttccggggaaacaactgcagctgttatcagatcgtaacgttcaaatgcatctgttgcctgttcagccttatcatctggaaggaatttgactgttttaggcgtcatgacttcagttacggtggtgtttggatcgctaaccagcaatcggttcaacaacagagttccttgcaggtgttcgttacgatcaactacaaacagctgatcggtgtgatccggcaattcaccaagtcggcgtaaatagcgaagaacaacctcgatacgcacatttccacgtacgataatgacatcaaaatccatcagcgcgcccactgcatcttcagagaaggacatggctgcacgcagttgctcacgttcttccatgggcaatgcccggaaaacatcttccatgacgtcgctgggcaaatccggtgccagatcggcaatttcgtctgcatccagctgctctgccgcggcaaccagctcctcgctgtccatatcctcgatcagcgtctggcgaacggcatcggagacttcgagcagtacctcaccatcatgctcagccttgacaaatctccagacgatcaagcgatcttcgagtgggatcatctccagaatacgggcaatatctgccggatgaagtttatccagcgctccacgtagattggcgagattctgtttttgtatgattgattcaatcaattctggctctggggtatcctgcagacgaacgaaaccttctaccagtttgtatctttgcagtagagagataattttctgcagtttgctttccaggttttcgtcctgattttcgtgatgttcttcagtcatggctgaaccggtaatcgtgtttgttggctggaagccgttataagaatcaatgaagtgcgcgtatcagctgcatgattatttgatatcagaaatatcagttgagaaatgggcaaggaaaaatgactccgtgaagtttctcgggatgtccggaatgctatcggcagtaaagataaacaatccctgtttctgccttcattattggttgcagtcaggtaccagtggcaaaaataccgggttttctcgcgaacgcaataattattgcagcgcaaaacacatcagctgcgaggtacagagaagacagggaagctgacattgtttgggctcgatagcacgcccgtaactgctttttattttagcatggaatttttacgggacagttacacaacaggcagtgtggtttgttactgctgtgtttttttcttgattgctatggccctgttcccatttcacattggtaaccacaggaaggtacaaaccatagccacgaggctttcgtggttttgtttgaatttatcaaagcacaggaccaccgcccggcactgtttcaaccgtgtgaaaatattttttaccaggtgtcggtaccggtatagtcctcgctccggatctgcattatctgttttggagttaccccttccctggaatgactgccttggcaccttgttgttcgctttgatcgtgaatggcctaactgtcatagtcctttgtctgcgataatggattgagccgcgcccagcatgaatcaaagccaatgcgtgtgtgcaatcattgatctgactaccggtaatatcgaatgcgatgggggaagtccgtgggtatctaccgccatgtgaattttgcaccgccccggcttttcccgattgccttatccttaccgctcgcactgtgctggtgagccttgatagctaccatcgataaaaacccgctccatgtccggctcaaccaccagagcctgaaataccttgagccattttccgctggcagatcaggcggtgaatcgtttataaaccttgctccagctcccgaatgaaccggtaccatgcggtacagtatgccttcgacagtcatacagcaaatcttgcttgttgtagaggtggttgtgaagcaaaatggccagtagcttcggccagagctcagcattaagcaataatcggagcattgcaagctcgtattgctggtgagagctacaacgatacgaacttgcttctttaaatcaatattgagatcaaataggaacagaccctaggtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacacctagagctctggcgaggataaaattatcatcagtattcacaagaagagactactcatttagcaagtgagaggaagcgaatatctacacaattaccggaaaacggaatgcggtattgaaaaagtaaattaatcacaatcgatccattacctatcaaggagaaatgcatgctcgtgacattcaaaaccgatagctatgctgatatcaccatgtttggagaagacgcgctaaccatgttgaaaatgatggggcacagtgaaaccgtaccgggcgctattctggcagcagatgttcctcaagcactgcatcggttaacaactgctttaaatatacaaaaagaaatctcgccaccagtcgagaataaggatgaagatacaaatgagccggtggtaagcatgattaatcgaggactgcctctaattgagttactgactgccgcagcaaaggcaggttgtaacgtaatgtgggaatgaatcgataccaggaaaaattaggcctggtgggaagctctatctggaaaaaccatactgctagggagctgcataccagaggactgcaaagtagtggcagacagtacccaccattacaaacaaatgccagatgaagtgaccgtatcgaaaacgtgagtcggtcgcaaaaaagaatacgccgatcgtataagtcacccctcctgcaatcaaccatagtaagccggatacaggtatgcgggtgtacaacgggtaaattgcgatgagaatgagccaccccataagcagataaagactggtggtgataatggggttgtgcatcttatcgaatgctttcaatgttactccgattgcggcgagcccccagacgatcccaaagagtgtccatccccatggaccacgaagcacacccagcgtgaacggcgtgtaggtaccagcgatgaggagatagatcgcagaatgttcgataatcttaaatacacgcttagccttgccttgcggcaaagcatgatagagggtagaagcgagatacagcaggatcatcgttgctgcaaaaaaactcgcaccaatgataaagcctgtatctgcgtactgcaccgcacgcataataagaaatggggttgctatcagtgctgcgaccagtcctataccgtggctgatgctgttcgcgatctcttctcccagagattgctcacgttcgggtactgcgagcaatatgctcacgatgtttcaacctacgtagtttatataggtgaagaaaacgacttgatggacgaacgacactgcttccaggaagtactcaagcctgattttcgtcggctggaggtaggccttttggtatatttcatggatggaggttgttagacatttgcgatacccacgctaattgatgcgcatattagcgtgggacggtttttacaaggctaataacatctaacctttaaacttgtcttttaactttgcggctgcatctcggacagcactacttagcgaatcccaagcatcctctgcgctatccttaagatcctcccacgcatcctcgctggcctcagccagttcccccatcttagccttcgcagtatcaaccttttgctcaagttctcctatctgcttatcatattttatgcgggtatcagctgcagaactcttcgcttcagccctcagttctgccaatttggcctgtgccaactcaatttcggcttctatcttttgtttgtatgcttctttcgtgctcataatgtctctcctatgttaatcaattcaggatggattcttagacttcgtgataacccaggctagaaataataatactgcggatccgactatagcggtcactattgaaccgatgagccccaatagaccgaacaagagaccacctgcaatggcaccaacaatgccaataatgatattgcccatgagaccaaagccccttcctttcatcaatatcccagctaaccagcccgcgattgcaccgattgcgataaaaattattaatcctgtatagtccacgagtttctcctctggttttatcaacaactgggataatccgcttaaaatggcttagtatctgcaatactgaagatcaggaaaatgttggataattaagatgcatactgatcagtatgcatctttaacgctttccttaatttctttgccggcatcttcaagcttatcacctgcatcttcggcggcatcaagagctttctccccaggtctttgatcaagcgcatcgttaacgttatctttgagcgtatcccccgcatctttagccgcatcacccgcatcttcagcagcatcaagaactttctctccgggtctccggtcaagcgcatcgttaacattatctactactttttcagtacctgttttagtttggtcacaggcgggtaatgccagaattgttgcagtcatcataagtattaaaaggtaggtatgtttcatcattatgtctccaattttgttttagttgtattcactgggctaccccattgaatatgggactaataccccatatttgtcattttaatgacgatactaaacattgtatgtacgataccgtacataatgaaaatcattatttttcctatacccctttatcacgctagtggataaaacatcgatgagtgtgccccaatctccataattcagtggcaagttgcatcacgaggcacccatgcgaatcattcagaaaatttcctcaataaattggtgattatctcgtgtcttgccacctcaaacttccctctcaaccagacccctctcaaccagacgaatacgacttcaataattttcaaatcttgtccagaatatcgtgcccaaaatatgcttatcccatataatattttcttcgtaaacaagcatctcataacgtttatctcgtgatcacactatataatcggagactgatatgtctgtattacctactccgcaacaaaaccatctattagctgcgttgccggccgaagttcaggaccgtatatttcctcatctcgaactggtctcactgccgcttggtaaagtcttgtacgaatcaggggatactttgtgtcatgcctattttccgaccgacgccatcatatcgctgctttatgtgatggaaagtggcgcatcggcagaaatcttgatggtgggtaacgatggtctcattagtgtcgcttcatttatgggaggtgaaagcaccccgagccgggggatcgtgcaatgcgctggttacgcttaccggctactagggaagcggctcaaggatgagttcgatcgccacggtgaattattacatctgatgctgcgttatacgcaggccttaattacgcaaacggcccagacagcggtctgcaatcgtcaccattcgatagaccaacaactctgtcgcttgcttctgcttttgatggatcgtttgccagataaccagttgacgatgactcaggagttgatcgccaatatgcttggggtgcgccgtgaaggcgttaccgaagccgccggaaaactacagaaactgggagtgatcgaatacagccgcggacatatcaaggtattggatcgacccaaacttgaggaattgagctgcgaatgttatgccatcgtcaaaaaagaagccgaacgtctgttacccaacatttattttcctgcatctggctacagttcagaatgagtgctggttaaccagcacagtgatctgtcgttatttgattctcatatcattcttgacagattttacacccccaacactgcgtgcaatttcgaccgctctgttggcatgaacttgcgaactaacgaagccactcaattgaacaacacctttaaaggtttcaacattgatttcagcagattttaggataggttcattgaaaattgctgctttgacctttgtggtgatgacagtatcatcaagatactctccggttcccgattgttttgctgtcgatgcgcaacccagcaaagaaaccattaggagagttaagaagaatgtgaaaaaatggttgttaagttgcgtcatggcaaggctctcctgagtaattaataaagaaagctgaacaccctctcgattttttagattaagggggtacctgttttactaccttcttcggtacgacattcaatctgaatgtctgagaacctgtcgagcaagaagcacctcgtgctattttttctaatttaatctttatttttaaattagattatcagaaagaatgtacttaatatgtacgctagcacacaaagcttactacctctattgtagataatagccgggataacctgataaaaatggatactcactcttgttatgccggtctcgaaatggagaaagtatcttatcccggcgattaactggtttttcatgaaataaattgagctgtttttcgtaccaatccagcatggtctgaaatggtgtctttggcttcaataccgattgcggcggctgatctaatggcacaatgaccaagcctgtgattgtttatgggtttttatgcattctgcaaagaatgaatcggtaaacttcttattattagtgagggtcttctggatcttgatggcgtaaacctgtgcaaaatatcgagaaaatatttggcatcaacagcggccttactacctttgatttggttatacattaatagtcggaactgattttcttattcgagagcgttccgtatccagcgatagatgagttgtatttgccccggcgttcccgccgctttcggccatcccaatagtttttcagataccttgttgcaacgctgtgaaatctcttcactcactgcttgaagctgctatctcataagcattaacgttctgggtatggtagacaccagcgataacccgaatcccagctgtaagattgacggatagagatatcgaatatctttgattatttggcaatagtgataccgggaacgttggtatgcggtagacctgttacggtcatttggaacagcagatacagcatctgaaaagcattacggttccaccgagtatgcgattcctggttattcactgcgtagtatttgccgtgtgaccggattgacagatcagtatttggtagtgagttgtctgtcacaagaagagccatcgtggcatcaggattttcgtcacggaggatggggggagtgcgtggatccttttccacttggtattctggttcatcgtccagtgaactaccgagaaaattaatgattgcatgaaagcttcgcaaccggaaggcacctttcatgggccattctccccccgctccgccaggacgaatgtcaaatgcaacatcagtgggatcccactgctttgcttcttcattcaattgcacacgctctgtttcggatagcatttctggatcatagttggtaatgaggatcggcccctgctttttctgacgaagagtaaacagtcccttttgttgatcatgatagatggaaaactccttttccagtgtttgaaagccttcggcagataccgatgctgcaggcagggtccagttgtattctatgtttagaggttcggcatgaagctggttttgatcctggattgccgatagatgcaatactactttgcggaacatctcgtagtctgctggaaagggagatctgttgcgatatgttttttgagacaaaccctcctggatacgcacttcctgagccatcagccgtaataacagatcgacatcgaaacgttggcgaaaaagcagcatgaacttgttctgccggaaaggtgttagcagccgccaggtaaattcttcaccttcgattggaacgatgctgatcgttgggttctctgcaatactgccgccgaatatcggcatcagcgtatttccagccaatccacccggtgcaggtgtggcaccggcattgaaacgaaaatcgaaggtggctgccacatttgagatgccagtaaaatgaattggttgatggtgttgggcacgggcgatgtttgtcaacagctgtctggaaatggcatctgtgatggtgtcgtcgtaggcactgactgcatgctgcagcgtaatcggtgacagacaaccttgaagtacggggagcaagcatggaagcagcaaccatagcaggtatcggcatgtatgtttcatatcagacgaggttattcgttcagccttgttcatatttgtttctgtttttttacgggatttttgctgtcggcaggcgtgacagaatgatccgggcttttttgagcaatctgggtgattggcgatgcgaatcataaaaacgcgggttggagatgattgatgccagccaggcggattgttcaggcgcgagagatgacgcaggtattccaaaatagtggcgcgctgcggcttcaatgccgaatacaccttctccccattcaatgacattcaggtaaatttccagaatacgccgtttgctcagaaattcttccagtatcagtgtgatgagggtttcctgtaatttacgccatacggttttttcgctcgataaaaatagatttttagcaagctgctggctgatggttgagccgccagcagccagtttgcgttgtttcaggttttttttccaggctacttcaattgccttgtagtcaaatccctggtgttgcataaaacgggcatcttcagtggcgatgactgcccgtttaagatgattggaaatctgttcgtaatctacccagcgatgctgtaattttgcagccggattctgccggtgcatggtttccaggcgatcttgcatgaatgcgctggtggttgggtggtaagtacgccagtaggtgatgtgtagcagaaaccaggattgatacagtaatgcaattgccaggagcagcagtaatgggcgtaacagccaggtgctgatcaatcctggttggggtgtggttggtcgggatgttttggtcagtttcacgaggcatggaggtgcaattcatctctgagttgtcggatgacgttctgtgtttcaggacggataccgtgccaaagcagaaaggattcggcggcttgttcgaccagcataccggtgccgtcaaccagattagtaaccccttgcgtgctggcaaattccagaaatggtgtcaacttgctgctgtacagcatgtcgtagacaagcgcagtaccatggaacaaatctgcgggaatgggagggagtgcattgtgcagactggctgaagtggcattgataatgagatcgaattgttgcccgataaaatcctgataatgtccgccagtaatatttccatggttcacaaattgctgctgcaaggcgattgctttgtcaggcgtgcggttggcgatagccagcaggccaggtttttgttgcagcagcggcagaatgacaccactggcagcgccaccggcgcccatcagtagaacatgtttacccgccaaagcaaaatccaggttgatttcaatatcacgcaccaaaccgacaccatcggtattgtccccgaatatttcattcttctgtccgaatctgaaagtattaactgcatgcgcggcccgggcgcgatccgtcagccgggtagccagtgcataagcctcaaacttgaagggaacagtgatgtttaagcccttgccaccattttctcggaaagtggtgacagtgcgttcaaattcatccagtggtgccagcagggtggtatagcgcatgctgcgtccagtctgctgcgcaaaccgggtatgaataaacggtgatttgctgtgtgcgatcgggttgcctatgactgcgtaagtatccattgcgactgattttaagtatttctgagaattttgctattcacttagcagcttatccgagcgggagaatacccaggtacgggtgatatgcaggatatcggtatcccggctgatatcaggcgggaagggagaaaatccgttacgtgcggccagtcggacaatccgaatggcggcatcatccagtatctgggtgccggaagagcgatcaatcccgattgattccaggctgccatcagagcgcacacctacggtcagctgcaggctgccgtacagtttttttcttctggcttcttccgggtaattcaggttgccgatgcgctccaccttgagccgccagtcttccagatagcgggcaaagcgatattcgcgtgtacgtgcgccgataaatctgcgttttgggcgtttctgataggcctcgtggtcttttgcgatctgtgcttccaaacgagcgatctcgaggctgcgctgcagtaagtcgctatagctgtccggattgatggcggcaggttgattttgcttgggtttatcctgttccggttttgcctgcggaagaggttgtgtgacatgagctttgctttcggcaacggtcagcagttttttgattttgctttccagttgttttgttttctgagcggccacggtgagatctgtcatcggctttactccaggcagcactggcagaggggttttggcctggcgatcttccgccacattgccgccaccatccagattggtctgggcgaataccttggtatctacgggtttggtttgggatttgctgttgaccagcaccacatctatggatttggtgattttggtatgcttttgcgcaggcggattgagcgatatgccagcaacaatcgccatatgcagcagcagcgaaatcagtagtgctagggaaattttgcgatggggttgcatggggaaaccgggaactaccgtgtgctgcattgatttatcagtcttcacgcttaccaagaaagctggcatggagcgtgcgatccagcagatcgatctgcgaaatgccgatggtaacgaatgtgcctggggagagatcgggtaatgaaggcacccgggctatcagtggcaagcgatccagtttaaccagattttcctttacaacaaccgcaccggttgtattgatgttttcctgcaataaccagcgaaggcaccagtagcgttccattccacgctgaaattccgcgtaggttgcataggccatttcaaaatcccgcatggcgatcagcagcgcatcatcttcccgggtataggcgggtggattacccgataccaatgcaatcaactgacgctgattgataagatccacataacgtcgcataggggagctgctccaggtgtattgtgatacccccagtccctgatgcggcgcgggagaaaggctcatcttcaccttgccatttccctggctacgataaatcccggcgaagccggcatctgcgagttgcttgccccattcggcgttggcaaaaatcatcagttctgatacgactttatcgatgggtgcgccccggcgccgttcggaaatagaaacacgatcttgttcaatagtaaaactgtaatccactttctcactattgatatcttgatccttaccacgcaatttctccattttgttggaaaaatcccagagcactcttaactcatgagcgaaaggataatttgcctgattttcacgcaaggtaatttcgttaaactgttgttccagtacatcgaggcgtaagttggtagaaacttcgatggtttctatccggctgagtgtgttggtgacagtaaaatcatccgccacgtccagatataacgagagcaccggacggcggcgtgtttcgctcagtgtgaaatgctgaattacgctttccggaagcatggtgattttgcggccaggcagataaaccgttgacaggcgttttgctgcaaatttatcaagaagcgaatccggtgcaacacccagtgcgggcgtagcaatatgtattccaatgcggaaactgccaaatgttagcggcgttacagaaaaggcgtcatcgatttctgttgtggcagcatcatcaatactgaacgctgtgactgcagccagcggaaaatcttccggatccgcgcggtggaaatcaggcaggagggaatccgtgccggttccttccgggaagtgttcgtataaaaactggttgaaatggtaatcatgcgttgaaggaatggcgccgcattgctccagcaatctggggacactcagcctggtggctgcacaggctgcttccagcgctttccattcaagtgtgtttttatccggcttgtacaatagatcatccagcaatggcctgaatgtatcaggtaactcgaatgccaccagttgctgtacataatcagcctgtttttcctcggccaatcgttttttttcgcggctggccagtgcggctcgcaaaatttccgggggggcggccttgtagcggccggttccttttttatggaaatagattggattctggctcagcaagattgtgatagcagcgatttcaacagagttgggcgtatggccaaaataatcgttcgccagttcctgcccggtgaattcattgttttcttcgcaacattcccataaaaaattcacatcaatctcagcagccatttcctgtgcctgctgcatgaattcgtgcatgggtggattttcaaagcgcagcaaaatcgctccagccttgattttggagcgttttccatggacggattcaatttgcagcgaggtggtgttgtcagccaggatattgccgactttgagagcccctgcttcctcgtaaaaaacgtttaccaaatcaatcctcagctcaacccagaaagcgtgcgaaaaaaaacattttttaatgttatccgattcaacgggtgacgaataatgaaacaaataagcggattacgcctgcaggattgatggtcgaaatcagcagataccaagataatcgaaccatccagagagacagggaaatgcgccgttcatggtaacataatggcatcattatcaaaaaaacaaaggctgtgagaaagagtattttgtgaccagttttcttgtgtttcagctcaaaaaatatttcctccagaggaatcagcaaggatttcctgatatggaaacaaccgtgtaaacggttgtgtatacaacttctaatatttagtcagatggtaaaaacacgttttgctcccagtccaaccggttacctgcatattggcggtgcacgcactgcgcttttttcctgggcgtttgcccggaaacaaggtggaaaatttattctgagaatcgaggatactgatcttgaacgttctacccagcaatctgtgcaggcgattctcgatgggatggcctggctggggcttgattatgatgaggggccgtattaccagatgcagcggttgagtcgctaccaggaagttgcggagctattgctcaagcagggacttgcttatcgttgttatgccagtaaggaagagctggatgcgctgcgtgaacagcagcgtttggccgggttgaagccgcgttatgatggccgctggcgcgatagcaagcagactccgccagctggtgtcacgccggtagtgcgctttaaaacgccacgtgaagggtatgcggtatttgatgatctggttaaggggcggatcgcggtagccaatcatgagctggatgatctggtattaatgcgaagtgacggcacgcctacctacaattttggagtggtgctggatgatcttgatatgggtgttacacacgttatccgtggggatgatcatgtcaacaatactcctcgtcaaatcaatatcctcaaggcactgggggcgatcattccacaatacgcacatgtaccgatgattcttggcgcagatggtgagcgtttatctaaacggcatggcgcggtatccgtgatgcattaccgggatcagggatacctgccggaagccttgatcaactatctggcacgactcgggtggtcacacggagatgaggaaattttcagccaggaacaattagttgaatggtttgatctggcggcaatcaatcgttcgccggcgaaatttaatccggaaaaattgacctggctgaaccagcattatctgaaaattgctgaggatgcccggttgatggaactggttacacccattctgctgggaagaaaatacagcctgccgggagaggaaaatatgtttagaatcatcaatctgcttaaagagcgtgtcagcacgatagaagagctggccgacgcatctgcttatttttttcaagccgtcgagcctgccgaagcgctcagaacgcagtatttcaccgttgaaattcgtccggttctggaatacctgattgatcgtctggcgcagattgaatggaagcgagaagcgattcaccaagaaattaaacagaccgtttcctcacataagctgaagtttcccaacttggcgatgccgctgcgtgtcatggtcacgggtgaagcacaaactccggcgattgacgcagtgctggagctgattggtaaagaagaaactctgcaccgtttgcgtgaccagctggatgcgtttccgcagtaagcatacagctgccgtatttattttgactaaaaattcccgtttgaagagctgttatgacaatgtctgatcgtgctgatttgctgaaacaattacttgccgaacgtatcctgatactggatggtgccatgggtacgatgatccagagttataagctgagtgagtcggactaccggggtgagcgttttgctgattttccgcacgacctcaaaggcaataatgatctgctttgcctgaccaaaccagaggtgatccgtgctattcatcgcgcttatcttgaagccggatccgatattatcgaaaccaacacattcaactcaaatgcaccgtcgatggcggattaccacatgcaggatctggtgtatgagctgaatgtggcaggtgcacgtctggcgtgtgaggaagcacgcgccatggaagcaaaacagcctgataaaccccgctttgttgccggcgtaatcgggcctactaccaaaacagcttcgctttcaccggatgtcaatgatcccggttttcgtgccattacatttgatgatctggttgagagttacaccgaatcggtgagcgggttggttgacggcggggccgatatcctgctggtcgaaaccatcttcgataccctgaacgctaaggctgcactgtttgccattgaacagtattttgagacacacggattgcgtctgccggtaatgatatcggtcacaattaccgatgcgtcgggacgtaatctttccggacagactccggaagctttctggaattcggtgcgacatgcgcgcccgctgtcggtgggaatcaactgcgcactgggagcagagctgatgcgcccttatgtgcaagagttgtcaaatgtctccgaggtttataccagcgcccatcccaatgctggtctgcccaatccactggctgaaaccggttatgacgaaactccggaatatactgcccggttgatcaaggattttgcacaatcagggttcgtcaatattgttggcgggtgttgcggtacgactccggaacatattgccgctatcgtggaagcagtgcaggacatcccgccacgtaagctgcctgatcttcctaagaagttgaggctctctggccttgagccactcagcattgatgagagctctttgtttgtaaacgtgggagaacgcaccaatgttaccggttccaaggcattttcccgactggtgcttagtggcaattatgcggaaggactggtgattgcgcgcaaccaggtggagagcggtgcgcagatcatcgatatcaacatggatgaaggtatgctggattcgcaaaaggcgatggtgacttttctgaatctggtcgcgtccgaaccggatatcagtcgcttgccaattatggttgattccagcaggtggtcagtgattgaagccggcctgaaatgcatccaaggtaaggcaatcattaattccatcagtcttaaggaaggtgaagaggaatttctgctgcatgccaaactggcgcgccgttatggggcggcggtgattgtcatggcgtttgatgaaagtggccaggcagataccttgcagcgcaaggtggatatttgtacacgtagctaccataccctgattgaacgggctgattttccacccgaggatatcattttcgatccgaatatttttgccattgccacgggtatcgaggaacacagcaactacgcagttgattttattgaagccacccgcctcattcggcaaacgctgccctacgccaagatcagcgggggtgtgtccaatgtttcgttctcgttccgtggtaacgaacccatccgcgaggcaattcatactgcgttcttgtatcatgcggtcaaggccggcatgaccatggggatcgtcaatgctggccagttaggggtttattcggatatccctcccgatctgctggagcgtgttgaagatgtgctgctcaaccggcgacccgatgcgaccgaacgtctggtggagtttgcagaaaatttcaagggccagaaaaaagagcaggctgaagatcttgcctggcgggatgaaccggtgcggcaacgcctgattcatgcactggtcagaggtatcaatacctatattgttgaggatacggagctgatccggcaggaaattgatagtcagggaggcaagccgatcgaggtgatcgaaggcccgctgatggacggtatgaatgtagtgggtgacctgtttggtgcaggcaaaatgtttttgccgcaggtagtcaagtcagcgcgggtgatgaagcaggcggttgcctatctgttgccgtacatcgaggcagaaaaaaagatttccggcgacaataaaccaaagggtaaattggttattgccactgtcaagggtgatgtgcatgacatcggcaaaaatattgtttcggtcgtgctgcagtgtaataactttgaggttgtcaatctgggtgtaatgattcccagtgcgcaaattctggaaactgcccgtcgcgaaaatgccgatatgatcggtgtgtccggtttgattacgccttcgctggaggaaatggcacatgtcgccagagaaatggagcgcgaacagttcacaattcccttgctgatagggggtgccaccacttcgcgtgtacatacagcagtcaagatagcaccccattacagcggggtgaccatatgggtacccgatgccagccgggcggtcggtgtatgcagcaatctgatgtcacaggatatgcgcgatggctatatccagcaggtcaaagccgagcaggaaaagaaccgggagcagcacaaaaacaagaaagggccttccaaactgctgacctttgaagaagcccgggccaatgcattcaaaaccgactggaaccgttatacgccacctgctccgagttttctcggattacgcactcttaacaactatccgctggaaacactggttccgtacattgactggacgcctttcttccaggcatgggagttgcatgggcgctatccagcaatcctgcaggataaggtcgtcggagaggcggccagcaatttgtttcgtgatgcgcaggtgatgctcagaaagattatcgagcagaaatggcttgcggccaacgctgttatcggcctgtttccagccaatactgtcaacggggatgatatcgagatttataccgaccgcagtcgcagcaaggtaatcatgacctggcattccttgcggcaacagacgacaaaaccctcggggcatcccaatctggcactggccgattttattgcaccgcgagagaccgggataaatgacaccatcggtttgtttgctgtcagctctggcttcggtattgatgagcgcgtacgtgcttttgaagctgaaaatgatgattacagcgcgatcatattgaaagcactggctgatcgtctggctgaagcgtttgcagaacatatgcacgcacgggtacgacgggaattctggggatacatgaaagatgaaagtctcaacaatgaacagttgatcgacgagcagtatctgggaatccgcccggcaccgggctatcctgcctgccctgatcataccgagaaggggccattgtttgcggtgcttgaagcggaaaaacggagtggaattatcgtgacggaatcctttgccatggtaccgactgctgctgtgtccggtttttatatttcccaccctgaatccaagtattttgcggttggcaaaatcggcaaggaccaggttgaagattacgcaaggcgtaaaggctggacgctggagaaagcagaacgatggttggcgcctgctctggcgtatgagcgctgattactgcctgtagcaacatatttttacccttccaggattatttcagaaatggcgtgtaatctttccctaaatctgtgaaattttgcgatgattatcggcgtaatgtagggatgtggtggccgatttttttgtgcgtttgtctggaatattatttactgaggggaatggaaaatgaaatacagcagtatcgaggaattcaagaattatgtttctgaaaggaatccggggcaaccggaattcctgcaggctgtttcagaagtcattgaaagtttgtggccttttatcgttgatcattcccgttacgctgagcaggggttgctggaccggctgattgaaccggaacgcatgattgtatttcgtgtggcgtgggtggatgatcgtagcgaagtcagggttaaccgaggataccgcattcaatataactccgcgatcgggccatacaagggagggacgcggttccacccctccgtcaatctttccattctcaagtttcttgcttttgagcaaacctttaaaaacgcattgacaactttacctatgggtggaggtaaaggtggatcagattttgatcccaagggtaaaagtcccggggaagtcatgcgcttctgtcaggcgtatgcgactgagttgttccggcatgtcggggtggatacagatgtacccgccggggatattggcgtgggtggcagggaagtcggttatatggctggcatggtgaagaaactgactaaccggtcggattgcgtgtttaccggcaaaggattgagttttggcgggtcattgctgcggccggaggcgaccgggtatgggctggtctattttgccgaagagatgctgaatcatgttggccgatcgttgaaggacatgcgtgtatctgtgtccggctcgggaaatgtggcacagtttgccattgacaaagccatgtcactgggagccagagtgatcaccgtttccgattcgagtggaacagtggtggatgaagccggatttacaccagagaaattggcgattctggctgaagtcaagaatcattcttacggacgtgtaaacgagtatgctgaaaaggtaggcgcacaattcctttcatgtgaaaaaccatggaatgtaccggtggatgtcgctttgccttgtgcgacgcagaacgagttgaatgataatgatgccgcaatactgaccaagaatggggtgagttgtgtggctgagggtgccaatatgccttgtactgcgggggcaatcgaacggttccagtatgcaaaaatactgtttgcgcctggtaaggcgagcaatgccggaggggtagctacctcaggcttggagatgagccaacaggccatgcggctttcctggacaagtggcgaggtggatatgcgcttgcatgaaattatgcgtgctattcaccgttcctgtatcgggtacggccagaaaaataatggcatagtcaattatgtggatggcgcgaatatagccggttttgtgaaagtagcggaagcaatgctggcacaaggcgttatttgatcacgaaaagcgctatacatctttgtgaattgatggctctggcagcaatagatgaacgatgctccctcttattgcgacatgaatgtgttgtttcccctgtaggctgggttggttgtaatcagtttgtaaatagatcgactgattgcactatcggattcaatcttgatcatggttttgaatggatgggtaggtcatgagtaaagtatttgccgggttattgctggtgttctgggcgcagctgcttgttgcaggaggagatgaggattatctgaaaataagagaagcattccggatgggtaatgcggcacgggttgccgaatatgccgagcgtatgaagcaccatgtgttatcaccttatgccgaatattttcagctgcgactgtcgctgacaacagcggatacgggcacaatcagggcttttcttgctcggtacgacaacagtttcgtggcagacagattgcggggagactggctgcagattctcggcaagcgtcagcagtggacgacgttttccgaggaatacccaaagctggtcaaccgggaagacagtttgcaatgctatgcattgcaacaccggctcgcggcgggagataaaacagcgggtacagaagttcgctcactctggtttaccgggcgcgatatgccagccagttgtgtggctgtattcgattcattgattagaaccggcgctatctcggcggaggatgtctggacccggatcaggctagcttttgaagccggcaataccggcgtggccaaaagtataaacaaatacctgccgcgtcagcaggcacttgatttacagaaactgggtgctgctgccaaagatgccagacgtttccttgatcgacaggcaacgtttaaatcccgtgcggaccgggaagtcgtactgttcgcattgttgcgcctgctgcgcagtgagaccaatcaggcatttgcccgctggcataaaatgcgcggacagttttctgaagtagatcaatcttacttcatgggaaatcttgcctactgggctgcgatcagacaggatgcgcgcgccatgaactggttcatggaagccactcggggcaagcatgcctatccactgtctgaatccaaacatgcatggaaagcacgggtagcactacgtgaaggaaactggaaattcttgctggacagcatcagccaaatgcctgccgccatgcagcaggaagatgtctggcgttactggcgtgcgcgcgcactgaaaatcagcaaaaagaatgtagaagccaatgctttgctgattcccttgagtcatgaacacagtttctatggacagatggccagggaagagttgggtgagatgctcagcgtcccggccaccgaatatcaggtcaagcctcaggaaattcatcgtatggaacaaaatccggggatccgtcgagccctggcactgtatcggataaaccagcgagtggaggcgaatcgcgagtggatctggacagtacagcatttcagtgatgcgcagctgctggcagcagccaaagtggcccagcgctatggcatttatgaccgtgtaatcaatactgcaatcagaacggttaaccatcatgatttcaacttgcgctatctggcgccctatcgtgagcagatgcgccctgttctgcaacagcagcaactggatgaggcgtttgtatacgggctgatacgacaggagagccgctttatcgcggatatcaaatccggtgctggtgcaatcggcctgatgcaactgatgccggccacagccaagtgggtagccggtaaactgggagtgcgtgattttcataccagtctggtcaccgatatcaataccaatctccagttaggcacctattacctgaagcatgtactggatcagctggatgatcaaccactgctggctgcagctgcctataacgccggacctggccgggcaaggcaatggaaggatacgcgtcctttagagggggcgatttatgcggagactatcccgttcaatgaaacgcgcgactatgtcaaagtggtgctgagcaattcgatgtactacgctaataattttgagcaacttgaccgtccaactctgaaacaacggctcgggatcgttgcaccgaagcgctgatgtatcgagcatgaagatttatcgggtaggaggctcagtacgtgatgaactgctgggcttacctgtcaaggatcaggattatgtggtggtgggtgctacgccggaagatatgatccgccagggctatcgtccggtaggcaaggattttccggtattcctgcatcctgaaacacacgaacagtacgcgctggcgcggactgaacgaaaaatcgctcgagggtacaagggttttgcgatttacgccacgcccgaagtgacgctgcaggaagacctggcccggcgcgatttgacaattaacgccatcgcgagagatgaagccggcaatattattgatccgtttggtggaattgccgatttgcaggcaggtatcctgcgtcatattagtccggcatttgttgaagatcccgtgagagtgctgcgggttgcacggtttgctgcccgctttggtttccaggtcgcaccagaaacatttgaactgatgaaagagattgttcataccggtgagacggaggcgctggtcgcggagcgggtctggcaggaaatagcccatggcctgatggaacagcatccttcgcgtatgttccacgttttgcgggaatgtcgtgcgctcgctcgtattttgcctgaagtggatgcattattcggcgtgccgcagcccgcacatgcgcaccctgaaatcgataccggcattcacgtcatgatggttattgattatgctgcatcgcagcagtacccccttgaagtacgttttgccggattgacccacgatctggggaagggcacgacacctcctgatgaatggccgcgtcatatcggtcacgaagcgcgcggtgtggaactggtcatggatttgtgtgagcgtatccgggtgccgcgagaatccagggatctggcgctgctggtggcgcgttttcatggcgatgttcaccgggcactggaattgcgccctggtaccattgccgatatgctgcaggcaacagatgcctatcgcaaaaaagtgcgcttccaggcttttttgcaggcatgtgccagcgattttcacgggcggccaggttttgctgatcaaccctacccgcaggcggagcatttaagcaaggcactacaggccgcaaatagcgtcgatgcgggcgcgattgccatgcaactcggtcaatcacatgctggagacacggatttaccgatgcggatcaagcgtcaggtctacgctgcgcgagttgaccggattaaatctcttctttcaaatccgtaacagcgggcaggccggtatccgacaataattctgctttgccatttgagacaatgaatacccggttggccgcgttaatcactgcgggttgatgggagacaacaatgatcgtgaattcctttgatagattctgcagcgttgtgcagataatgcgttcactttccggatccagtgcactggtgggctcatccagcaataacagtttcggctgatgagccagtgctctggcaatggcgatgcgttgtcgttgtccaccggacagcatgccgccgcgttctccgacaatagtatgaatcccatcgggaagtgaattgacgaaatcccatgcaccagcctgtctgagcgcgcgttccgcatcctcgacgctgatggtggaatcacccacgagaatattgctcaagatagtatcatgcagcaataccgtatcctgggaaacatagccaatcatatgccgccagtgacgcagatcaatgttgtgcaaggatacgccatcaatcaggatttcaccggattctggttcggccagtccgcagagcagatcaagcaatgtgcttttgccagcacctgaagaaccaatgagagcggtgaacgaatgaactggtatttctatattcaaatcactgaatatggtttttcgttcatagctgaagacaatatgtcgcaggttcagaccctgttccagggtcggtatcaatgtaccagttgatctttctgcctccatacgcgcttcctcagcagcactgcgcaaggcccaataggcactttcctgtgccacaagctgctgatagcggcgctgggttttattcagtaatcccagcacccgggtcagtagaaataccatgaccatgacttcaggcagggacaatttccagataaccagtgcgaggtagaggccgcttgcggtcagagcggccagaatgggttcctgcaaggccagcagagccgcccggttggttacctctttacgcgtggctttttccagcagccgggtttgttcgcggagaataacatcggccacattatcacgcgccattgctttcagagatttcaccgaaccgagcacatcagatagataggtcagcaaatgacgcagcaaatgagtctgcttattaccggcgcgtttggttgccctgaccagccggtgcaataccataaataggatcgctccgatgatcagcgatcccaacgtcgcctcccaggaaatgaataaggccacgatgctgtataccagtgcctcaattgccagcgccagtacattgacactgtgctcaaaaccgttggcggcacgataggcttcggtggcaattgaatttgccagcgcaccggcgggctgacgcagatagtattgccagcgactggcaagcagcgccttgatcagatccagccgcagcgcggtagcaacatgggcgacggtatgaccgacttgctggttggtcagcagtagaatagcgcccttgaggaacatgccgccaacgataaccagcagaatggtttccagtgtgggctccagtccgatctcatgcagcatattaacgatcagttggcccattttggaatcaaccgattcgcctactgcaatggacaacaggggaagcaacgcagtcagactaagtgcctcggcgacgcctgccagcagcagagcaatcagtacgaatgcgctgcgcttcgggaagaccatgatgtaagtaatcagcgtgcgcatgataggatgagtgggtgtttacagatcaattgtgccttcaaatacggtaatagccggcccggtcatccagacaggcttgtcttttccgtcccagcgaatctggagattgccgccgtgcatggctacctgtactgtcgtatccagaaggccgcgcagaatgccgcagacaacggcagcacaggcgccggtaccgcaggccaatgtttcgccggttccgcgttcaaaaacacgtagccggatatgcgcgcggtcaataatctgcataaagccggcgttaactctttcaggaaaaagtgggtgggcttcaattttggggccttcagttgtgaccggtgccagatcaatatctggaatgatttgcacggcatgagggttccctatcgagacagcagagatttcaatggttttgtcgccgatttgcaatgggtaaacaggcatacgctgtgcagcctgaaaaggaatctcagccggttcaaactggggaactcccatattgacggaaacttcaccattgttttcgatcgtcggcgtgatgatgccgcgagcggtttccacgcggatcgtatttttgtcagtcagattgtagtcacgcacaaagcgggcaaagcagcgggcgccattgccgcattgttcaacttctccaccatcggcgttgaagatacgatagcgaaaatctccaccttccctggcctgttccacaatcagtagttgatcgaacccaatgccgaaatgacgatctgccagccggcgaatcgtggcaggatccaggaaagtgagggaggctggctggttgattgcattgatgacaatgaaatcatttcccagcccgtgcattttcgtaaattgtaatttcatttttagagtccttcaggtttatcagaaggtgtgtagatgttctgagttggctgatggatgtaattcaatcccgggaacaaatgtcatattttcctgcttgaccatgatggaacgcaactctactatattgagcacaaaaatatcagagcctggctgtggtaatgggggatacacttccattcccgatcgtcgttaaatgcggggatgagaaagggtgcaagggtagtattatgctacgtgtcattgctttgcattatgcaacttccggttttgtgttggtaatccgtcaaatttgtcggtatccccaatttccagatcatgttccttttgcttatctgcgtacttgtttacgctctttcggagagttttccggaaaaatccaaattcagggggcatcgaaatatgaagcatgtatcaaacatccggttgcgtgtggtttatgaacgcggattcactttgctcgaattgctggttgtcatggtgattattggcctgctggcggcttatgttggccccaagtatttttcacaggtaggtaaatctgaaatcaaaatggcccaggcgcaaatagattctctggaaaaggcgctgcatcagtatcggctggatgtcggaacatatcccagcactgagcaggggttaaacgcactgcttactgcgcccaccaacgagccgaaatggcaagggccttatttgagtaaacgtttaccagcagatccatggggcaagccttatcagtataaatatccggggacacagagtgattttgatttgttctcatttggtaaggacggtcagccaggtggtagcggtgaggatgcggatatcaccaactggtagccgtattcaatcccattgatgcgctacacagtaaaagctttactgaccggaaaaggcgctgtgctgcttgaacttgaggcggccagcgaagccgatgttcgcaatcagattagcgcccagggtggcgtggtactgagtatccggcggaatttctcaggcttgttttccaggccacgttcgcggtttccgttatctaatttctcccaggaactgcttgccttactgacagccggcctgaatctggtggaggggattgaaaccctggttgagaaagaagaagacagtgcggtgcgcgaattgctgcagcagatactggtgcgattgcatgaggggatgacactctcgcgtgcgctggaatctcatccgcaaacatttccgccgctgtacgtcgccacgattcgcgccagcgagcaaacgggagatctggcagaagcgctgacacgttatctgacttaccagtcacaaatggatctggttcgcaagaaactggtgggtgcatccatctatccggttttgttgctggtgctgggggggctggtggccatttttctgttggtgtttgtcgtgccaaaattcagtgccatctatgaagatatgagtacggatctgccctggatgtccatgctgttaatcgaatgggggcatctggtgcaaaaaaacggctggatgctggcaggcgttgtaacggttatgctggccgccgtgttttacacactttcacaaccgcaagttcgggcgcacctgttgcaagcgctatggcgtattccggcaattggcgagcggatgcgggtttaccagcttgcccgtttctataaaacgctgggcatgttgctgcgtggcgggattcccgtgacacaggcgctggaaatggtcagtgatctgttgcaaccacattttcgtccccgcgtaaaaattgccgcaacactgattcgtgaaggtagcactatttccagtgcgatgcagcgtgcagaactgactactgcagtgggcagccgcatgttgcgggtgggtgagcgtaccggcatgatgggcgacatgatggagcgtatcggcaattttcacgatgaggaaatcgggcgctgggttgagtggaccaccaaactgatcgagccgctgttgatggcagtaatcggaactgtcatcggcggtatcatcattcttatgtatctgccaatttttgagctggccgggagtatcaattgacgcagacgcaggtcgccctgctggaccaaccggtaattgatgcagcccaacttcgccaggcacgggagcaggctgtcatccatggtacgtcgctgatcaaggtgctggaagaaacctggcaaggtactccggatgaactgatagtcacactaagtagagcactgcgtgtgccgatgctctccatgagcgatttgcatgcgttatatccggcttttgacaagttgccttttgctcaggcggtcaagcatgagtgcgtgttgttgcaaaaaccggatcagtcgtatctgcttgccgtcagtgatccgttccggccgagcctgcgtgattgggtggaagaatatgtgccggtcaatgcgctgtggcatctggtacatccagcagatctggctgccttttttgcgcagcaggaacagagtatgcgcgcgatggataatgttctgacttctgcccgggaaaacctgattcaaaccggtattgaggagttgtcgctcaaaacgatacatgaaggtaccagccaggtggtgcgcctggtgcattcaacactgtacgatgcacataaatctcaggcaagcgatatccatctggaaaccacgccaggtgcgctgtccatcagataccggatcgacggcgtactcaccagcattggtacgatgcaggggacggatctggctgaacaggtgatttcccgcatcaaggtaatgtcggatctggatattgccgaacgccgcattccgcaggatggccgcttcaaggtatccatccagggcagggaaattgattttcgcgtgtcggtcatgcccagcatttttggggaagatgcggtgctgcgaattctggatcgtcaggcgctgaccgatcatattgaagggttgacactgaatcagttgggattcaatgtcactgctattgccagcatacgccgtctcagcgcagaaccatatggcatgctgctggtaaccgggccgaccggcagcggcaaaacaacttcgctctatgctgctatttctgaagttaaccacggccaggacaaaattatcactattgaagatccgatcgaataccaattgccgggtgtgctgcagatacccgttaacgaaaaaaaaggactgacgtttgcccgagggttgcgttcaattttgcggcatgaccccgacaagatcatggtgggagaaatccgcgatgctgaaaccgcgcaaatcgctattcaggccgcattgacggggcacttggtgtttaccacagtgcatgccaacaatgtatttgatgtaatcggccggtttgcgcacatgggagtggatccctacagctttgtttcggcgctgaacggtatcgtggcacagcggctggtgcgtttgttatgcccaaattgtatggtttctgagcaaccggatcatcagatgatcgaggaatcggggattcctttggaacaggcggaacagtttgatttcaactctgcaaaaggttgcgggcactgccggggcagtggttatcgcgggcgcagcgccattgctgagatcttgctgttgaacgatgaaatccgtgagctgattatcgcgcaggcacccattcgtcggatcaaggaagctgcccggctgaatggcacccattttttgcgtgaagcagcgctggatatggtgaaatccgggcaaaccagcttacaggaggctaatcgtgtcacggttgtggcgtaactgtatgcaggtttttttggcacccggccgggtcaatctggtgggttttgcccgtggcatcaagcccatgcagcgcttcaggcagtcgggtacttgtggtcaggcgaatgctgcaagccagtggcaggctcccttgcaagtgctggagcagatgatcgggcaggtggatgacagtttcagacgaggtgctgaactacacatcacgctatccaattactttgttcgttatggtgttattgcaccacagtcttcgccggcgaatccggatgaactgatggcttatgctggtttccagatgcgtgaaatctatggtgagcatgttgataactgggagctcagtcttggcatatgggatccccacggcgggacattatgcgcggccattgcccgcgatttgcaatcagaactggaagcactggcacagcgtcatgaaacgctacttgtgcacatagagccctatctcgctgcggcactggatcactggtcaaagcagttgaatgacaagcagatatggtttgttctggtggaatcggggcgtttctgcctggtttcatcgcttgatggcgtgtggtgcggtgtgcgcaatcagagagtagtagagaatttgcaggaagaactgttatcggcactggtgcaggagtcgatcatgtccagttcaggtcaactgacagagcaggtttatgtgtttgctcccgaattggccaggccacttcctgatgtacatgattctcgctggcaatttgtgcactggccggatgaaagctatcctgcgcctgcacatttcccgtggataaaaaaggtggatgacaggcagaatcatgcgtagtctaaagctaaatttcccctatcgcggacagcggctcccggtggccgattatatattgctgttgctaggcgttgcattgctgctgagtgcggtttaccagctcaagcaaaccatgtcgaagatcacttactgggaatcgcgcgaagtacgtattacccagcagcagaagcataccaggcaacccagaacgccaatggcacgtattaacaaagctacacagcaggaactcgaacaggtacatgatattttacgccagctcgattttccctgggaagcgttgtttgattcactggagctggccgccagtaaggaagttgcactgctgtcgctgcagcccagtgtatccgggcgtactgtccgtatttcaggtgaagcgagaaatcttgccggcctggtggaatatgttcaggcactggaacaggaaccggtatttaggaatgtgcatctggccagttataaaacccggcaggatgattcgcatcaccctattgttttttcaatcatggcaacgtggcacgaattattttagaaaactggctggtcaggatacgctggcatgttacctgcctgggtactattggcaagacgggagcgggattgcttgtgctgacactggtattttttatggcggccgtattgccccaacagcagaccctgaaggaattaaaaaacagggtgcaaacggtacagcaacaggagcaacctgattctgtgagacaggcagggctgagtgacagccaggccctgcaggttttttatgattttcttccgcgcagtgattcctccccatactggatcagtgaacttgacaggattgcgcgagacagtagcgtggaattgaacagcagtgattaccggctgacgatggaaaaagaatccaagctgatccgttatgagattcagttgccattgcgcggaacttacccccagattcgtgcgtttcttgcagaagcgctgcaggcgatgccaacactggcgctggcggatatcgcgattaaacgtgaaaccgtacagactggctgcgtggaggcacgcttgaatatgtacctttatctgaatgactattagggagacgctgattaaatggctgctcggatgagctgcagcactacgcggtgctcgcagcctcgcttgtctactggatgtatctcgtcaattgctgaatctggttgcgggatctgatatggccagcgcggtttatcggaaatggatgctctggggtgctctggcggctactgtactagcagcattgctggttgatgatgagagtgaacaggctgtggatgatgtagtacaggcagtacaaccggtatctggtttttcaggcgacaaacgcactgttggacaaacccgtgaaacgttgccggtcgatcaattgggaaaacgaaaatttagtgccagggcagatgatatattcgctgtgacttcctgggtgccgaaacgcactgctgtagatagcagttttaacccgcaaattcttcaatccaggcaggaagaaatcaggcgacagccgccgacaccctctgcgccaccattacagtttgaatatctgggtcgagtggttgcggaaggaaaaacccggatatttctggcccaggcagatcaaaattatgttgctggtgtgggggaaaggatcaatgcggaataccggattgatcggattcgggaggatgcagttgaactgatttatcttcccttaggtgtcaggcaaacactgcttatcaattagagctgtccataaagggtgtcatgaatagagggagaaatttttttgtgctgttgctattgtgtgtattgatcaccggttgtgcaacacaaatgacacgaaacccctccttcctggaaggaaaacagctgatcgcggaaggtcggctggaagaaggattgagcaagctagagcaagctgcgcgcgaggaaccagataacagggaagtgggcgcgactctggccagagaacgtgattccatcattggccagattttattcgaggcagatggcttccggatggcaggcaatctggagcaggcggagctggattatcaacgagtcctgggtgtcagtgtcaataatgaacgtgcccgggaaggattggaagcagttgagctggagcgccgtcatattgtgctggtgaatcaggcaaaagaagcgcttgcgcatcatgacgtggaaggtgcggaaaaaatcgtaagaggggtactggcaaataatccaatgcaatccgaagccaggcagctgatcaaggcgctcagtgaacggattgcacgggccgagacatccgaattatccctgatctccgagttcagcaagccgattaccatggagtttcgtgatacatcactgaaagccatatttgaacttatttcccgcacggctggtatcaattttgtgtttgatcgcaatgttcagcaggaagcaacggcttcgatgtttgtacgggacaattccattgaagatgtgctgaaattgttgctcctgaccaaccagctcgcttacaaggtgttaaacagtaacacgttgttgatttatccggatacgccggccaagcaaagagattatcaggagctggtagtgcgtagcttccatgtcgctaataccgatgtcaaacagatggtagctatgatccgtgggctggtcaaagcgcgtgatatctacgttaacgaaaaactcaacctgtttgtgatcagagatacgctggagatgatccggttagtggaacgcttggttgcaatcaatgatttccctgatcccgaggtgatgctggatgtggttgtattggaagtgaagcgcgacaacacactggagctggggccgaatatgcctacttcggtgacattcagcgccgtccctggagtgggtgcacctgcccaggcggcagctgattccgtggtgaaaatgagcatgatcaagaatgcggggtttgaaggtctgcggagttttaccattagtaatcaggcaaaaattgattttggcagaacgctgactaacgcggatgtgctggccaacccccgtattcgcgttaaaagtcgggaaaaggcaaaaatccatatcggcaacaaggagccggtgttcaccgtgaccaataccgccaatgtcgggtcggctgcttcagcgacttatattgatgtcggattgaaattcgaggttgaaccagtcgttagaaccaacaatgaggtcacactgaaagcattgctggaggtcagtagtaatctgggcgagaagagatctggagggggagataatgcggccacagccattgtcatcggtacacgcactgcggaaacagtgttggaattgcgcgatggggaaacacaggtacttgccggattgattcaggacgatctgagccgggtaaaatcgggtatcgctggactgaccgagattccgatactgggggatattttttccaagcaggtcaggaaacataataaaaccgaaataattttgctgatcacaccgcatattattcgtaatgtcgttcagcccaaccattttgagagtgaattttattccggtacagccagcgctgccggaaaacttcccgttactatccggaaaacggccccgcaatcactagccatggaatcctcaggcagcacttcagtcggtggtggctatgccgcatttggccaggcggcacgatctgccggattgctcggcacggaatctgatccgtttgaagaagctatcacccaggcaggaagtgttgcgtcaccttcgctgacattgcgggcaccggaaagcgtgacaatgggacgggaatttaccactactgtcaggctggtgacacagaattccatgctgtccggtgagttgaacctgatctatgatccggaggcgctggagttgatagatggcggagaaaaatccggcatgcgcagcctaaaatttggacgggatcaacctactggaatgacggcagtattacgtttcaaggtgattagtacaaatccgggttcaaccgaaatcgcgttacagaatctgcaggtgcgagatgaaaccggacaggcgattgaagtggacgtgccaccgacagcaactatccggattcaataaaggtatctctgaaaacgatcgtgcaaaaagtgtttccagaaaactgtcattttcaggcttgtcgaggttttacgctggttgaactaatggttgtggtggtgattatgggaatcctggcttctgctgcaatgccgttaggtgaaatggtcgccaagcgagaaaaggagcaggcgttgcgtactgcactgcgtcagattcgtacagcgattgatgcttacaagcaggcggcggatgaaggacgggtggagaagaaagctgatgaaaccggctatccccacaaactggaagatctggagatgggggtagacgatatcaaggacccggacaagaaaaaaatcttttttatgcgccggctgccgcgtgatcccatgtttcccgattctgatgtaatggctgccgaaacctggggtaagcgcagttacgccagctcacccgatcatcctgaagaaggggacgatgtttatgatgtttattcattgtcggaaaaggtggggttgaacgggattccttataaccaatggtaaaatttgctgatgggtttgtcatcaatcgttcaaagccgtttttttaatggtcatcatctagttgatgcagatcagtctgatggacattttatacggttgcgtgagcgtgggtttacactgattgagctgctggttgtcatgacaattattgctattttgctcaccattgtgtcgccacgttactttacatccgttgatcgggcgaaggaaacggtgctcaggcagaacctcggtattttgcgcgatgctatcgataaatattatgccgatactggcaaatatccggccgatttgaatcagctggttgaggatcgctatattcgtgcagtaccggttgacccgattactgaggaaaatatctgggtggaaataccacctcctgatcctgaaatggaaggcgtatttgatgtacataccatttccgacaagcaggcgctggacgggacgttttatgaaaaatggtgatgaaacggatcagagaagaacagggatatatttatatctggatgttgtttgctgttatgctggcgggcgtgatgctggctgccgccggattggtatggcaaacagaagccaggcgggagaaggagcaggaattactgtttgtgggagatcagtttaggcgggcgattgaatcttattacaatgattcccaaaccgccgggggaggcgccgggcgctacccggaatcgttggaacaattacttaaagatgagcgttccccggttgttaaacggcatctcagaaaaatttactatgatccgatgaccggcagccacaactgggggctgatcaggcaggaggatggagggatcatcggtatttacagtctttcgacaaatgtgccgatcaagcgaaccagcttcccggcggattatgcggcgtttgaaaatgccgagagttatcagagctggaaattcactctggctgccagtggtaccggaggacaggggacgcaacagatcgatgatcagaaaaatgtgccgggcagcatgccttgatgcctgattcccgagtgtttcacttaatccatttgcgcaggatcagtctgctccggatgtaaacgcctacccatccccgcaaaattctgtggatcaaccagttgatcagtgattgtctttttaaataaagaatattgaaaccaaccgaatataccgtaatcacaagaaccaggcttgttgtttgaaagtcttagtatagataaatagttgccgaaggccgatacgaaatgaatgttattttgacgatattattagcaatgctgctgtgcgtggcgggatgtacccagcttcccaagacaggaaataaagttatgggtgattcggaggcacccgagaatgcagcgcccgttactgaactcactgctgatcttctttttgatttcctgcagggagaaattgctttgcagcggaatcagccaggcgttgctgtggaaagctttatccggatggcaaaggaaacacgtgacccgggaatcgcagagcatgcgactgatatcgcactgcgggcgcgtcgtttcgataatgcccgggaagccattgatttatgggcaacgctggaaccgaattccatacaagcgcatcaggcagctgtagcgctgtttgttgcgaccggtcaattgaataaagtgcgtcctcatattgaacggttgcttgtgcttgagccagaaaccgtcgataaggcttttatgcagcttaacaagcttctgtctcatcatccagataaggaggcagtactaaagctcattcggcagcttgcagcgccctatcctgatctgccagaagcccatttcgctgtttcacaggccgcatgggttgcccgtcagttcaaatcggcatcagaagccatgagccaggcgctcaagctgcgaccggaatgggaaatggctgctgtacacgagggacagattctgcagaaaattgatacagacaaagcacaggccttttacagtcagtatcttgaccggtttcccagagccaatgatatgcgaattgcctatatccgcatgttgatggaggaaaaagaatttgatcgggggcgtgaacaatttcagaaactagaacaggccaatccatccaatccggatatcgcgctggcaatcggtctattatccgccgagctggatgatctggaaaatgccgaaaaatatttcaaacgtgccttgcaactggggtttgaggatgccgatacgattcatttcaatctggggcgtatctatgagatctcgcagcgtgatgcgcaggcaatggatgcctatcaaaaggtgacaagtggagatcgttatattccagcgcatgtgcgctatgcttatttgctggcaaaacgggatggcgtggtagctgccagacactatctgaagacgatccaggtttcggatgagcggcaacgtacgcagctgctgatctccgaagcacagttgctacgagataataatgatttccggggggcgtatgatttgctggatgcctatctccggaaatatccggaacaggtcgagctgctttatgatcgcgccttgatggcagacaagattggcaaactggatgtgctggaacgggatctgcgtaaattaatccagctgaaaccggataatgctcatgcctacaatgcactgggttacagcctggccgagcgtggagagcagttgccggaggcattggcgctggtccagaaggcgattgagctctctcctgatgatccttacattctggatagcctgggctgggtatattaccggatgggtgatccgagaaaagggatcaagtatataaaacttgcttttgatacgcgctctgaccctgagattgcagcacattacggagaattactctggatatccggtgctaaacaggatgctgaaaaaatctggcaaacagcactggaagatcatcctgaaaacgagctgctgctggataccatcaggcggttcataaaatagacagcagccaaggaacttctgaagaacgtcagccagtcagttgccgatagagtgccggaataattttgatgagtcgttccggccgattgatgatggcgtagccaccacggccgaacagataaggaaaataagcttgtgcttcatggtcgatggtgatgccaaacagttgcaatccttgccgccgggcttcgataaccgcttggcgcgtatcttcaacgccgtagcgaccttcataatgatccagatcgttgggtttgccatcagtcagcaatagaatcaggcggtgacgttctggtcgttgcgccagtaactggctgacatggcgcaatgctgtgcccattcgggtgtagtatcctggccgtaatgctgcaatgcatcgcaatgtccggctgctgaaaggttcgttaaaatctttcacagtcgtcatttgcacaaaatggcgctggcgtgaggtaaaggtatgaattgaaaaacaatcctgacaagcggcaatgccagtggccagtgcaaccagtgcttctttctcgatatccagcacccgccgcccgccaatccagctgtctgtggagagagaaacatctaccagcaccgcgaccgccagatctcgtgcttgttcgcgtgcagcaagatagagccgatctgtacccatgccatgagcggcctgatccgcttgggcgcgtactagtgcatccaaatccagttctgcgccatccggctggccgcgtaaaatttccctacgagggcgtaatgcctcgaactgacggcgaatccggcgaaactgccgccgggcaccgtcactgggttcccattgctctccggtttcactggcgatttggcacagcacctgacaatgggcagcgtgatattgtttgcggcgataatcccattcagggtaagttagtttcgcaagcaggctggctggatcggtatcttccggtgccagatcaagatcaaatttcaatactgtggaggcgcgccgtcgatgggtagtaacggccagctcttccattgaatcagctacttctcgagcgtctgcttcattatcatcttctactggtcggttgacattcaccatttccgaccaggtgatcagtttttcaaaacggtttagtaataggggatcattacgttcgctctggtcaaattttctccgccgggcttttctactgcatcgatcttcctgattgacagaatgatcaacccgatcttcatcaacggacaatattcgggtagtacccgacggtgaatctatttctatcgtgccccataatggcactggcagaaacgggtggtaacctttatctgcgcgcagatcactgaaatctggttcgggttgttggatgcgtgcgagtaaattgattgctgccggatcagtacacggttgtccaagcagggcaagtacaatggattctacaatgtgctcttgtgtcggtagtgaacggggtggacgtgtttgaagtaaatgagagcacagtgtctgatatgttttttttaagcccagatagcgttggcaaatagcaagactggtttgccaggcacaatgaagaaaataaagatcagtctggaatggatcatcctttgaaaaagcggattgatgacaatgctggcttatttcgtcgaaatgtccggattgcttaccgctacttgctgccgcctgctgcacttcattctcggtagcgtgcgcagtcgcaatgacattggttgatctaatcagcgttttcttgcctgtcatagcaaaaaaagcggctaaccagaagtagagttgccgattgagcgatgcttctgggaacaagcaaatctcggcgggcagtaataatcgttccgggccaagtaccgccaacggcagtttttcttggtgatgacccaggcgctgtttccaacttggacgatttcgtaccgtttgtagcgttgtggccgtcagtaacagaccgtgatcaccacccataccatgaaaaaatgtgcgcaacgctgcatgaatggattccagcgaaacggcggccgaaggatagtgtgggtaactactttcagactggccaaccagtcggtgccagagacggccgatttgttcttccagctccagccattgccacatggtgcttaaccgaaagtagcgtggatcagttcaaataaaccttgttgcacttccggctcatcgcttaatggttcgatcaatgcggcttgtgctgcctgcaggggatcaagcccagccgccatcagtgtggcgcagtacaccagcaaccgggtggaaacactttcttccagatcaacttctttcagcagtcgcagttgggtagctagattgaccagcgcagtgcaatgttctcttgcgaggccgctttcattggcgataatttccagctcaatttccggtggagggaaatcaaaggatagggcgataaaacgttggcgggtactgggtttgagtgatttaagaatgttctgatagccgggattataggagatgactaacataaagttgtccggtgcctgcagaatttcattggtgcgctccaacggtaacatacgtcggtcatccgtcagggggtgcagtacgaccgtcacatccttgcgtgcttccacaacttcatccagataacaaataccgccttcgcggatggcgtgggttagcggtccgtccatccatactgtttccccacctttgatcaggaagcgaccagtcaaatcggatgcagtaaggtcatcatgacaagagatcgtgaaaagcggccgccccagtcgggcggccatgtgagtaacaaaccgtgtttttccgcaaccggtcggccctttcaataacagcggtaaacgttgccggtaggcgactccaaacagttcgcactcattgccgactggaacataaaatggcaggtctgtcgttgtggatgtcacgaatatattccaggagtagcgagcaactgtttcatttgtgggttggttgcaagttcggcgaagatgacacctgatttttggtaggtcctaatgcggcgtagatgtacaggattgcaccggcaacaaagacgataccggacaacaaccgcatccagtagaataaatccagttgctgctgaatttccatgaaccccataccgaccacgcgttgtaaatgggtttgcagcaccccggcaaaggtcagcgtaaaggtcatgaacgccatggaagcagtcatcacccagaaaccccacatattcaaaacctggttatatggttgcacgctgcgcaattgtggcagggcgtaagtgaagaaagccagattgagcatgacgtaggcaccataaaatgccatgtgtccgtgagcagcggtgatttgcgtaccatgactgtaaaaatttatgaatgagaaactgtgcattagcccccataccccggcaccgaaaaaagccatcaccggacagcctaaggtccagagcatggcggccttattgggatgattgcgtccgctgcggtacaccatgtggaaacaccacagcaccatagcgaagaagggcagcacttccagaatcgagaacagactgccgatccattgccaatagcctggtgtgccaatccagtaatagtggtgaccggtgcctagcaatccgctgaacaacgctagaccaacaatcacatacagccatttttcgatgacttcacggtccacgccagtcatcttgattaacaaaaaagcaagcatcgatgccatgattaactcccatatgccttccacccagagatgcacgacataccaccagtacattttgtccagtgcgaggttatccggattatagaaggcaaatagaaataacagtgccgccccccacatgccaagtagcagaactgtggagacaacggtctttcgtcccttgaggactgtcatagagacgttgtacagaaataacaggaacgcaacgactaacaacactttgacccataaaggctgttccagaaactcccggccttcatgtatccccatcaggtaactcaccacggcagccagtgcagcgaagacgaagataaacaattgcaaccaggcaattttcgggctatggatatctcgctcgctttcttcaggaatcagaaaataagctgccccgaagtaacctagcagcagccagatcagcagggcattagtgtgaatcatccgaataatgtggaatggcaaactttctgccagtaaattaggcaaggtatagacggaaccggcaaggacaccggccaatacctgaacaaggaacagcgctaatgcggcgatgaaataggggtaagcaagcttctgggtcgaatatttcatggatattttccttcgtatgatagttgttcaggtgagttagcctgcggtatttggaggccatccttgtgtatcaatacgactgacccactcaagaaaatcgattaagttatccagctcttgttcgcttaaattgaattgtggcatctggcgacgtcccggtacaccggttggctgggctctcatccaggcctttaaccccattcttgcaccctccggatgctcacgtccgccatagcggacccagacattgcccagttccggagcaaaataagccccttcacccagtagcgaatggcaattgatgcaggcattgcgctcccatacctgttttccttgcgcaacggctggagtgagcgtggtctgatcggtcgaggtgttgacgatatacaaatgggtgtggattgaaagagcaatgaaaagtagtaggaagaaagctgtcccgccgtaaaaaatattacgggcagccgatttagtaaacctttcactcatcgctattctccttgttcaaatattttgggtaattatagctgtgaccgggttgctagtattttagggcgaggcatccaatttcgtcggtatttgtctgatggttcaaagtctgcgtgggggcttctgcatagcagtttaatggtttcaacacgactaaaggtaaagttcagcgtgcctatctaaatccagataatccaattcatcattcctggagatatgcccaagagataattgatggtattaatgccgcacaaacaacatcatattcagcctacacaaagtttttgtgcattgctattacttgtctgagtcattcccacaaatacctcagccacctgctgctttatcgcctggagcggatgcattgcgctaaataataccgtgttacagctcgacttgtatgccaagctcgattacatgctctggcggcaggtggtagaacgccgttggccaggcgctgttgcgtgacataaatgcaaacaagcgatcgcgccaaagcgccattccggggcgttcgtcggtggggatcaacgaggcgcggctgagataataggtcgtggtgtcgagatcaatcttcagtcccaatgtttcacaggctcgtaatgccaccggaacattcggactttgcataaatccatagtgcacaatgatgcggtgaaaaccggaagacaactccatgacttcaaggcgttctgctgccggcacacgcggcacttcttcggtaattacggtaaccaggaccacttgttcgtgcaagaccttattgtgaatcagctggtagagtaatgccggcggtgtatcgtgctggtggatagtaaggaaaaccgccgtaccagacacacgcacaggaggatcagtcacgatacgttggagaaaatcttggaacgactcagtttccttatgtattcgctgtatgagaagctggcgcccctgctgccaggtaatcattaaggtaaatatgaacgcggcaatggcgagcgggaaccagccaccatccgtgatcttgagtagatttgaactgaaaaaggccaaatcaattatcaggaatcccaccgttaccgtcactgcggtcaggatgttccagtgccagcgttcgcgcatcacaaaaaacgccagaatagtagtgatcaccatggtacctgatatcgcgataccaaaggcacccgcgagattatccgaggagcggaagtgtagtaccagccaaatggcagcaatcatcatgaaccaatttgctgcaggcacgtagacctggccaatttcctctgaggaagtctgtactagtgtcaaccgtgggctctgcccaagctgaatcgcttgtcgagtcaacgagaatacccctgaaatgatcgcctgagaggcaatgatagtggcgagtgttgccaaacccaccagagaatagaggaatgatggcggcgctaagcggaaaaacggttgtgtctcgtgtgggctgagcaatagtagtgccccctgcccgaaataattaagtaacaaggctggcagtactagggcaaaccacattagccggatcggcgctcgaccaacatgtcccatatccgcgtagagagcctcggcgccggttagggcgagaaacacaccaccgagaactcggaaagcgctccagccgttatcagtgaagaaattgatcccataataggggttgaccgcgaccaacacctgcggatggtgaatgatcccattcaatccgagcaaggcgattactacaaaccacactagcatgatcgggccgaagactctgccgatgcgcgcggtacctcgcttctgtaccagaaacagcagcaacaggataacagtggtagccgggattatgtaggatgtaagttgtggtgttgccacttccagcccttccagcgcgcttagtaccgaaatcgccggtgtgatcatgccgtcaccatagagcagcgctgtgccaaacagaccaaggacaatcagtacgctacgctggtgtcgtggcgagccgcgccaggggcgcaacagtaccagcagagccagaatgccgccttcgccgtggttatccgcacgcataataattagcaaatacttgatcgaaacgaggatgatcagcgcccagaaaatcaacgacaggatacccaggatactttcaggcgtcctggagtcgggtgccatattgtgcagtgcttcgcgaaacgcatatagagggctggtagcgatatcaccatagactacgcccagggtggttaggtgtagtaaagcagcagtgaggcagaggtttgtgtcctgctcgttacgtgatccttgcttgttactggcagatgattccgaatcgagtgccatatttcattttcttttttttcgatgtagggagattactgcttaaactacccattatgcaaacctactgtaaaccgcaaacggcagtacatttgacgaagcattggatgacacgcacaaacgcgagggtgtaagaatttttatgtaaacggttatttggcaggacactgccgtgtgacgcagtaccaagcccacaacaatagactgtatgaggtattatgcgctgtgttgtacctgctgcgcaccggttttgcccatggagattcctgcccagtgagtttcccaaatggtagcgtgtgtatgcctctattggcgcaaatggagtgagcccgatcagcatggcgtgagtgtgttggagcagacattaaaaaatcaggttggcacggttcgcaagaaacaggggcgcaacgcttgcagcacgttcttgatcgtggacgcgcagagcgtgggactaaacatctaagaggctgtttgactcagcttcatcatcaaacgatccaatgcattggcaaacccgcgctgatcagattgactaaacgctgcaggtccgcccgtttccacccccgcactacgcaattcttccatcatatcgcgcatcgataatcgttcacgtatgttatctacgctgaaaagctcacctcgagggctgagcacgaaggcttctttatcaattaactgtgctgccagtggaatatcgcccgtaaccaccaaatcaccaacacccgcgtgtagcacaatataatcatccgccacatcaaagccacggggtacttgaaccgccctaatcaaaagcgaaggtggtgtatacaacatctgattcgccaccaacgttaaaggccgtttccagcgttgtgctgcccgaaataatatatctttaatcacgactggacatgcatccgcatcgacccaaatatgcatcttatctcctaaaacccttgctctagcattggctagaaaaaactgcattaaattcgatattattagatgatgtagtcacaagatactcgcccagaggacgatacatctaatttgtacagcggcaaggaaggaagcaatgttggtggaatgacaggtttcatgccctgggcttttgcttgatcaagtctgttaggcatcgcctttattcgtctttgcttgctgcacgaggccgccaccctggctgaaatacttgtttatgccttcagccgcccgatacgcaaacgcccctattgtcacggttgggttgtaattgctgttgtgcggaaacgaggagccgccgacaacaaacagattttccatatcccacatttgcgaaaacgtattcacagccgagttgtgcgggccttcgcccatgattgcaccgccaaagaagtggttggtaaaaaaccggtggttaaagttggtatcatcaggcacgtcgtcaacatcaacgatatctgcacccatctgctgcataatttgtttgcatacggcaacgccggcccgcgcccgtttgcgatcctgatcctggtactcgcacgtaacacgcaatagcgggttgccgagagcatccttgtaagtaggatccaaatccatatagctgtttttattaggcaaaaatccgctttggggcgttataaataagttgcggttgtaatagtagatcgaattctttttgaattcctttccccaggtcggtgtcccctttggtacatgattgttggcaattgggcgcgcgcccagctgactgtaatgcacctcgaatccatgcaagtagtcagaattcgaatgatctttattatccccgctaaagtcgtcaatggtggcaccgagcgccccggttcccataaacgtattgaattttttatccttaaagaatccgcgggcaccaatatacgtggagatattagtgaaatgcccggtgaagttcttgccaataatgccgtttccggttttcggatcataaggcttaccgatgtccgataacaacaacaggcgcgtgttgttaaaaacgaagcccgccagcacgacgacatcggctggttgttcgtaggttttgcccgtgttggtatctgtgtataccaggccagttgcacgcgttccatcatgagcgacgcgcgttacgttggcgttattacgcagctcgaggtgtcccgttttctccgcagtcgccagtactgtaacggtcgggctggactttgcattaaaaccgcagccgtactcttcgcagaaggcgcagtacatacagccattgattagctcgccatcggggttggtatacgcttgcgacatgttggctgacggcaaatggtaaggatgataaccaagctttttactcgcgtccttgaacagcgtaatagttggcgtagttttcatcgccgggttggggtatttgtccgaacgccgtggtccaagcggattttcttctcctgagattcccgctgctttttcatattgatcgtagtagggctccagctcgtcgtaagttatgccccagtcctgaatggtggtgccctgcggaatctttttctcgccgtaacgctcgacggttttagaataaatctcaaaatcgtagggcagccagcgaaaggctatgccgttccagtgatcgcctgcaccgccagtatctgtgcctagccttgcatggtaattattacgtactggcaatgctgttttgttcaaaccgttgcgcgacgttaacgtttccttacttaaatcctgcatcaattcgtagcgcgacgaatagcgcaattcatctttcattgcgacgaagtcgctggatcccctggctttaccacgttccagaataacgacgttatgccccttcttggtcaattcagcagctacaataccgcccgcccagccggaaccaacaatgacggcatcgactttattcagtttctcggtcattacataatctccagcgtttttttggtctaaccctgatagtcggtcaggcttattggctctagcttcacaaactcgtcttgttcaataacggctgaataagacgcttgagcgccgggatactccttcatcttccaaccctgcatattcttagaacctgtttacgatctttctgctatccttgataatgtgcagatgaagagaacaaaatatgccagtgatatcagcagagagaagtttgccgagatagagccgctattgcgcagcgtgcgacgcagcaccaagcccacgacagtggatctgtatgaggtattctgcgctgtgctgtacctgctgcgcaccggttgccaatggagattcctgcccggtgagtttcccaaatggcagagcgtgtatgctcattggcgcaaatggagtgagcccgatcagcacggcgtgagtgtgttggagcaggcattaaaaaaatcaggttggcgcggcccgcgagaaacgggggcgcaacgcttgcagcacgttcttgatcgtggatgcgcagagcgtgaaaaatacggacacggctggccagaagggttatgacgccggcaagaaggtatcgggtatcaagcgccatatcgccgtcgatacccagggcttgccgcatgccattgcggtgacgacggcggaagtgactgaccgcaaaggagcattgcaagctctaaaacgctgcaagcagagtctggggcaggttcaaagcctgctgtgcgatagcggctatactggagagccgtttgccgaaggcgcgcgagaaattctaggaaaacttgttacggtgcagattgccaagcgcagtgaactgcacacttttgcagtcatacccaaacgctggatcgtcgagcgcagctttgcctggctggagaagagccgaaggttatggaaaaactgcgagcgtaagctcaataccagcttgcagttcattcatctggccttcctggcgctactactcaaaagatcgtaaacaggttcttattgccgccatacaaagggtcggaatacgcaccttcgagagtcgtctgtcgcaataaggtgaaaaagtccgaggccgctacgccgaccatatcgatatcatcattctcgaaagcctgcaaaatctggatttgctgttcttcgctggcgttttcgaaacgcttaccgaaacgtttttcgcttacctcattcagtttacgcaagccatttagaaaaatggcacctctattcatagccgactgctcggggtacggctctccatgctccaggtcttcttctgtttgcggctgaaacggcccggctcggtaatcttgtccgttgataccccataagcctgccaattgcttatctataaaataaggcacgtttaggccaatggctcccggcccattatcgtcttctgggaacaggcgttccgtagccgcctttagaacttcgaaatcactggcacgcgtaaaaaattgccgcgcttcctgaaaattgggtgcctcgggttcattcggcttggcctgcgcagcctggctcacaaaaacaccaccaagcagcacaccgccgacagagctaccagccactctactcgtggtcttgatgaaatttcggcgggtcgggtcgtctactacggtaccctttgaatctttatcgtcggtcatggtttagtcactcctttagatagtatataattattcctgattaggtgtaacggctcatattcaacactattttaagctcggaataactgcaggttcatttgcggttaatgtcgatttagcgctcggatcacggatagttgtagttatttccggctcaaaatcgcgctgaatgctggttgagtcagctttaaatgtaggtcattacatgtatgctgatgtagcaattcgctaaattcgtctgctgttacaggcttgcccagcaggaatccctgtacttcatcgcacatcatgctttttaatttcgtgagctgcgaatcggtctcgacgccctcagccaccacatccattccgagtgtatgggcaagtttgatgattgcggaaacgatggcgctgccttcaggtccgcactcatccataccgctggtgaaaaaacgatctatcttcagttgcttggcacggaagcgttgcaagtaggcaaggctcgaataacctgtcccaaaatcgtcgatggcgatctcgaagttgttttcctgaaacttacggatcatatcagtcgttttgggtgcatcctgcatcgccacggtttctgtgatttcaaacataatctgttcacatgggatttgttcagactggacgatatccagcatcattgtgatcagatccggttgctccagttgtcggggagacagattgatggccaccttgattgctggcaagccatcttccttccagcggcgtagttgttggcaagtttcgcgcaccacccagtaacctattgggatgatttgcccggaacgttcagcgatcgggatgaactccatcggtgacaaaagtccgagttctggatggcgcagacggagtagtgcctcggcaccaactagctcactattactgccacggaattttggctgaaaatacagagaaaaatagccaactttgagtgcttcgtgcaagacatgctgaatctgcaacgcgcgagtggccgcttcattcatgctcgtctcaaaaaatcgataggtgctgcgcccaccccgttttgcttcgtacatcgcggcatccgcgttcttcagcagtttttcaacggtatcgccatcttgtggaaataatgtaattccgatacttggcatcacctgtagaggctggttattggcccatagaccttggcgcatgcggctgagtatgctatctgccatttctgaggcatcgtccgtagtcgcgatattttcgagcagtgccacaaattcatcacctcccagccgggcgaccgtgtcgctgccgcgcacgcaatgcagcaaccttagcgcgaacgccttcaggacttcatccccaactgaatgcccaagagaatcattgatgatcttgaatccatcgagatccataaacaggatggcaaacatatttccatcgcgcctggaaatttcaatcgcacgtttcatgcgctctataagcgtccagcggtttggcaaatccgtcaaggcatcaaatgttgccatgcggacgatctggtcgttgaggcgggatactgagccagtaagaaagttcgccctcgcatcgtagcgagatagtgtgagtgtaatgatcaggatcaggaatgtgagcaaaatgatggtagtggcgagccattgcgaatcgatatcgttggctgtgccgctagttgatccgggtggaaaataggcggcggccatgccggtgtagtgcattccggtaatcgcgacacccatcaggaacgctgcgccgatacgcttagcaatcagatgggtttgatctgcatcgctgagaatgtaagcaatccacagtgcagcattggctgcaataatggcaataacaaccgagacaccgaacagcagcggatcgtagtgaatcgcagattgcatctccatagcggccatgccggtgtaatgcatgctggagatacccaaacccatcagggtgccaccgatgaggagacgggaaatcgtcaattttgtttgcgtgaccacatacagcacagaataagaaagcagtatggcgatcaccagcgaatagacggtagttgcgaaatcgtaaccgagtggagtaggcagcaaaaaagagagcattccaatgaaatgcatagaccagataccaatgcccattgctgctgcaccgccggcaagccacacataacgcagcctgggacgcgtcaatgcagaaatgtggctcgataggtcaagagcggtataagaggcaagcatggccaccacaagtgacaagccaaccagccagtaattgtatgtggcttgcatgacagttccgatacaggattagtaacatagaggataacggcaacgagagcacttcttttaacactgccacggtacttataattcattttctgcgatcgtatccctgatacagcaactacatttccggattggagtacttgagagttttagttgggcagaccaaacaccgaagccgtggtagttgcctgattaggatgatattgaaacggcgccagacttagatcaaagtgtagtggcagccaaattccttggatagcctacgaacaggtagacacaagtgggcctgggcattgatttttatcgcgatgaagtaactggcatgcttcattttcattccaagtaaacgtttggcagtaccaatcattgttcaatcacaacataactaacgtatagaggcggaataaccacatcgtatcaggtgttctgtcgttgtcctgcctggatttctttgactattctttcgattgaatttttgtagaatacccggtttgtttggttctcttttttacggttgatccccaccgatttaactatcatggctcattcttttgatgtgattatcatcggtgctggcgcagccggattgatgtgtgcgattgaggctggcaagcgagggcgcaaggtgtggttgattgatcatagcgccaagatcgccgagaagattcgtatttctggtggtgggcgctgcaattttaccaatctgcatacccagccccaaagctacctttctcagaatccgcatttctgcaaatcggcacttaggcgctatacgccgcaggatttcattgcactggtgcgcaggcacggtatcgcttttcatgaaaagaagctggggcagttgttttgcaatgattccgccaaacagattatcgctatgttgttggcggaagcgcatgaggcaggtgtgaagctggaaacctcggtgcaggtgcgtgccattgaagcagttgcgggcggttattggcttaaaaccaatcagggcgagcaaacttgtgcttcgctggtgatcgcgactggtggcctttcgattcccaagattggagcgacgcattttggctatgaggttgccaaacaattcggattgcgcgtgattcagccgcgtgcggcgctggtgccgttgattttcgatggagcattgttggcacgttgtcaggcattgagcgggctttcggtcgaggcggatgtgcgtttcgggaaacagatttttgctgaaggattgcttttcacccaccgagggttgagcgggccttccattttgcaaatctcatcgtattgggaggagggagagccgattgtgatcaatcttgcaccaagtacggatgtgttggcatttttaaaagtgcaaaaacaacatcagcccagactgcatatcaacaatgtattagcggaaatcttgcctaggcgacttgcccaaagtatttgtgatgaacggaatgatagcgggccattggccaacttgtccgatgtccggcttgcggcgctggctagtgctgtcaatgattggcatatcaaaccggttagtactgaaggttatcggacggctgaagtgactcggggcggggtagatacacgtgagttgtcttcgcagacaatggaggcaagcaaacaatctggcctgttctttatcggcgaagtggtggatgttaccggtcacctgggtggttttaacttccaatgggcctggtcctcgggttacgtagccgggcagtatgtatagacttgttttggtaccggcatggcagccagtgctgcctggtgagtgcatgatgatctgggcatagacttttatcgtgctgaagtagctggcaaatcgcaccgctcatcttgcctgttccatcacatcaatttgagttgccagttacgctgcgtggccaaagcgataaaacgcaagaataccgaagagattgggaaagaatgcgacctttttatcatgattcattactcgcctttccaggatgttcactttgtgtttctggcatagttgctcgaaatcgtgcaaggtacaaaggtgaatattcggggtgtcataccattgataaggcagattggatgaaactggcatgtgtccggcagcaacctgcaagcggtttttccagtaaccgaagttgggaaaagagacgataccttccttgccaacgcgcaatatctcctgaatgatattttctgtgtttttcatcgcctgtaatgtctgcgacaggatgacataatcaaacgatgcattctcaaacccggacaggccggattcaaggtcgctgtgtatgacattgattcctttttgcatgcacgccagaatattgtgagcgctgatttccacgccgtagccgcgtacatcgagcttgttaccgaggtagtgcagtaacgtcccgtcaccgcaacccaagtcaagcacgctggatcctggtttgatccaggctgcgatagtggcgaaatccggccgcaatgtcaggaccgatctgctgatttcagttgttgtcatgtccaaataagaaaccgttaaccggttctgctagatagagatgttatccatgtaggcgcgcaccagctggtggtagtagtcatcctgcatgagaaaagagtcgtgcccgtatgtggaaggtatttccgcatagctgacattcagtttattgtcgagcagtgctttgacgatctcgcgtgagcgttccggagaaaaacgccagtcagaggtgaacgagagtaccaggaaatctgcttgtgcacgcgcaaacgctgcactcaggttgccatcataatcctgtgccggatcaaaataatccagtgcttttgtcatcaacagataagtgttggcatcgaacagatcggcaaatttatctccctgataatgcaggtaggattcaatctgaaactccacgtcataattgaatgcaagcgagccattacgcagttcgcggccaaatttgctggccatggaatcatccgacagataggtgatatgaccgagcatacgggccaggcgaagccctctgcgcgggtgggtgccatgggaataatagtctccgccatgaaaatccggatcggtcagaatcgcttgtcgtgccacatcgttgaaagcaatattctgtgccgttaatctggcagaagcggcgatcaccgcgacatggcgcactctttccggagcatcaagcgccagttgcatggccgacatgcccccaagactgcccccaatgatggcagcaaaacaatcaataccgaactggtcagcaaaacgcacataggtttttgcccagtcacttgttgtgaccagcggaaaatccgggccgtagcgttttccggttctgttattaatgctgatggggccggtagaaccatggcagccacccagattattaatgccgatgacaaaaaatttccgggtatcaatcggttttcctggaccgatcatgttgttccaccatccggtattcttgggattatctgcgtaaacaccagccacatggtggttgccggataatgcgtgacagaccagaattgcattggatcgctccgggttcaactccccgtaggtttcatagaccagttcatagctgtccagtacagccctgcttttcaggctgagtggggtgtcaaaatgtacgcgtcgcgccgagacgataccgatagaatcagaatcttgcatgaacatctgaaaataataaaactgactgtagatgtgaaaaatgaatgctcattgtatctaattgtattaccgaaaattcagtattccttagggaggtggatgtatcagctattaagtttctgcagcagatcatgaattttctccggctcgtccgccttgagtatcttttgtatcaggcgcgaaatatcgggcaaagaactatccagtacctcccgtttcacagtcagtagctgtgtgggatacatggaaaactgccgtagccccatcccgagtaacagacgggtatattttgcatcgcctgccatttctccgcagatagaaaccggtatgccggcttttgtcgcactctggatgatccgggccaataatcgcaaaatggccggatgcagcggatcaaacagatgcgcaacggtttcgtcggtccggtcaattgccagtgtgtactgaatgagatcattggtgccgatggataaaaaatccagtttgcgcatgaatagctcaaggctcagcgcagttgccgggatttccaccatgcagccgattttaatagtttcattgaaaggcttgttttcatctcgtaaactttgcttggcaaattcgatcatttgcagtgtctgatcaacttcccggctgctggaaagcatcggaatcaggatctgggtatggcccaggcttgaagcgcgcaaaatggcgcgcagttgcgccagaaacatgcctggttcggccaggctcatccggatcgcacgcaggccaagcgccggattgggagccatgcgataggcgcttctgagattcttgtccgcacccagatcaaacgtacgaatgatgacaggtgatccattcatgcctttgataaccgtggaataggcttcaaactgttcttcttcatccggcagatcatcccggttcaaaaacagaaattcactgcgaaacagaccgattccggttgcgccatgttcttttgcccgctcgacttcttgcggcagttcgatattggcaagcaaatccaccggagtaccatcccgtgtcactgctgctacaaagcggagacgccagagtttgcgtttctccagctcaagctggttttgcttcagacgatattcggcgaggatatatttatccgggttgataatgacgatgccctgattgccatctacaatcagattgtcattctcgcggataagctgctgggcgtgctgcatagccacgatcgatggaatattgagactgcgtgcaacaatagcggtatgcgaggttggcccgcccatgtctgtcagaaaggcagaaaattgatactgcttgtattgcatgacatcagccggactcaaatcatgtgctaccagaataccggagccatcttgtttcaccggcgggggcgtataccccggatgtccgagcaacaccttcagaacccgttcagctatctgggcaacatcggttttgcgttcacgcaaataggcatcttctatttcctcaaagcgtgcaaccaggacctccatttgttgtgtaattgcccattcggcgttgcattgcgcttgctttacaatgtccagtgcagcctgggaaaacatcggatcatccagaatcatctggtgcagttccagaaatgcattgaattcagccggtccagctccttgtacagtagaactctttagtgtttccagctccagccgcacggtggaaaatgcgttgtgtaaccgtgccaattcagcatcaatttgatcttttggcagctggtaatgaaggatgttcagcgctgctgacgaggccagatgagcacgtccgatcgcaattccgtcggacacaccgacaccatggaggatgaaactcattcaccttccccgaagcaatcattgatcaacgcttttaatgcttccatggcctgaattgcgtcgggtccgattgtttccagctcgaccactgtacccttgctggcggcaagcgtcatgacacccatgatgcttttggcatttacccggcgaccgctgcgtgtcaaccagacttcactctcgaacctctctgccagttgtgtcagtttggctgatgcacgcgcatgcaaacccagtttattgaggatagttaacgtctcagttggcattgccggtttcctgcgatatatgaaggatactttcccgtccgcctgtcaggactttgttaatcagctgtggcaggggaatatgccggtgctgtaccgcacgcaacaacatgggcagatttagcccggccaggcattcaacgcgcccatcctgaatcagcccacaagcaatattagctggcgtggcgcccaaaatatccgtcagaatcagaacaccgtcaccctgatccagctgcttgagtactgcctgcaactttatcgcctcagtatccggatctgcagccggggacacaatatgattaagcaacagcgggggacgctcgcccagaatatggatgacgcagtcaatcagactggccccaaactgctcatgactgatgatcaggattccgatcattttgtgatttacctacctgtttactagaaatgaatttctggattttatcatcaaggtatttctaaacaattcaattgctcgtgtaatttgtattcgtattaaaaatgcatacggcggtatctttttcaatggcggcggatttaatttagatgacggtacagtgtgctgtcagatctggtaagtaaatattaagcaggttgtaagctatttcacggcaggtttccacaaaatgaatcatgatcacgcaataattgtaacgattacgtatgtagaggcgtgtggttgcagagagaaatagaaatcggagtatatgctggaaaaatttaatcctactgtcaattttcggtgatggagcaattctttgtaactgttctgctttcaattgagcattttcatatgcttggcggggtagcttttttggcagcgttgctggccatattggccgcctggatcatgctgtggcttgtccaatattacctgcttcgctatggcaacaggttatggcgggcaacggtatcgttgggccatgtactcaagagcaagtttatttgcaatccatacgtgcaccggtggatgcgccgacatcccggcagcatccggtttctggcggagcgtgctgattacacccattttttcggccttccactgacacttcttttcttgtcgcttgccgttacgttggttttgcttgtagaagttgctgaagatgtcgctacttccgattcgatcgttgtggttgaccatattgctgcccggttgatttccacatttcgtgcgccagaacttattcctgttgccatctggattacgaattggtgtgcaccgccgataatcggcatattgctggtggtggcatgtttgttgctatggctggtgaaccgcagatttgctgccataggcttgataacttcgttactgggagcctccctgttcagtgtgctgaacaaattgatttttcagcggctccggccggatggcgctgtgctgtttgaaccatcctattccttcccaagcagccatgccaccctgtcagtcgctttctatggatttctggggtatttgctgatcagatctgtgcagaagtgggatacacggatcaaattatgctttgccatgatgggatttatttttctgatcggactcagccgcattgtgctcggcgtacactacctgagcgatgtctgggcgggctatttggtggggttactgtggctgatcttgggcatcagcgtgaatgaatggctcgctgcaaccgggcgaattgactggaatttaccacttgaccggcgtcggagaatactagcgtgctccctcatgcttgtcgcagtaattggtgttgccggttatttatttgcccaggcactgttttcccgcgatcttcagtaaaagcatcatccagtttgtttattaagaaggtttaacgcccgcatttgtgtcaaattggagtgcagcggaaatttgtccgcaacatgcgtttgttagcttttaagccttgttccaatctctagcccggattcttccagtctggtagtaagttgaaacaagatcgatataatcacaaaaatcttcattttcaataagtattctgtttgttgattcccagtcaacatcttgacgagaacgagcaggcagtatcatttcactttcacttggattttcagggttgagcagaattacgccgataccatgtaatgcggataacattctcaattctttttcagtattagcatcgctaatcgatgtaactaccaaatagccttcattcgcccagctagaattacttacagcttggaagaaactttttctagcattggaaacgttaagttctttctttacttcaaacgaccatagacgaacactctgacctgcgccctgcttaacacaacttctgattaattcattccactctttgtcaatgggctgcatcgctactatgtctggatgtaaccattggttaccgccactacctcttgaattttttgaacgtttttcatctattcgttggcagtaaagtttaagctctgttttgaggtactcaatcagtaatgggtacagttcatgctcgagctatgattatttctggtgtatgacaagggagaaggaagcggtgtaacctgttgttgaggatctggcagatcaaccaacaaaacaagggaaacaccgcatgacggatagtaaagtttttaatctgaataaaccagaacaaaatgatccgttacaggaagtgctgcgagaaggcgcacgcaagatgttgtcggcagcgattgaagcggaagtaaccagctttatccatcatcatggcggtttgaaaaccgctgagggtagaacggcagttgtcagaaatggttatctaccggggcgctcgattcaaaccgggcttggtgatattgaagtcaaagtgccgaaagtacgtgatcgcagcggttctggcatcaaatttaacagcagcctgatccctccctacttgaaacgaacacgaagcattgaagaatttctgccttggttgtatctgagaggggtttcaacaggagatttcacagagaccttaaaacacctgttgggagcagatgcacctggattatcgcctgcaacgatcagccgcttgaagcaggactgggaacaggattatcaaaactggactcgccgcgatctgagtggcaaacggtatgtttatgtctgggctgatggtatctacagcactgtgcgaatggatgaccggttatgtcttctggtgattatcggttctgacgaaacggggcgtaaggaactgctggcattgtctgatggttatcgtgagtctgaagcgagctggatggaagtattgacggatttgaaacaacgtggcctcaaaggtgctcccaaattagctgtcggtgacggtgcgctggggttctggaaggctgttacccagtgctggccggatacggatcaacagcgttgctgggtgcataaaatcgccaatgtaatggaaaagctgcccaaggccatgcaacccaaggtcaaggaagcgctgcacaatatctggcaggcggaaacacgggaaaaggcttataaagcatttgataactgtattgaacgttttagtcctaaatatccaaaagcgatggagtgtctggcaaaggataaagactccatgctggctttctatgattatcctgcagaaaactggcaacacattagaacaactaatccagtcgaatcagtctttgcaactgtccggctgagaacagccaaaaccaaaaactatggaagccggatgactactttgacaatggcgttcaaactgatggaagtggcacagaagaaatggttccgactaaggggctataaattgttagcggatgttgtgcagggcgtcaaattcgttaacggcgttaaacaaaatggagatcgaaaacaggtagccgcttgattctctatacaccagatttgacaatagctcttcatgctctgacaatgtgtgatttgtagctggggcagtatctacttcaactttgtcattatcttgccaatccagatctgaatgttctgggatatctgtcgattttttatctgggtcataccaatatagtctggggcgaggcttgtcctgccaaaaaacatggggactgttattagcaatttgctctttctgtgcccctatttcagcaacaatttgagtaatgaatgcttttttgtcgacaaaccgtggattattacgtttttctgtatagtcttctggatacagattgaaaattgcctctgcgagagttcgagcattaaaacgttctttggggttctcacggaggaattgaaccactttttgtgactgcgataactttgacaacccctactcctgttttaaacgtattactctggaaagctcgcccctcactgcacgaaggcgcctttcttcatcaattgccattagctctttccctttcgcaatctgctcttcagtagggtcaggcagttcttcaaaccagcgttcccatctggccgcgagtgcattcaacgagatttcatctgtacgccctcggtgaatgtgtggtttgatgagggcataaagttctggggcgagctccttcttttccatcatgcgcttaaatacccatagatgaacgtcgacaagctcaagtcctccactgcttgcactagatgaaaatgagatgggagtttttggcatgccgctgaaatcgattgccggaaggcctgggccgttgactgccggaattccgctcattacagcgaagtattcagatagagacttttgtgccatgttgaattgggactgttggtcaacggtgatcgcggcttccttcttccgttgcttctttaggcaggaggcaataccatgcattaccaactgaaaaccaatgatgttgggtgtgacctgtagccgatcttttttgctcttggtgttatagcagatctcggacggatttttctcagcccatgtgaggacgtcggagataagctgccgggatcgagcatcgggtagttctcctactcgggaacgtaaatccacgcagacggacacaagtgcagcttccgcttttgtatcatcaatttcaatccgtgcctcccatgcacgtttggcaaggtcctcgttgaatagtgacgccagtttgagcagcagtacatagcgcatcggcgtccagtaaccagaccaagtaatagcgggattatttccgtgatcaaagacttggtcaaaaaagcaaatgatcgcgtgatctggctttgcaacccgatataggtcaaatcgaaaatagagtcgtcgttggagcgcaacgagcccttcgatcaaaggaactaaaccaccgttaccaagttcatttgcatgaaggcgtggcacttgcgcctgacgccttagcttttgaagatgtttctcagccaggaagtcgatgttgacctgactggaaagaacaccgtagtacagcattggctggtcggggtcaaataggttcgggccggtgtgaccgctctcatcaatgtagaagtacaagaggcgtcctctgtaatgtgatggctaacgtataaggacattttgtccaataattctgtatgtggtgtcgtataactttgaaatcagcctgttatcgtgttttatttcaatacaagccttgaaaaggctggtcaatttttataaacagatacgacaacagaattggtttaaaaattatttaacctagtgcagctgagaataagatatgggttcgatagtgaaggcatgaaatagcgctgatattgcaggttatttgtctgattcctgaatatatggattctattttttgaagcattccagagttgtgcaaaggtttccagggattcaaaatgcatacagtagtatctttttcaatcaatctgccatgaggagaaattgtgaaaaaactgataatgggtgtgcttttcctggccttcatgttgtccggagctgtctgggcaacgccgtttaccagcctgtacgcgtttggcgatagtctctcggatggcggtaacagcccgactgcggtaacgagtatttacaagctgctgggaaataattgtgatcccacccatccctgtccaccttatgtgggtgggcattactccaatggaccggtagcggttgaatatctggcaaattcaatcctgcctggtggcgctaattcaggcaatttttttaatttctccgtcgccggagcaaccagcggtatcggtaactatggtgatagagggtctgcaacctcatccggcattttcggattacctggcattagtctggaaattgaaggttatctgcttgcttcgggaggcgtggctgatccggatgcgttgtattttgtctggggtggagcaaatgattttctgacattagattcccccactgctgcagcgcagaatatcgcagccaatgtagacaaactcatggcggctggagccactcatttttttgtgcccaacctgcctgatctgggcctgacaccgctggctgcagaaggaaatgtgcaagggctggccacattattctccaccacgtttaatacggcgctgtcttccgagttggcagcgctgggtacgcagtttcctgttgctgaaattctccaatttgatacctattcctttttcaatcggattgttggtgacccggctgcgtatggttttaccaatgcacaggcaagctgcctggcttttcaggcaggaggggtgcaatgcagcaacccggatcaatacatatactgggatgacctgcaccctaccacgcaagcgcacgctctgtttggttctgtttttgcccgggccatccctgcgccgggaacactttttttgctgatgctgggctggctggcacttgtttttgcgcgcgggaactggacttgcaagaacctggccaggccagttaattccatgaaactggttggctgattgccgggctctgtttgaatctggtggtgatgcagggcgggcaagcatagtgcatcacctgcaaactaccgggttatttcgagtgcttcccggtagctttgccagtcaaagcgggggcctgggtcagttttcctttgtggcgcaatatcgacgtgcccgacaatgtcatgaatagggtaggttgcctgtagtgcttgggtgagtttaaccaaacgggcgtactgaattggtgcaaatggttgattatcactgccttccagctcaataccaatggaaaaatcgttgcaccgggtgcggccttgccagcaggagacgccggcatgccaggcacgcagcgtgcaggggacaaactggatgatttccccatcacggcgaataaaaaaatggctggagacttttaatcctgtcagctcttgataatacgggtgtgcttgagggttgatctggttggtaaacagttcaatgacgccttcgccgccaaattcttccgggggcaggctgatggcatggatgaccagcaggctgatatcattcccgtccggccgttcatcgcaattgggagaaggaatgtatctggcgtgaacgaggtaaccgtccgtattgattagcatggatatgattgaattgccggcatgagttctgaaattttaagggtgccgccataaaaacgcccgttaaccattttaattgagtgactatcttgcaacgcggaaaatttattacttttgaagggatagacggggcggggaaaagcacccatctggcctggctggcgagtttcctgcgtgataaggggctggaggtaatcgtgacgcgtgaaccaggtagcaccgcgctgggtgaacaattacggcaattgttgctggatcatcgccaggcgatgcacgctgaaaccgagacgttgttgatgtttgccgcgcggagagagcatctggacaaagtgatattgccagcattggagcgtggtgcctgggtaatttcagatcgttttactgacgccagttttgcctaccagggcggcggcaggggagtgccatcagccaggctggaaattctggaacaatgggtgcagaaagggttttctcctgatctgacggtgtacttcgacgtaccggtgacaatcagccgccagcgggtacaatccgccagaacggccgatcgctttgagctggaaccagatctgttttttgagcgtgtgcgacaagcctatctgcaacgcgccaaacaattttctgaacggatcagagtagtggatggcagcttgtcgctggaagaagtcagaacagccatggtggaagttgtagagaaattctggtcggctcaagcgagctccggatacagaatgtaagtttggcatgagtaaacagccagatatcagagagacgccagatgggaagaatatactgaaagacagtgctgtcgttgtattccttgctattagatgattacccggacttcagccataaatcattccaatcaggtttcatccatatccagccacactccattctgacgacaatgcctccgcctgctgcaatacggtctgcaccgccgcatcctgcaggtcgggtgggtagccatatttgcgcaggatgcgcttgaccagcacgcgcagccgcgcccgggccgattcacggtgggcccagtcaacggcaatgttttctttcaggctgaccagcagctcgtgagcgataacccgcaaattgtcgtcacccatcacctgcacagcagattcgttctccgccagcgcgtcgtaaaaggcgatctcatcaagggataagccctgttcctcgccgcgattacgtgcagcgcgaatgtcctgcgccaaattgatcagttcctgcagcacctcggcggtggtgatagcattggcgtgataacgggcaatggcgtcttccaaccgctcggtgaaagcgcgagtctcaaccacgttggtgcgggtgcgcgagcggatgctgtcattgagcagcttgcgcagcgcttccagccccagattctttttctccatctgctgcacttcaagcagaaactcgtcggagaggatggagatatccggcgtctggatgccagcagcagcaagtatatcgacgatctcggtggagaccacagcacggctgacgatctgttggatggccagttcccgatcctgccggataacccctgcaccgcccgccgtcttgaccagcgcggcacggatcgcctggaagaagccgacttcctcgcggatgccgcgcgcttcatccgaacttgccaccagcgcaaaggccttcgatagactcagtacgccatcggcaaagcgccgtcgcgcctgcctcgaagcttctggcgtcttttctgctgtcgcccattgctgctgcttgtcaagtatccattcgatagcgccggccatcatggccagtcgttcgccgggcgtagcgccaaggccggtgcggtagtcgaacccaaagaacatgtcgcgcacgatctcgaccttctccagcagcaccgccacggcctcccgctcatcaataccggttttgtcttgatccggtttggaatactgggcgagggccgacttcagattctgggcaatgccgatgtaatccacaatcaagcccgctggtttgtcacggaacacccggttaacgcgggcaatggcctgcatcaggccgtggccgcgcattggcttatcgatgtacatggtgtgcatgctgggcgcatcgaagccggtcagccacatgtcgcgcacgatcaccagccgcagcgggtcctgcggatcgcgggcacgttttgccagcagatcacgccgggccttgtttccgatatgttgttgccactcaaccgggtcagacgccgtgccggtcattacgatcttgatgctgccggcgttgtcatcgttgctgtgccaatcggggcgcagcttgataatctggtcatacagcgccacgcagatgcgccggctcatgcacaccatcatcgcgcggcctgagagtgccgccacccggtcctcgaagtgctgcaccaggtcggcggccaccaaggcgagacgcttgtcgctgcccaccagcgcctccatggtgctccatttctgtttggtgcgttcggcgctggcctccacttcgtcttccagcagcgcctcgatctcggcgtcgatgcgcggcttctcgtcctcatccagctcaatgcgcgccagccgcgattcgtaatagatcggcaccgtagcgccatcttccaccgcgcggctgatgtcgtagatgtcgatgtaatggccgaacaccgccggcgtgttcacatcggtggcttcgatgggcgtgccggtgaagccgatgaaggaggcatggggcagtgcatcgcgcaggtacttggcaaagccgtaggcaatctcaccggtcttgctggccacttttgctttgaagccgtactggctgcggtgcgcttcgtcggcgatgaccacgacgttggaccgattcgtgagcgtggggaaatcggcctcgtctgcctttggtgcgaacttctgcagcgtggtgaagatcacgccgcccgaagcgcggttgagcaggatgcgcagatgctcgcggtcccgcgcctgcaccggcgtctggcgcagcaggtccttgcacatggcgaaggtagcgaataactggtcgtccagatcgttgcggtcggtgagcaccaccaacgtggggttggccatgcgcgaatcgaataccagcaagcccgcgtaaaatgccatcagcaggctcttgccggaaccctgcgtatgccagatcaccccggccttgtggtcacccggcggttggaccttaacgctgggtagcccgtagacagccgggtcctcggccactccgagacgatccgatggctggctcgcccgtaacgtagaaactaccgccttcttcaccgcgtgaaactggtggtagccggcgatgatcttgatcagcccgccaccggtttcgccaaacacggtgaaatggcgcagcaggtcgagaaagcgcccttgctcgaatacgccctcgatcagcgtggccatctccggcatgcctttgggttcaatgcgtgtgccgtcggtggtgcgccagggcatgaagcgctcctgatccgccgacaacgagccgacccgcgccgacagtccgtcggaggtcaccagcagtgcattgctgcgaaacagtgccgggatctgctgcttgtaggtttgcagttggttgaaggcgccgaccaacgtcgcgttctcgccaccgggtgccttgagctcgatcaccgcaagcggcaggccgttgatgaacaccaccacgtctggccgacgcttggtctggccagtcaccacggtgaattgctgcaccgccagccagtcgttgttggcggggcgctcgaagtcgatcagccgcacctttcctgagaccaactggcccgccgtcagcgtgccgtcctcggcccgatcctgtgaaaagtactccacatccgcgccctcggtcagcagccggtggatgcggcggttctcctccagcaggttgggcagttccgactgcgtcaggcggcgaatggcgtcagcttgcgcctctggcggtagcgtcggattcagtcgcgccacggcggcggtgagccgcgccttgagcaccacctcgtcgtaagcctttcgctccggcgccttgccgtcgggaccgaggaggtcgtccgaggcgcaggtgtagcccagcccggccagctgcgccagcagcgcggtttccagttgggcttcggataaaaaggccatgacgattccttattattcgctttctttcagcaacacaaagtgctccaccagccgtaccatcagttccttttgttgcggcaggctctctgccaccagcagggccagcgccaccaggtgctggtttacgcgcagataccagaggaacaggaaggacccggtgcgtttattgccatcggccagtgggtgattcttgatcacgaaatacagcaggtgcgccgcccggctggccacattggggtagaacaacgtatcgccaaagccctgttcgatggtggccaatgcggaggccaagccttcgccccgcacctgcccgaacagctcggtggcctcgcccttgcggatcagctcggccttgagttgggcaatggcggagagtaccgcatcctgttgcagtacctgcataccatcctgcctggtggtctggccggtcaggctttgctcgtcgtagccctgcagcaggctccagctgcgggcgtagtcggcaatcacccgtaccacggcttccccttcggcgcagaccagctgctggttggccaaggtgcgcgacagcaggttcagggcctgctcgaactcgatgccgcgctccttgagccggtgctggttgaagctgtagccgtccaccagatgctggcgcagcaccccggtggcccactggcgaaagcgggtggcgcgggtggagttgacccggtagcccactgagatgatggcatccaggttgtagtgcttgatgtgccgtttgacctgccgcgagccttcctggcgaactaccgagaaagcctcggtagttgacggctcatccaattccttgtccgtgaagatgtttttcaggtgcagactaatattgtccgctgaggtgccaaacagctccgccatctgcgcctgactcagccagacggtttctccctccagctgcacctgtaccgcttggtcgtcggcttcgaaaatcacgatgttattcatggaccccttccctgggcattgttacccctgattccagccaccccgccggtatgagcgtatccagcccagcgcgctcgcgggcccaggtcggcagctcggggttgatgggggtgcgggtggtcacgcttttcctccatattgggaggcattggtatagcagtgctttcttacttcctcgacccaattgtcataccaataccatgcgtcctgaacctgaaccccaaatcctttcgcaggactctttgcatccatctgctgccatagactggtatgagcataaatcgagaaatttttatatccttccatcttcatcatctccacgaccccttttggcagatgctttggacgctccgtttctttaatgatggtgtaagccttgttcacatcgcttgccaattcagaatcagctttcacgaactcgattacttcatcggcttgtcctttccgattagctgtcttggcaacgaatagcactcgataggcaaatttggggttgttaaactcttcatccgtcagcccaccttcgaaaccagcgacgaatgctcgaatgtgcgaaggcattttgtcggcggaaggcaatgtggctgcttggtcacgcgatatggaggagaactgaagactaaatgcgagatactggtcaattccgaatttttctccgaacagcttttttacgtactcgttgtaattcaggcagcacgcctgaaacttggcgctgagcgaagaatcaatccacgaggtcatttggtgctcaatctcgtggcgtatgccaatcaggaagcgcagattgttggcactgtctttgtcaatcggcgactccttggcattcaggcagcgttccaactcccagtgtttatgtgcgccggatgctgttttatcgaatacccgtgttttgccggtttttttaaaatagcgatattcaatttcttgcttgcgatagtaggcatgaagcaaataggtccaggccacattcatcagcacgatgaaaatttccgacttgaatatgatcaacgggctgttgaatatctgcaccgccgacagtgcagcctcgcgggacttcgtaagcaattctccggatacagagaaggcccgtctgattcttggctctttggccatcagttcgctctctcaatgaagagttctgcatctttcactcgcagtttgccggagatcagtttgggcagcagggtatcgcgaagctgcgcgagagactgcgactgacgctcgttctgcaaaatttgtgaaaatagatgtttagctcttttgtcgtaagctaggcgtaacggtccagagctcgcgtcaacccggagctcagaaaatctggctgtgctgaggttgcccagtacagacccgccacttcctccagctttgatttcctccccaagatttttcaaagcccagtaccagaaataggtttcgcctccttgagcagggataacgctattgatttgctgattcgtttgagatggctccgtcgttatgaccacgaggccaagtgttgcgatgcaactcacacaaatcgatccaggagggagcgtctttttttcttgtgactctgcacctttatgcgataaccgcttttttacattagttgcaaaaatattcccgtgcatctctggaatcgttatgaagggcacatcgtcaccgtaatattctagatttttggtgggcggcgtttttccacagacaattcgaccgatgtctccaacgcgctgttgtatccacccctccggcttgccctcgtcgtcgaggcggtcggggaagtgttgccagaggtcggcggggaggtaggcgtcgcgggcttccatcttggcgcggacggggccgaagtcgacgaaccagtccttgaacaaggcgcgggccatggcctccagggtctggttgcggcggcggttgagttcgattttgtcatccaatgtgccgaggatatgggcgatggcacgttgttcggtcatcggaggcagcgacaggtttatttttcgtagttcgctctgcttaatgccggatacagttgagccgcttgctcttgctcgtagttgattctgaattagatctgactgaagaagaaacttcagaaacgtgttgtcaagcgtgtcgagcttgccacgaagcgcaatcaggcgctgggctaaggccaccttttcatgcccaagctgtgccacttcacctaagggcgcttcggtggtgatgagaacatctcctgcttgcggtatcccgcgtcgcatccatgcatcgtagtcatcaggcgatataaactcgttcggcgtttcgatgcgaccattcttgactactttcgcggtaatgagagggacgcctgcataggtcttcgtgggtgttttaccgcgataatcaatcaaggcttccatgccgtcttctaatggaatctgctgccactcactcgccatacccaagctccctcaggttggtctcgattgccgcatccagccgcgccgtctcctgctgctgctcgcgccattgcgcactgagtcgctgcatcttgtcgacgaaggcttcgccgtcatcctcggctgcctcggcgccgacatagcggccgggggtgagcacatggccgtgcttgcggatgtcatccagggtggcggatttgcagaagccggggatgtcttcgtattcgccgtcctctttttcaccccgccacgcatgataggtgtcggcaatcttctggatgtcggcctcgctcagctcacgccgggtgcggtccaccagcgtgcccatgttgcgggcatcgataaacaggacctcgccgcgccggtcgcgcagggtctccttgccgcgcttgccgttggacttgtcgcgggccaggaaccagaggcacgcggggatctgggtggagtagaacaactggccgggcagggccaccatgcagcccacggcgtcggcttccaccatggccttgcggatttcgccttcgccgctctggttggagctcatggagccgttggccagcaccacgccggcggtgccgaagggggccaggtgccagtggatgtgctgcagccaggcgtagttggcgttgcccacgggcggcacaccgaactgccagcgcgggtcatcgcgcaggcggtcgccgccccagtcggagatgttgaacggcgggttggcgaggatgtggtcgaagcgcaggtcgcgcagctcgtccttatgaaagctgccctcgttgttccagcggatgtctgagtcgatgccgcgcacggccaggttcatcttggccaggcgccaggtggtgtagttgctctcctggccgtagatggcgatgtcgccgaggcgcccgccatgctccagcacgaacttctcgctctgcacgaacatgccgccgctgccgcagcaggggtcgtagacgcggccctggtagggttcgagcatttccaccagcacccgcaccactgagcgcggcgtatagaactcgccaccgcgcttgccttcggcgccggcgaactggctgaggaagtattcgtagacccggccaagcacgtctttcgatttgtcgccgccctcgttcatggcgatgcccgagatcaggtcgatcagctcgcccagcatcaccttgttcagcgccgggcgggcgtagtccttgggcagcacgcccttgagggagtcgttgtccttttcgatcacgcgcatcgcgtcgtcgatcagggtgccgatctcggggcgtttggcattggccttgaggtgtgaccagcgcccctccttgggtacccagaagatgttgtccgcgaggtactcgtctttatcttcggcggctgctgcactttcggccgctagctccgcatggcgagcctcgaaggcgtcggaaatgtatttgaggaagatcagccccaaagcgacgtgcttgtagtcgctgggttccatgttgccgcgcagcttgtcggcagccttgaaaagctcagcttcaaagccgagatgatcggtggttttgttgttattggatttaaccattgggtatttccttgttcttttctatttgcttgtggctttagctgctggcgatcgctgcctcggagcgcgcctggcattctctactcccgatagtgccagcgggtgggttaatctattatcaacaatttttatgttggtaaaatgctgaataaatagagattttactttttcgggaagattatgtctggcaggagtggaatatcatattaactctccacagggtgcctggcacgcagcaggccgattcccagcatggccatgatgattgaaaccaggggatttagcacgttaagcagagcatacgcggcgtagtccagtgttggtacacccagtgttgcggcgtaaaaaacacctgctgttgtccacgggatcaggccggcggtcagtgtggaaccttcttcagtggaacgcgataacacggccagatccagctgtttttcccgataaggttgcctgaacagctggcaggtgaggatgatggaaatatacgtctctcccataaccaggttaccggccaggccggaagcaatagtggcggcaatcagggcactggctcggttgattggcgcaatcagccgcatcaatagtacttgcaagaatctggcacgatacaggattccgcccagtgctagcgccatgatggataacagcaaagtccaggccatgctgtataaaccgccgcgtccaagtaattcgtcaatattggcgatgccggtatggccgggtgtgttcagccacagcgcgttgatgacattgacagtatctcttccttgataggccacggcgatcagcattgccagcaggatgctgcatgtcatactggtttcggcactgtagcgtttcatactcatgcccagcatcactagcaggggtaacagcgttatcgccccgttcattcgataggaatgtgccagcgcgctgcggatttctgccagatgtgcttgcggaagatgataatcgccgtactgcagcccccatacgagaaaaatagccagaacaattatgaatgtgggcagcgtggtgtacagcattgagccgatatgtcggtatagattcgtaccagcacttattgccgcgagattggtggtgtcggaaatcggtgacagcttgtcaccaaatgttgcgccggagacgatcatgccggccaccagtggcagtggaatgcccatagcattgccaattccgatcagtactacgccgatggtgccgacggtgccccaggaggtgccggttgcaaccgacatcaagctgcacaatacaaaaccggttgccagaaacagggtgggattgagccagtcaaggccaaaatacagcaaacttgcgatggtgccgctttgcataaagctggcgattaccatgccgatcagcaggaaaatgtaaatcgccggcaatgccctgacgatgccttcatccatcatactgcgaatggcagcaaacgaataacccaggctatgggtatgcaggcctgcccagatcaacgccagaaaaatgagtgcgtgtaggctgatttgaaacacgaacaaacccgatgcaatcagcagcagtattcctgtaaaacaaatgagtgcctgccagaaggaagggagcgggtgtatatttggcagttcctctacggtggtgtcgttgtgtgtcatggttttggtgattatttatggatcagttaatgtcaataacattgcgtgattgccttgctttccttgttctttttttggggggatgcagactttatcaccaggatattcaaacagccagattgggtgccagtgtttccgatccgggtcatgcttgttggaaatcgcgctaaactgcaatgcctttattaaaggcagtttctttatttaatgaaaaactatttttttaagatagggtaacttcaaaaatgactgtggctgaaatttttccatggcagcagacaatctggcagcagatccggcagccggacagtttgaggcggcatcatgccctattgctaaaagggcgcaaaggaactggtaagctgggttttgctcttgctctggtgcgatccatgctgtgtgaacaggtagatgcagcagggagggtatgcggaaaatgtcaggattgttactggtttgaacaggggctgcatccgaatttccgtttgctggagccggaagcgttgtcagttcaggatgggacggcagacaggaatagcgaagaaaagcaggaggaggctggtggtacaaagtctggcaaaaagccgagtcagcagatcacgattgcgcagatccgtacactggatgactttatctatctgagcgcacaccagaatcgctacaaggtggtgttgattcatccggccgaggtaatgaatgcagctgctgctaatgcgttgctgaaaaagctggaagaaccgccgccagaagtgttgtttattctgatagcgcacggaacgtcaatgattccggcaactattctgagccgctgtcggcagattgccatgccgacgccggatcgtaaacttgcaaaagactggttgattcaacagggaattgcacaacctgatttccgtttggccatgtcgagtttctcaccattgctggcattgcactatgacgagcaacaatcttcgcctcatgctgattttattcagagtttatgtgtgccggagaaatttgatccaatcggattggcagaaaaactgtacaagcaggatttatccagtgtgaccagctggatgcagaaatggtgctatgacctgatgagctgccaccttagtggaagggtgcgttaccacctgcagcagatggatgccatcaagcggcaggcggcagtcatagatccggttgcggttggatttctatggcgtgatctggctgcttcacagcaactggcacgccacccgctcaaccccaggctatttctggaagagatgtttctgatctgtgctgaaataatacatccggcaagctcagaaacaaggtaataactactgaatgcaggattcgctggttgggtcgatggtgcaagcccagagcgttctgtgaatacctgctgcacgattaaacaggtggtcggcctgttgggatttttgctgctccagcgtgagggaggctttttcaggaatgaagtatttttgtacccagaaacgtattctgcagaactctttctcgtttgcgcacagcttgtgaatggcagagctgtatatcgttttatctgcttgccgccctttttctatcaacaccatattcacaaattttcctgaattacccatttcaactttgcgtatcagttgccagccaataccgctgggtagtgcattttcatctaccttgatcacagtttcggattcggcggtggccggggccggggctgtttcttccacaggtgtagaggctgcagcatgttctccatcctgtactgaaaaagccaggcttgaccaggtgattgcgagagaaatcagcaatccttttcctatattgttcatgtgttccccttatgaaacagcttgttatattgaaaggcacctcaagaaacttacgacacctgatctgctcgcgacagttttttaagctgacccgagatgtattattctgtctgcacgaagtattgctcaggccgcttgagaaatataaaaaatccggccataacaacttgttttcgtaacacccgacagactaacgtttctgatcttatccaaagattggatcactgtgcaacgattgtgactggaaatcggtggcttgcatgtttgtttcatcagatttaaccaagaatttttatttggcagaagattctttcggagcagaaagaggagtccatgaaacataaaattacgacgaatttgagtcatccacgcaagcatcatgctcgcgtgcgtaattatcgtccgggtgcgtcccccggttctttggaagctctgccggctgcagggtcagggacgacaccgatgccattggcgtgtatttcactgctgcgttatggaaaaaatggggtgattgaagagcaacgtgggcttgcagcacacgattgccgggcgcctgctgccagcgcagcagacgttatctggttgcatttacaaggtctacctgctccagagcagttgcaggcgttgagtgcagtgtttggtttgcatccgcttgcgctagaggatgtattccatcgggagacccgttccaaaatagaagcctacgaggcgcagcagtttgttgtgctcaattacctgcatcaggatcaaacgggtaaattcaataccggcctggtgagtatttttctgggaaagaactatctcatcagtattaacgatggtccaggtgatcttttcgagcctgttcggcggcgtattcgcaatacgggcaagccgtgcgagcatggtgccgattatttactatatgcactggcggatgtcattgttgatagtggattttcgttgcttgaggaactcggcgatcagattgaagcgctggaaaatgaaattctcgacaacccaggtcacgaggcgcgcaacaaaattcattgcatcaagcgtgaattggttcaggtgcgtcgcatctggtggccgcaacgtgaggttattgccgcacttatgcgcgatgatggacattttctgtcggatatcacacgtctttacatgcgtgactgttacgatcactgcgtgattgtgattgactttgttgaaacctatcgtgagatggcgtctaatctgcttgatacttatctgtccgcagtgagccagcgtatgaatgatgtcatgaaggcacttaccattatcgccacaatttttttaccccttatgtttctcacgggtctgtacggtatgaactttgatactgaaagcccgtggaatctgcctgagctgcactggcgttttggctatttttacgtgctcagtgtaatggccgttgtggttattggcatgctgatttatttccggcgcaagcgttggttgtaagaacctgtttatgatcttgtaaaactgctgataataatgttggggcatgagaaaaaattatccgagcgacatcagtcgcgaacgatttgaaattatcaagccgttgttggagtgtgcgcgctggaagacctaccccagacgcatagacctgtccgaagtattctgtgcgggctctgtatttactcaggagcggctgccaatggcgcatgctgcccgaggagtttcccaaatagcgcacgcacactcgtacttttccatctggagtgaattacgcgaaggtggcaggccgtaagggggctttgctggtggctgcgtcgttgcaaacatgggctgcagcaaggacaaagtttgctgtacgacagcgcctatctgggcaaaccttttgcccaaggagtgtgcgaaatcctgggaaagtttgtgacggtacaaatcgccaatcatagcgagctgctatacctttaaagtcatgcctgggtaaatcatacccaggtgctggattgtgggacgtagcttcgcgtggcgagaaaagaatcggtgacggtgaaaaaactgtgagcgattactcaatgccagcttacagttcattcacttttggcatttctggtgatcctgctaaaaagagttggaacaggttctgagaagtgcccttgtgtgcgagcagaacgattataatcgtaccaattgtgccaaagggggataacagtttatgagtgatttgcaaatcagcctggttattattggtgttgtgattattgccggggttgtcatattcaacagaattcagttggctcgccatcatcgccgagttcaggatgcgttcagacatgagcatgatgatgttttattgagtgatgagcataaaccaatatctgtagatgaacggattgagccacaatttggtgatgaagtaccgtcaattcaggatgatgcgacggatttggccaatgttccggcgagtgctttgcctgaacggcatgtggcgaacgatcagccggtacagaaagagcccggtgtgcagaagaaagctgctagcgttgatagcatgatcaattatattgccgatattcgctcaaactcacctatcccgcatgagagactcatagatctgctgcaacagaagttcgattacggtaagccagtgcgctggtacggcctgcagtcagaaggacagctgtgggaggagatttcgctggatacgcttagccccagaaatacgtatatcgaattgaaaggatgcttgcagcttgtggatcgctctggactggtaacagaaattaatttatcgagatttcgtgacatggccgaagatttttctgtgcagattcacgcggaagttgattgtcctgatattgcggatgcgtatgccagggcggttgatctggatagattttgtgctgatgtcgatgtgattatgggtgtcaatattatcagtaaagatggtggtgcttttgttggaaccaaaatccgtgcgttggcggaggcatctggttttaggctggaatccgaaggagttttcagataccgggatagcgaaacgaatgaggtgatgttttcccttggcaactttgagtctgctctgtttttgccggcaaatatgcggacgttgactactcggggcattacttttctgttagatgtgcccagggtcgcaaatggtgagaaagtatttgatcagatggtccatattgccagacttttttcatcgacattgaacggccttctggtggatgacaacagagtaccgctgagtgaaagtggagtaaaaagaagtaggcagcggttggctgatattcaaactacaatggcggcacatagtattgctgctggtagtgaaacagccctgaagctatttgattaacagtatctcaagtgttccgtgggagtaagccatggataaatctggtgctgtgcagaatcatccgattcaggttcagctggaaattgggaagcgatattactggtgtcgatgtggtctcagtcaatcacaaccattctgtgacggttctcatagaggtgccgggataaaccctgtgccatttacgattagggaagctggctcggtttggctttgtgtctgcaaaaaaacaggtaatgctcctttttgcgactgttctggtagtgagccatgattttttatgcattctgattggatctagggcttgagcgcacgaaaaccatgaactgctgtgatattgaagcagagatagtaggggtgttcagagtgggttattaatttttgacagatgtagtttgacaatgcgctggattctaaccggattatttttgttgttggtatttccactgccaagccgtgcagctcaggacgtgtggattctgatagatacttcagagcaccggcttagtgtcatgcgcaaggataaagtcttgctgacttttgataatatcgctattggtcggtatggcgctagccactcaaggatgcgaggagataatcaaacaccgctaggatcgttccaaatcagttgggttaaacaacatgaccgcttctatcgtttttatggcattaattaccctaatcgagaggttgcggacttggctctttcagaggggagaatttcgcgacaagtctgggaaaatataatgaatgccattgaatccacgggattgtcaccacaggatacatcgcttggtggttacataggtattcatggcataggtaagggtgatcaggcagtacactctcgtttcaattggacaaatggatgtgtagctcttactaatgtccaaattgatcagttgaatccgtgggtaaaactgggtacgcgtgtgataatacgatgatagttccttcgtgaaaggattctgaaaaatactattgagtaaaaagatgtcgatatgcctaatttattaaggcctgttcctgtttaatctcaatattgatttaaagaagcaagttcgtatcgttgtagctctcaccagcaatacgagcttgcaatgctccgattattgctcaatgctgagctctggccgaagctactggccattttgcttcacaaccacctctacaacaagcaagatttgctgtatgactgtcgaaggcatactgtaccgcagtggtaccggttcattcgggagctggagcaaggtttataaacgattcaccgcctgatctgccagcggaaaatggctcaaggtatttcaggctctggtggttgagccggacatggagtgggttttcatcgatggtagctatcaaggctcaccagcacagtgcgagcggtaaggataaggcaatcggaaaaagccagggccggtaatacctgcaagattcacatggcggtgatgctcagggacttcccgtcgcattcgatattaccagtagtcagatcaatgattgcacacacacatcggctctgcgatccaggaggctggatgcggttcaatccattattgcagacaaaggactatgacagtcaggccatacgtgatcaaagcgaacaacaaggtgccaaggcagtcattccagggaaggggtaactccaaaacagataatgcagatctggatcgagggctgtaccgatgccgacacctggtagaaaatattttcgcacggttgaaacagtgccgggcggtggtcctgtgctttgataaattcaaacaaaaccacgaaagcctcgtggctatggtttgtaccttcctgtgattaccaatgtgaaatgggaacagacctttggatagtcagttgatttaaccgcggcaacagaatactttagccttgacttgaaaataataacgccgtaaaattcgcagtcttttttagccgctatataaggcgagagggttttgtgtaaaacaaggctataggaaagcaaaagaaaaacataggttgaaggcgtaaaaagagtctgcgctattttaatgaaaacaacctgcataatagaattaaaacttgatgtatgaaaagctgggagcaaaatgccgacaattagtcaattggtgcgcaagccacgtaaagcaaagcaagtaaaaagtaaggttcctgctcttgagagctgtcctcagaaaagaggggtatgcactcgtgtttatacgacaacgcctaaaaagccaaattctgcgctcaggaaagtagccagggtgcgattaaccaatggttatgaagtgagtagctatattggaggcgaggggcataatttgcaggagcactcggttgtattgatccgtggtggaagagttaaggatttgccgggtgttcggtatcacactgtgcgcggaagtttggatacggctggtgtgaaagatagaaagaaagcgcgttcaaaatatggttcaaaaagaccaaaaagtgcataagaaatatagttcagtgtgcgtatagctgtgtgagattaataatcaaaatattgagatagtgcaaaatgcctagacgcagagaagtgcccaaaagagaaattttaccggatccaaaataccataatgtggaattggctaagtttgtaaacgtattgatgacgcgtggaaaaaaatcaattgctgagcagatcatatatggtgctttaagtcacgtagagaaaaaatcgggaaaggatccggtagaggtatttacacaggcgctgtcaaacatcaggccggtcgtagaagttaaaagcaggcgggtaggtggtgcgaattatcaggttccggttgaggttaggtcggtgagaaggagtgctctggctatgcggtggttgcgagacgcagctcgtaagcgtagtgagaagtcaatggatttaagattggctggtgaattgctagaggcttctgagaatcgtggaacggcaatcaagaagcgtgaggaagtgcatagaatggcagaatcaaataaagcattttctcatttcaggttttaaagagttggctgcttatatataaagtacagctgtagctatttatcagaaaaaacaatcttagggtgtggcagtgtcaaagagaaatccgttagagcgataccgtaatataggcatcatggctcatattgatgcaggaaaaacaacaacaagtgagcgtatattattttatacaggtgtttctcataagttgggggaggtgcatgacggtgctgccactatggattggatggagcaagagcaggaaaggggtattacaattacttctgccgccacaacatgtttctggaaggggatggcgggcaattaccccgagcacaggattaatgtaattgatacaccagggcacgtagattttacgattgaagtggagcgttcattgcgggttttggatggagcttgtacggtattttgttcggttggtggtgtgcagccacaaacagagacggtttggcggcaagcaaataagtatggcgttccgaggctggcttttgtaaataaaatggatcgatcgggtgcaaattttatgcgtgtccgtgagcaaatgataagtaggcttaaggcaaatcctgtgccaattcaattgcctatcggagcggaagataaatttgctggcatcattgatctcgtgaagatgaaagctgtttattgggatgatgcaagtcaaggcacgaaatttgaggagcgtgaaataccggcttctcaacaagctgatgcagctgcttggcgcgaaaaaatgatagagtctgcggccgaagcaagtgaagagttgatgaataagtatttggaagcgggtgatttggcagtggaggacataaagcaagggctgcgtgcaagaacaataaataatgaaatcgtgccaatgctttgtgggacagcattcaaaaataaaggtgtgcaggctatgttggatgctgttttagattatttgccttcaccattagatgtaccggcaattaaaggtatagatgaaaatggcttggaggatgagcgtggaccaagtgaagatagtccatttgcagctctagcgtttaagattgcgacagatccctacgttgggcagctaatatttttccgggtatattctgggactgttaaatcaggtgatactgtatttaatcctgttaaaggaaagagggaaaggattggtagattgttgcagatgcacgctaatcagcgtgaagaaattaaagaggttggaactggcgatattgctgcagcagtaggtctgaaagaggttacaacgggggatacattatgtgatcctaatcatgtaattactctggaacgtatggatttcccggagccagttattcatgtagcggtagagccaaaaactaagatcgatcaggaaaagatggggattgcgcttaaccgtttagctcaggaagatccgtcttttagagttagaacagatgaggaatctggccagacgattatttctggtatgggtgaactccacctggaaattattgttgatcggatgaagagagaatttggagtggaggcaaacgtaggtgctccacaagttgcataccgagaagcgataagaaagcaagttgagattgagggcaaattcgttaagcaaagtggtggtcgtggtcaatatggtcatgtatggttgcgaatggagcctaatgaagcaggtaagggatttgaatttattgatgaaattaagggtggtgctgttccgagagaatatattcctgctgttgagaaaggattgcgggattcattatcgagtggagtgcttgccggatatccggttgttgatgtaaaaatcgcattatttgatggttcataccacgatgttgattccaatgaaaatgcttttaagatggctgcatcaatagcgtttaaagatggtatgaaaaaagccagcccagttcttttggagccaatgatggcggtggaagtggaaacaccatctgagtttatgggtaatgtggttggtgacttatcttcacgtcgtggaattattcagggaatggaagatattccagggtttaaggtgatacgatcagaagtgccattagcggagatgtttgggtactccactatacttcgatctgctactcaaggtagggcaacatactctatggagttcaagcattattctgaagctccaaaaaatgtggctgaggcaatcatcagtaagaaataaagctattcaaataaaaagaggttgacgtaatggcgaaaagtaaattcgagcgggtgaagccgcatataaatgtagggacgataggccatgtggatcatgggaaaacgacgttaacggcggcgatcacgaccatcctgaccaggaaatttggcggagaagccaagtcatatgctcagatagattcggcacctgaggagcgtgcacgtgggattactattaacacatcccatgttgaatacgaaacagataaacgccattacgcgcacgttgattgcccgggtcacgccgactatgtgaagaatatgatcacaggagcggcgcagatggatggcgctattctggtggtgtcagcagctgatggacccatgccgcagacacgcgagcatattctgctggcgcggcaggtgggagtgccttatatcattgtcttcatgaataaggctgacatggtagacgatgctgagttacttgagctcgtcgaaatggaaatacgtgaactgttatccaagtatgattttccaggggatgatacacctattattattggttcagcactgaaagcgctggaaggggataaaggtgacatcggtgaagcagctattctgaagctggcggaagtgctggattcatacatcccagaaccacaaagagcgattgatggggcttttattatgcctgttgaagatgtgttctcaatctccgggcgtggaactgttgttacagggcgtgtggagcgcggtatagtcaaggttggtgatgagatagaaattgtgggattgcgacctacaatcaaaacgacatgtaccggtgtcgagatgtttcggaagttgctggatcaagggcaggccggagacaatgttggtatattattaagaggtaccaagcgagaagaggtggagcgtggccaggttctggctaagccgggtagtatactgccacacaccaaattttctgcggagatatatgtgttgagcaaagaagagggtggtcggcatacaccattttttgcaggatatcgcccacagttttatttcagaacaactgatgtaacaggctccattgaactgccggcaggcgtcgaaatggtgatgccaggtgataatatatcagttaatgtcaatttgattgcaccaatagcaatgagcgagggattgcgttttgctattcgtgaaggtggacgtaccgtcggcgctggtgtagtcgccaaagtaactgaataagtttagatacatcgatactgctaaggattggtagtctcatataaaataagctccgtaaaatatacaacttagagtgctttatgcaaaatcaaaaaatacgtatacgtttaaaagctttcgactatcgtctaatagataagtcagctgttgaaatagtagaaacagcaaagcggacaggagctgtggttaaggggccagtgccactaccgacgcgtattgaacgatttgatgtactgcgatcaccgcatgtaaataaaacctcgcgcgatcagtttgagattagaacgcatttgaggctaatggatattattgatcctacagataaaacagtagatgcgttgatgaagcttgatttgcctgctggtgttgatgttgaaatcaagctgtagtttatttattagctatagaaggcaaaaactcaaagtagaggaagcaaatgaaattagggcttatcggtaaaaaagtaggaatgactagaatctttaccgagtctggaagtagcgtgcctgtcaccgttcttgatgtttcgaaaaatcgtgtggtgcagattaaaacagctgagagagatggctattcagcaattcagttgacgcaaggatatcgacggaaaaatagaataacaaaggcattatctggtcattttgcaagagctggcgtggaggcaggaaaagtaataaaagaatttagaatagagcagcaagctatcaatagcgacctaaaattaggttctgaaataaacgttgaaattttcctgatagggtcaaaagtagatgtaagtggggtgtctataggtaagggatatgctggtactataaagcgtcataatttttcttcgagtagagccagtcacggtaattcaagatcacataatgttccgggttcgattggtatggcgcaagatccaggtcgggttttccccgggaagaaaatgacaggtcggttggggggtgtaaatagcacaatccagaatattgaagttgtgcgtgttgatactgttcgtggtctgatttttttgaagggatcggttccgggttcaaaaggcaacggagtttttatacgcccaagtgtgaaacacgcaaataaacaataactgataagtataagcaaatggttaaaattccttgtagaagcgaaaatggacaagttgttaatattgaagtatcagattctgtttttgacagggtatataacgaagcattggttcatcaaatagtgacatcgtatttggcgaatgccagaagcggtactcgagcccaaaaggggcgatctgaagttgccggttctacgcgcaaacaatggagacagaaaggaaccggaagagcaagagttggtgcggcatcgaatccattgtggaggggaggtgggaaaatatttcccaataagccaacagagaactttaccaaaaaagtaaatcgtaaaatgtatcgtgcggggatgtgtacgatattttcccaactattaagaaatagtaaattagtagcgataagtgaatttcgggtcgagactacaaaaacaaaattttttttgcagaaattaaaaaattatcaacttgaaaatgtaatgattattactgatgaagtagatgagaatttgtatctggcttccagaaatgtaccgaatataaaagtagtcgagattgacttaatagaccctgtaagcttactgtcttatgataacgttgttattactcgcgaagcagtaaataaaattgaaagcgtattgcaatgaaaattatcaatataggcagtgaaagagcactggaagtaataaaagctccacaaatttccgagaaggcaacttttttagctgagaaagttaggcaaatcatattttatgtttcacgcgatgctaataaagctgaaattaaatcagctattgagcagatttggaaatcacagaatattaaagtaaagagcgtgcaaataataaatgtaaagggaaagaaaaaaagatttggccgatatataggacaaaaatcagattggaaaaaagcatttgttagtctaaaagatgaccgcgagatagattttactgatgtaaggttgtttgaggataaataatgacacttaaaaaatcaaaacctacctctccaggtcaaagagcagtagttagatctgtaaacagttttttatataagggaaattcatattctgcattaactgagaaaaagaaaaaaaattcaggcaggaataattctggaaagataacagtacgacatattggtgggggacataaacatcattatcggattgtcgatttttgcagaaataaagatgatattcctgcaaaggttgagcgcattgagtatgatcctaacagaagtgcatatttagcattactttgctatgcggatggagaaaggaaatatattattgcagcaaaggatatagaggtgggttcgtacgtggtcaatggatcaggttctccagttaaaactggtaatgcattgcctatccgtaacattccggttggaagtgtgattcattgtatcgagctaaagcctggtaagggagcgcaattagcacgttctgctggatcctctgctcagcttatggcgcgcgaaggtgactattctcagattagattgagatcgggtgagattaggaagatacatataaattgtagagcaacaattggagaggttggtaattccgagcataatttgcaatcaataggtaaggccggggctgtaagatggagaggaattcgtccaacagttcgaggtgtggcgatgaatcctgttgatcatcctcatggtggtggagaaggtaaaactgccgctggaaggcaccctgtaagtccttggggcacgccttcaaaaggatctcggacaagaagaaacaagaggacagtcaatatgattgttcgaagcagatattctaagaaaggttaaaagtatgagccgatctatttcaaaaggtccttttgttgatttacatctcatcaataaagtcatagttgttcgtaaaaataatgataaaaggcctataaaaacttggtcacggagatcaaccattctcccggattttattggattaactatttctgtccacaatggaaggcagcatattcccatttttataacagaaaacatggttggtcataaacttggtgagttttctcatactagaacgtttaaaggccatgctggtgataagaaggcagcaggttctaagcgataggattatatatggaaacatctgtagttttacgtagcgttagattatccgctcaaaaagggcggttagtggtaaatcaaattcgaggattgcaggttgatcaggctattaagctcttgacattcagtcccaagaagggggcggtaattattttaaagttacttgagtcagcagtagcaaatgcggagcataatgaaggtgctgatattgacgaattaaaagtagctcgagtttttatagggcaaggatcttcactaaaacgtgttagtccgcgcgcaaaagggagaggaaatcgtatatcaaaaccaacatgtaatattttcttgaccgtctgcaatagatagaaatttattaagtaaacatgaaaaaaggtaaataattcatgggtcaaaaaattaatccgacaggatttagactttcagttctaaaaaactggtcttctcgttggtatgcaaacacaaagaaattttcagtttttttaaatgaagatattaatgtgcggcagtatcttcaaaaaaggttagcgcatgcttctgtaggaagtatcattattgaaagaccatcaagaaatgcaaaaatcacaatacatacgtcaagaccaggtgttgtaattggtaaaaaaggcgaagatattgagattcttcgtaaaaatgttgagaaacttatgaatgttcctgtgcacatcaatatagaggaaatacgtaagcctgagattgatgcgcaacttattgcggctagtattactcaacagcttgaaaaaagaataatgtttagaagagctatgaaaagggcgatacaaaacgctatgagattaggagctcaggggattaagataatgagttctggaaggttgaatggtatagaaatagcacgaactgaatggtatcgagagggaagagtgcctcttcatacattaagagccgaagttgattacggaacttcagaagctaaaacaacttatggtgtgattggcgttaaagtttgggtttttaaaggggaacagcttagtgtgagggatcgtcaaaactaagcaaaagcttaatgtctctgagagtcagctcagattaagtttgtgactatattttaaagtagctcgaaagcaagggatttagtaatgttacaaccagccagaaccaagtttcgtaagcagcataaaggtcgcaatactggtatggcaaccagaggcgcaaaggttagttttggggagtttgggcttaaagctataggccgtggaagattaacctcaagacaaattgaagcggctcgacgtgcaatgacgagacatatcaagcgtggtggacgtatttggataagaatttttccagataagcctgtttcgcgaaaacctgctgaagttagaatgggaaagggtaaggggaatccagagtactatgttgcagagattcagccaggaaaagtactttatgaaatggatggagttgatgaactgcttgcacgtgaggcttttagattggctgctgcaaagctaccaatgcagacggtatttgtgataaggcatttagggagttgatttcttaatgaaagtaatagaattaaagggaaaaggattgccagatttggaaaaagagcttttatcgttaagaagaatccaatttggtttgaggttccagttgaagacgcaacagcttacagatacgtctcaagttaaaaaagtgcgtagagatatagcgcgtattaaaaccattattcgagaaaaagaggatggcgatgaatttagacaatcaaagtaaatatctgattggacaaattataagtgataagagagataaaacagtaactgtaagaattgacagaaaagtaaaacaccctctttatggaaaaattatcactcgttcaaaaaaatatcatgctcacgatgagcataatcaatataaagtgggcgatgtggtagctataagtgaagcacgccctatatcaaaaaccaaatcttggcgagtaatcaaggtagtaaagattaattgaatataaccctcgattgaaaagtgttatttatatcctaccgtacaaaatttagaatcaatcttaacaggaagtataaatatgattcagatgcagtctttactaaaagtagctgataatacgggggctcgcactgtaatgtgtatcaaggttctcggaggatcaaagcgaagatttgctggaatcggagatgttattaaagttgctgtaaaagatgccgcacctcgtggtcgtatcaaaaaaggagaggtttataacgcggttattgtacgaacagcaaagggaatccgcagatctgatggctctttggtgaagttcgatacgaatgccgcggtaattttgaataataaattagagcctataggtactagaatttttggtccggtgacacgtgagcttcgtacggcaaagttcatgaaaatagtgtctctagctcccgaagtaatttaaagtaaagagcttatggccatgaaaaaaatcaggaagggtgacaacgtaattatattatcaggtaaagataagggtaagcaatcaacggtaattaagtttgaaagtgtagaaaaagtaatagttagagatgtaaatagagttaaatcgcatgttaagcctaatccaagtaaaaatattgttggtgggattgttgaaatagaaaaaccaattcatgtttctaatattgcaatttttaattctgacaaaaataaggcggatagagtcggttttaggtttaatgaatcaggtaataaagtacgctactttaaatctgatggcactctaatagatttgtaaggatagaagaataaaatggctcgattatttgatcattataaaaatatagttataaaggaactaatacagcagtttaattataaaactgtaatgcaggttcctaaaataacaaagataactctaaatatgggtgttggtgaggcggctgttgataaaaaaataatggaaaatgccgtcagtgatctagaaaagatctcggcacaaaaacccataattacgaaagcgaagaaatctattgcaacttttaaaataaggcaaggttatccggttggttgcatggtaactttgcgtggaataaagatgtacgaatttttggatcgtctcgtaagtattgctatccctcgtatacgtgattttagaggaataggaggaaaaggttttgatggccatggtaattttaatatgggaattaaagagcagattatatttcctgaaatagattacgataaaattgataaattgcgtggtttgaatataacgatgaccacaacggccaaaactgatatagaagctaaggctttgctttctgcttttaaatttccatttaaaaattaaaggaataatgtggctaagaagtcaatagtaaatcgcaatataaagaggatggaaatagtaaataaatatgcgacacgtcgttcagaattaattgctgtcttaaaagataccaaatcagatattgaacaaaagtcaacagcgcgcaatttacttcaaggactccctagaaactctagtcccgttagactgcgtcagaggtgtatcttgactggaaggccaagaggagtatataaaaaatttggtttgggaagaattaaactgcgtgaaatagcgatgcgtggtgaaattccaggtgttattaaagcaagttggtaaagttaagctttgactttgaagaaaattgtgataaaaaagttatttctggaacaaaatataaattggtgtatatatgtgcatgactgatccaatagctgatatgcttacgcgcataagaaatgcgcaggctgcagaaaaaaaagaagtaaagatcccttcatcaaagttaaaaaaagcaattctaaaaatattaaaagatgaagggtatattgagagctatcaagagatagtcagtgatggaaagttatctgtagatatatgtttgaaatattttaacggcggaccagttattagttcacttaccaggataagtaaaccaggattaagaaggtattcatcacgaaataatctgccgaaggtgatgcatggtttgggtatagctattgtatcaacctctaagggtgttatgaccgaacgttcggcaagagctggaggagttggtggtgagttattgtgcatagttgcgtgaggtaatttaataatgtctttctacacaacaacaaaaccaatcgagataccaaaattagtggaagtccagttgacagaattgggtatagctataaaagggcctttgggaagtttatttcaattaattgatgtgcataatactaaaattgaaatgagctcaaattatttaactattcaagccttaaactcttcaaaacaagcaagatctatagtgggaacgattaatgctttgatatcaaatatgattagaggtgtgacaaatggatttgagaaaaaacttctcattgtaggagttgggtataaggcacaagtttctggcaatattttaaatttgaatctcggcttctctcatcctatatcttattccgttccagaagatattaaggtagaaacgccaaatccaactgaaatcctaatcaaaggtatcgacaaacaaaaagttggtcaggttgctgcggatgttagatcttatcggcgtcctgaaccatataagggaaagggaattcgatattttgatgagaaagttataattaaagaaactaagaaaaagtaatataaggaataagataatgttgctaaatacgatcaaacaggctcgcttaaggcgtgctaaagcaactagaattaaaattagcaattcaaagcgttttaggctgttggttcataagagtaataatcacatttatgcgcagattttggatccttcatcaaataatgtagttgttagtgcttcgacagttgaggcggaggtaaaaaaacaatatccaaacggtgggacggtggaagctgctaggtatattggtcaattagtggctaagaaatctcttgattcacagattagtgaaatagcttttgatagatctggatttaagtatcatggccgaataaaggctcttgctgatgcagctagatcagcagggatgaagttttaaaataaaggtaattgcggtggctaaaacaacgagatctacaagtacaaaaactcaagacgaaataaaggctgatggattgaaagaaaaaatgatttctgtcaatcgtgttaccaaagttgtaaaaggtggtagaattcttggttttgctgctttaacagtggttggtgatgggaaaggtggtatcggcatgggtaaggggaaatctagggaggttcctttagctgtgcagaaggctatggatgaggctcgtcgtggaatgattaagattaacttgataaatggtacgcttcatcatcccataattggtcgacatggtgcagccagggtgtatatgcagccagcttcagaagggacgggaattatcgctggtggtcctatgcgtgctatttttgaagtgatgggtgtacataatattttagctaagtgtttgggttctacaaatccgtataatatagtgcgagccactctgaatggcttagataaaatccaaacacctgcaatgattgctgctaaaagaggtaaaagcatagacgaaattactggggcctgatttaaatggaaaaattaaaatctataaaaataaccttggtaaaaagtttaattggtgcaaaaaagagacatagattgataatacaaggtatgggattaaggaagattaaccgtacggtttttttgccggatttaccttcgactagaggtatgattaataaaacagcatatctattgaaagtagaggaataaaggtgagacttaatactataaagcctggtatgggttctacaaaacccagaagaagagtggggcgtgggattggttctgggttaggtaaaacatgcggcagagggcacaagggacagaaatcgcgtgcaggcggttttcataagattggctttgaaggggggcagatgccattgcaacgcagattgcctaagagaggttttgtggtctatgggaaaaaacaaatacaagagattaaactatctagtttgttgttaattgatcggaatgagtttgatacatctgtattgcatgaattcaaccttataaagtctattaattaccctgtaaaaattattgcagatgctcaggcttgtacacgagccataaggctaaaagatttaagagtaactcgaggtgtcaaagatatagtagagcacgcgggtggtcaggttgagttaactatagaagatgtaaatggtatctaaatcaaaagctgctttgtctgatagattctatgatttaaaaaagcgattgtggtttttgctgcttgctttgattgtgtatcgcattggtacacatgttcccgttcctggaattgattcggttgtattaaaagatctttttaactcccaggaaggtggaatactgggaatgtttaatatgttttcgggaggggctctttcaagattttccatatttgcacttggaattatgccctatatatcggcatctattattatgcaacttggaacagtagctgttccatatttggaatctttgaaaaaggaaggtgagtcaggcaggaaaaagataacgcaatacactcgttacggtacactgctactttctacattacaaagctatggaatttcctttgccttgcaatcacagcctggcttagtggtggagccaggaatgcattttatatttacaacaatcattacgcttgtaactggatccatattcctcatgtggcttggagagcaaatcacagagcgcggaattgggaacggaatttctttgataatttttgctggaatagcagctggatttccaagtgctgttggggggactcttgagctggtaaatacgggcgcaatgcatttttttactgccttatttatttttattgcagctatagctattacagcgctggttgtctttatagagcgtggccaacggaaaatattggtaaactacgcaaaaaggcaggtaggtaagcagatgatgggtggccaatcatctcatttgcctctaaagttaaatatgtctggagttatacctccaatatttgcttccagtattattttatttcccgcaactttagctggttggttttctgacagtctgtctctaaattggttaaaagactttagtaatacgttggcacctgggcagcctatttatgtcgctttatatgctgcattgatcatatttttttgttttttctatactgcactcgtatttaatccaaaggaaacggcagataatctgaaaaaaagtggggcttttatacctggaatacgtccaggtgaccaaactacgaaatatatagagcgtattatgttgaggttaacattaattggttcaatttatgtcacgctagtttgcctgttacctgagtttatgattttgaaatggaatgttccattttattttggaggaacttcgctgctaataattgtcgtggttaccatggattttatggctcaagttcaatctcatgtgatgtcaggtcaatatgagagtctgttgaagaaagctaactttaaaaccagtggtaactttttacgatagttgggttgtgatggcaaaagaagaaactatacaaatgcaaggagaggttattgaaacgcttccaaatgcaacgttcagaataaaattagagaatggccatattgtactaggccacatttctggaaagatgagaatgaattatattcgtattttacctggtgacaaggttacagttgatctaacaccctacgatttaactagggcacggataacttttcgcaccaagtagttactgtaattattacattacataaatattatcgtgagtttattatgaaagttagagcatcaattaaaaagatatgtagaaattgtaaaataattaaacgttatggggttattcgtgttatttgtgtcgatgccaggcataaacaacgccaaggttaattatcgtttttaatatatagggtaaaaaatggctcgtatagcaggcgtcaacttacctagcaataagcacgttaacatagctttgacggcgatttatggtataggaaattcgacagcacgtaaaatttgtacggatttggatattccaccgtttattaaacttaaagagttaacggatggtaagttagaagaattgagaaattctattgcgaagctgctggttgagggggatttgcgcagagaagtctctatgaatattaaaaggttgattgatcttggtagttatcgtggattgcgacatcgtaggggtttgccagtaaggggccaacgaacgaaaactaatgcgaggacaagaaaaggtccacgtaaagctatacgtgctagataattttttcgccaatttaattttaaagtagatcagaaattaatgataaaacctccattaaaaagccgtaagaaaattaagaaaaatattattgaaggagttgcacatatacatgcatcttttaacaatacaattgtgacgatatctgatcgacaaggaaatgctttgtcttgggctacatcgggaggagtcggattcaaaggatcgcgtaaaagtactccttttgcggcacaggttgctgcagaacatgcgggcagagctgcgttggagtatggcgttaaaaatttagagattagagttaaaggacccggacctggtcgtgattcggctgtaagagcgcttaatgctacaggttttaaaattacaagtattactgatgtgacacctgtgcctcataatgggtgtaggccgcccaagaagcgtcgtatctaagaaggagaaaatctgtggccagaaatataaacccaaagtgtcgtcaatgtcgtcgggagggagaaaaattattcctgaaaggtgacaagtgttttagtgataaatgtccaatagagcgtagaaattatccacctggacaacatggacagagaaaaacaagactatccgattatgctgtgcagctaagagaaaagcaaaaaattagaagaatctatggcttgttggagaatcagtttcgtaatgtatataaacgagccgatagacaaaagggtattacaggtgagaatttacttaagcttttagaaagccgtttggataatgttgcatataatatgggatttggggcatcaagagctgaagcacgacaaataattagacacgattgcattcttttaaatggtaaaaaagctaatataccttcacaattaatagggccaggcgatcaaatagaggtggctgagcatgcaaagagttatttgaggatcaaatcttcaattgaattagccaagcgtcgtagcattccatcctggctggaggttgattttgataaccttaaaggcctttataagaataaacctgatcgcagtgatttatcttcaactattaatgaatctcttgtagttgagctttattcaaagtaatcggcattttttatattggcacctatatgtcatcgaatagttttcttacacctaggattatagaggtacataatctctcgcctttacgcgctaaagttgtaatggagccttttgaacgaggctttggttacactttaggtaatgcattacgtcgcgttttattatcttccattcctggttgtgctcctactaaaattagtattagcggagtggttcatgaatattcaacgatagatggcttacaggaagatatcgttgatctgatattgaacttgaagggagttgtactaaaacttcatagcaagaactctactgttctttctttaaagaaagatacggagggtattgtcacggctggagatattgaatcttctcacgatgttgagatagtcaacccagaacatgtgattgctcatattactagcggtggccgtattgaggcgcaaataactgtagaaaaaggaagaggatatttaccttctgttaatcgtagtcgagaagataaaagtttatcttctatcggcgatatactgctggatgcttcatttagcccggttagacgtgtcagttacacgatagaaaatgcacgtgtggagcaaagaacagatcttgataagctgattatcgatattgaaacaaatggttctgttgatccagaagaagctattcgttatgcagcaagggtattggttgaacaattttctttttttgcagatctagagagtactccattgcctactgagcaaccgagagctcctgcaattgatcctattttgttgcgaccagttgatgatttagagcttaccgtccgctctgcgaattgtttgaaagttgagaatatattttatatcggagacttaatacaacgaacagaagctgagcttcttcgcacacctaatttaggtagaaaatcattaaacgaaattaaagaagtactagcttcacgtgatttatcgctaggtatgaaattagagaattggccgccagctaacttagaaaattatgtaaaggaaccgggacatgcgtcatcgtaatggattgcgaaaattaaaccgaacctctagtcatcgtttggctatgttcaggaacttaactaattctttgcttgaacatgaaattataaaaaccacgctccctaaagctaaagagcttcgtcgtgtagtagaaccggtaattactttaggtaaaaatccaaccttagctagcaaacgattggcatttgatagattaagaaatagagaaaatgttgttaaaatcttttctgaattgggaccgcgatatcagaatcgaaacggaggttatttaagaattcttaaatgtgggttcaggaagggcgataatgctccaatggctatcgtggagctattggatagatctgaagctaataatgatattgcgaatattactgagtaattaatcgttgatttaatagttctgtttttgaagctgtagattttatctattttttcatatttaaaacataactatttagctacatcactccatttcaatatttctaggtaaataattgattggagtgattttaatttgtctcttctaaatatatttcgcattgacctgacaattttattatttcacgaagccgcagtaactcagttggtagagtagctgattcgtaatcagcaagtcggaggttcgactcctctctgcggcaccatgattctgttagttgatttttaacttattgaaattagcatgaaaagctattgggatcatgatccccttattttattatattctgacttgattttcagcttgcgtttttctttgggatctgagattaaaggtctgtaaatttcaatgcgatcgttttgctggagcacggtttctgagcaggccacttttccataaatccctattttaagagttgagcaatcgatctcaggatagaactctttcatttctgcaagtttaattgcttgattaattaaagttccttttggaacttgaagtcgtttgataaaatgtcgttcggtcagtgcagcgactatttctatgataataaaatccttcctaaatactgggtccataaatctcttctgctcgttccacgaaagcttctacaaaactattggctattatgtaaaatactgggccgatcagcttttctaaaagtttgtgagaaaatgtgtaatgtaatttaaattcaattttacaagcagtatctgttaaaggaatgaagcgccagtagccattaagtttttcaaaaggcccttcaagcaattccatttctatcaagtcgggtgggtggcgcttgtttctcgtagtaaagctatgttttacaagatggtagtcgatatttattgttgcatgtgctgtttcgttgtcctccatgagtttcattgatgcacccgagcaccagggtagaaagtcgggatagttctccacggtatctactaaatgaaacatttgggcagatgaataccccaccaatacagttttttctatttcagtcataatgttgtattctcatagtctgggtgtaaagatacagaaaactgatacactaatgcgctaatcaaatatttttatatgcatatattttcttccagctgttttgaatgagcattgcacaaaacaaaaaggctttccacgattatttcattgaagaaaagtatgaagccggcattgtgctggaaggatgggaggttaaggcaattcgtgccggtcgggttcagttgaaagaagcttacatagttatccgcaagggtgagttatttcttataggatgtcatattagtccgctgccgacagcatcgacacatgttaatcctgaccccgtaaaaacacgcaagctgttgttgcatgctttccagattaaagaactcatcggaaaagtagagcgtgcgggctatactctggttcccttagatatgcattataaagcaggtaaaattaaactggaaattggccttgccaagggaaaaaagcaatacgataaacgtgaaagtgagaaacgtaaagaatgggaacgtgataagcagcgcttgttgcgtatgcgccattcctgattaatatttatgcaaacaaattcatctaactccgttccttcggtaatttctgataagtatactcaaaatcatatacctattgctatctggttgctgatttgctgtgcgttggtgtttgccatgattgttgtgggcggagtaacgcgtctgacaggttccgggctatcgatcgttgaatggaagccaatagttggaacgattccacctattggccaggaagattgggaagtattgctggagaagtaccgtcagatacctcaatacgaacaagttaataaaggtatgacgctggatgaattcaagggaatattctggtgggaatattttcatcgtttgcttggtcgcctgattggtctggtttatttcataccatttgtctatttcatggtgcgcaaacggattgatcgtttacttggtttaaagctgctgggtatattcgcgcttggtgctttgcaagggttaatgggctggtatatggttatgagtggactggcagataatgtttatgtcagtcagtatcggctgactgcacaccttggtctcgcttttgttatttatgctgctatgttctgggtggctaccggattgctttctcccttaaatactcatttgtcagacccggtattcgtacataaacttaaaaagtttgcctggatgctgactggactgatattcgttatggtattgtccggaggattggtagcgggtattcatgccgggagggcgtataacacatttcccttgatggacggctttctgattcctcccgctatgtttgtgctggaaccttggtatcgaaacttttttgataacatcactacagtacaatttgaccaccgcttgattgcctggttgcttattttttctataccatggttctggttcaaggcaaaacagttatcattgtcttactctgctcgcttggcttgtcatctcctgctgttgatgctgctcattcaagcagggcttgggattacgacgttattattgtcggttcccctgacgtttgctgcagcacaccaggcaggtgctgtgctgttattcactgctgcattgtgggtttgtcgtaagctatcctgacggtaaatatgtgttttttctaatggtgatacgccttttttagtagatgagaccttgggaaagaatcaataaccggtacaagagaatatgctgatggaaggatcaataccggggtttgggcgtcgtatgctggcgttggcttacgaatttttgttgctgctgggtgtatggtttatcgcggccttcctgttccacctcgtttttcaggatacatcagctgaatactttaggcccttgtttcagttttatctattgtgtattggtggtatctatttcatctggttctggacccatggtggccaaacgctggccatgcaaacctggaagttacgacttgtttctgagaatggtggaaaagttactatgcaacaggcgatggtgcgctacctcatggctgtaataggcattagttttctgggatttggattgctgtgggctttatttaatcgtgatcgacaatttctgcatgataagctggcaggtacgcggatcataagactcagttaagctggaaaagctacggtggatcttaagggggattttataatccggccacggtattcttatttctgtaaggtttctgatggcagttgcttgctttgcagttacggcgttgttctgtttttttattatgtagcctgaaacatactgtattcaggtgctatcttaaggtagaatgagcgcatggcgggcctccccgcattgtaagatagtgaatctggtcagatccggaaggaagcagccacagctattttttacaagtgccgggggttcggctcgccacctgtctttatacagattgcagagtctgtttctttgcagcttcataataaatccgggttgtaataatctcttctcgataaaaaaccttgacggattctcaggcacttgcccgcaaatggcgccccaaagacttcacggggctggttggacaagaacacgttgtaagagcactggtcaactcaatggagcagaaccggttgcaccacgcatacttgtttacgggtacgcgcggggttggcaagacaacggtagccagaatcttggcaaaggccctgaattgtgaacagggagttactgccacaccttgcggcaagtgtgcggcttgcctggcaattgatcaaggaaattttgttgacctgattgagctggatgcagcatccaatacacaagtggatgccatgcgtgagctactggataacgcacaatatgcaccagttacggcacggtacaaggtctatctgatcgatgaagtgcatatgctttccaagtcagcatttaacgcaatgctcaaaactttggaagaaccgccagagcatgtcaaattcattcttgccaccaccgatcctcaaaaaatacctgttactgtattatctcgttgtctgcagttcaacttgaagcagatacccccttctctgatcgtgacgcgtctgtccgagattctctccatggagggaattgtggcggatgcgactgccttgaagttgctggcaaaagctgcgaaaggaagtttgcgtgatgctctgagcctgctagatcaggccattgcactcggtaacgccgcagtggatgaaaaaaatactcgtgtgatgctgggagcgctggatcaggatcatttgttcgcattactggaagcactggcagagcaggatggagcggcattgttagctattgctgatcagctagaagcagcgagtgtatcatttgattctgccttgcaggatctggcagcattgctacaccggttggcaatagttcagatcgttccacagatgcttgatgaagaacagccggagagtgacaggttgctcgccttggtaaaatgtttcacgcccgaggatattcaactgttttatcagattgcactgcacggacgtgctgatcttggtcaggctccggatgagtacagtggttttaccatgacattaatgcggatgctggcctttatgcctcattctcaacaatccagtcatccggtgcacgcaagtaccaatgccaatatcactcggaaaattaaatctgagctgcctgcagattccaggaagcaggaaaaatcaatagagaaagattctccgaatgacacctggcttgcgctggtaaaccaattggaattgagtgggatgacacggatgctggcacagtacagtgaagcaaaacacttctctgcgaacagaatagaattgtgtgtggcagaaatgcacaaacatctgctggaaaaatcctatcaggacaagttgaaatttcaactggagtctcattttgggaaacccgttgaagtgatttttttgctggggagtattactggtgttactccagctgtattacaggatcgcgataagctcgcaaagcaatcccaggcagttgaggcgattaaatcggatccttatgttcaggaactggtcgaacaatttgacgcaaaattgaatatttcttccattaaaccaattaattaacggagattgtaaattgatgaaagccaatttgggcaatctgatgaagcaggcccagcaaatgcaggaaaacatgaaggctatgcaagaaaagctggcaacgattgaggttgagggccaggcaggagcaggtatggttaaagtgaccatgacttgtcgccatgatgtaaagcggatcaatatcgatagcagcctgatcggagatgataaggaaatgctggaagatctggtggcagctgcgatgaatgatgccgtacgtcgggtagaagccgcaacacaggaacatatggcgagtgtaaccagtggcctgggattgccggcaggaatgaaatttcctttctaaattgtttggctgcgtgtttttgacagaccgactacaacacaggacttatattcatgtcggttaatcggctaaagaatcaaaagcccaggcgcacgcacagatcatctcctgcctcgaagaacctcagtgctgcacttcctgccgaaactgacaggttacagaagttgctggcacgcaatggcttgggttcccgacgggaaattgaagccatgattgcagccggtcgtgtgagtatcaataatacgacggcaaaactcggcgatcgagctgggctcggggataagatacggattgatggaagaattatccgacttagcatgcctgcacttttgccacggattatcatttaccacaagccggagggggaaattgtcagtgcgcgtgatccacaggggcggccatcggtattcgataaattgccgcacatacagtcttccaaatggatagcaataggcaggctggattttaataccagcgggttgcttatttttacaaccgacggtgccttggccaatcgcctgatgcatccgcgttaccagatggagcgggagtacgcagttcgcattgttggggagctgtccccggaacaaattactcatttgactactggtattgaactggaagatggttcagcaaaatttgatcagttgcttgatgaaggtgggctgggaacgaatcactggtatcgcatcgtactgaaagaaggtagaaaccgtgaggttcgccgaatgttcgaagcgctggggataacagtcagccgcctgatgcgtgtcaggtttggccccgttaatctcccgcccagacttaagcgcggtatgtggctggagctggtcgatacagaagtcgaacgattactggcgctgatcagttagctcgcttccggacaaattcctttctacgcttacaagtcgcatcgtctcaccattagaagaaactgatctcctgcactggcttccaaccaggtacaggacagctggggaaatgcttgctcgatttcggcctgattgtggccgatttccatgatcagcaagccgttttcggtcagatagtcggctgcttctctgagaattcggtgaacaatatccagcccatcaagtccgcctgccagggcgatagcgggttcgtggcgatattcttcagggagcgttgccatggatgcagcattgacatagggaggattactgatgattagatcgtatcttttaccttgcagcccggtgaaaagatccgcatggatcaggttgatccggttcatcagatcataatttctgatatttatggatgccacgtccagtgcatcggaagaaatatccatagcatcgatttgtgcctgctcaaaggcgtgtgccagtaaaatggcgagacaaccggagccagtgcataaatcaagtgctgaattgatgtcatgtggatctattacccagggagacaggcgatcatgtagcaattcggcaataaatgaacgcggtatgatgacacgttcatcaacatagaaattaaaatcacccagccaggcttcgtgcgtcagataggcaaccggtattttttccctggcacgtcgttcaatgatacggagaacctgatcacgctcattgtatgtaagcatggcatccataaaaagatccagctgatcagcgttcagatacagtgcgtgcataatcagaagcgctgcttcatcataagcagtcggcagaccgtgtcccaggaaaagatcggatcggttgaaatagcttactgcaaaacgcaacaaatcacgcaaggtgcgcaattcttcccctgcctggaggatggtagtgttattgggctgtctggtataagtcatgattcaatccgagtttctccggaaagcaatttagcataaaaaaactgatgaaagtacaggttatccgggtgccggttcaggcagaagatgagtatttcatgcgtcaggcgctggatcttgctcgtgtggcgggcgactcaggggaggttccagtcggtgcggttgtggtcagaaatagccagattgcaggttacggatataactgtcctgttacgttaatggatccgacggcacatgctgaaatcatggccttgcgtgatgctgccaacaaactgggaaattaccggctgccagaatgtacgctgtatgtcacacttgagccttgtgtgatgtgtatcggttcaatgtttcatgccagaatcaaacggctggtttatgctgcgaaggatccaaaaaccggtgtgtgtggcagtttgcttgatttgcctgctgatacccggcttaatcatcacttggtggttagtcagggtgttctggcggatgaagcgagtaccttgctgaaacagtttttcattatccggcgcagtacaaaagagcgcgatacaccatgaaaattatcgttgatatttcgttgcaacaaatgactctacaggatgtaacaggacatattgtcaggtgttacccaatctcttccgcaaaaaatggtactggacagcaacgtggcagttttcacacacctttgggaaagcatattattcgtgccaagattggacagaatgtacctgttaatacagtgtttgtccggcgtcgccccactggagaaatctatacatcagagctggcggccaatcacccgaatcgggattggattctgacacgcattctctggctttcagggtgtgagctgggatttaatcgcctgggttcggtcgataccatgcggcgctacatttatattcacggcagtccagacagcgcggagatgggtaaacccggatcgatcggctgtatccggatgcataatcacgatctattagatctgtttgaacgggtgtctgttggcacgctagttgaaatcaatgcctgaccgctttgggacgtaatcaagaggatggtgatatccaacacatcctgaccaggaaaatatcatgaaatcattatatggcaagacattactgaacgatccggtgcagaacaaatccaccgctttcacccgagaggaacgtgaacattacggcttgcaagggttactgccatacggcgtgacggatattaaaaaacagcagcaacgggtactggccaatctgcgcaacaaaagcagcaatatcgaaaaatacatttatctgaatgatctgctcgaacgcaaccaacagctgttttaccgcactctggtcgatcatattggtgaaattatgccattggtctatacgcccactgtgggcgaggcttgtgtaaagctttcacatattttcagaaatccgcaagggttttacattacgccggaagatcgcggggaaattatatcccggctcaaaaattggccagaaaccgatgtgcaaattattgttgttacagatggcgagcgaattcttggcctgggtgacttgggagcaaatggtatgggaataccaatcggcaaaatatctctgtatgtagcttgtgccgggatttatcccgatcgatgtatgccggttatgctggatgttggaaccggtaatcaggcactgcgagaggatccgctctatctgggttatccctatccccggttggtcggacaggattatctatcgctggtggatgaatttgtggaagcggtacagcatcggtatccggatgcgttgatccagtttgaggatttcagcagtcggaatgcatttaccttgctggatcgctatgccgcatcagttcggtgtttcaatgatgatattcaaggcacagctgcagtgacgctggcgggtatctatgcttcctgccggattacacacaaatcgtttgctgatctgaaaatcatgttactgggaactggatctgctgcaaccggtgttgccgaattgctgctgccggcattcaaggcggccggattgggtgaggccgaggctcactctagaattagttttattgatagacagggtttggtgacagctgcacatgagctgattaaaccgcgtatttgtccgtttgtgagcgaacgtgaggcaatgagtttcgttgatgcgattaccgctatccagccggatgtgctgattggcgcaacaggaacagcaggtgcgttcaatgaagcagttattcgcgagatggcccgttgccaggaacgccccgtgattattgcgctttccaatccaacttcgcatacggaatgtactgctgaacaggcttaccggtggagtgaaggacgggttatttttgccagcggcagcccgtttgcgccggtaacatttaataaacgaacccattacccggcgcagggaaacaatgtatatatctatcctggaatcgggttaggtgtcatggccagccgtgcgcgtctggtggttgagcgcatgtttctggttgctgctgaagaattggcaaatcgtgttttgtctggggaaatcgagcgtggatcaatttatccggatattgcccgggtacgcgatatttcacagggcattgccatcaaagtttgtcaggtggcttggcaggatggcctggcgggtggaaatctgcctgaggatctggaagcaaatgtgcaagctttgatctatgaacccggctattgaaacaggagtggtgtccccctgccttacggtataaagcaggggattgatttactcaaacaggttgaggataccgtcgagaccgacgtgattaagagaaaaggttgctttttcctttaatacaggttttgcatgaaaggcaatgccaactcctgattcttccagcattttcagatcattggcgccatcgccgacagcgataacctgatctttcctgaggccgagctcatcccgtatccgtttcaagatttctcccttgccggatgaaccgataatgttgcccaacactcgtccggtcagtttcccatcctgtacttcaaaagtattggcgaatgcataatccagcccaagccgatctttgactcgatcggtgaagaaagtgtagccgcccgagattaccatggtcttaataccggcggattgcatgcgttgcagcattttttcagcccccaggctcaatcgcacgcgctcatcgtaaaccttctgtagtgcttcctgtggcagcccttcaagcagggcggtgcggcggataaggctttcggcaaaactgatttctccgcgcatagtgctctgagtaatggcggaaacttgcggtttgacattgtgcatgtcggcaatttcatcaatggattcgatggcgagcagggttgaatccatatccatagagattaaaccaaaatcgcttaattttttgcctggcggaacaaaagcatgatccaggttggtctcttcacaatagtcaggaatatccggatgcagttgagcatttatcatccggaaagcttccccggtgatacgatcaatctggctggcttgtgcgagtttggcaattgcccgtaaatcattgttctgtatatctgtaccttgaataataagattcatgagaattattttaatttgattaagtgacgaatgcaggcactatacatggaatgtcgtactatatgaatatcggccgggtaggtgcgatcaggtttttaagggtgaagtcagcgccggattccattcaacaacccggttacgacctgcatatttggcggcatacagcgctctatcggctgcttccagcatttcactctggagatcaaaagacttttccttatccatattggtagccaggccaattgaagccgtgatgcggatagtactggcttcattcggtttataggcaattgtagcgatactttccatgacccttgccaggatgtgacgtgcagccgaaagagtcgtgcccgggagtatcagagcaaattcgtcaccaccataccggcagaaaatatcggtttgacgaatctgatcagtaatggctttggctacagttaccagcacaccatctcctgcaatatgcccataggtatcgttaaaagttttgtagttgtcaatatcaatcattgccagagcaagagacgtcccctgctgaattgaaagctgaaattcactccggaatgctccatcgaagtaggcgcggttgtgcgcgccggtcaggccgtcatgctgaattttgtcttcaagctcgcgcactttgatcatagctcgcattgtcagtaactctcgggcctcagtgatgatattgtcaaggtgggcagggttcaggatagtgatttcaaatagctcttccacatggtgcagatcattctgcatggcttccagaacttctatcaatgcatgtccgtcgagccccaaataggcctccgctatgcgggttgtttcatcaattttttcttttttgtcaggcgacaggaaataatccgtaatgtagccagatactgcaacacattcgttgatgccagcattagggatatctggtgcagtatgactgttccggcaggcagcaggtgcgtagctgggaaatttccagtattcgagtaatgctgcacccagctcgtcatgtcctatatcgaatgtttggcgttcagcctccagaagggcgctgtggtcctcagcaagtgaaaataccggtggataatcctcaggcatgagagcgtgaaaggcaagaatgccgatgtcctgtagcagccccgccaagaacagatcatccagtattttgtccattgccagacgtttgcccaaagtgcggctggctaacgcagaagtgatcgagcggcgccagaagctattgttgccggccatgcccagtttctctctggactgttttatcagagaatctgccagagagaaggacaatgctattgtaataacaccgtatgttccgagaatattggtagcctggctgatgttactgatcgggtatctggatttatacagcggggaattggctgtcttgataattttggcggcaagcgcgggatcatgcgagatataatgattgatctgcggaaggctggtatctgctttgccggcaagatcaataatcttgagcgcaacagaaggcaggctaggcaaattggtacagaaccgcaattgcttgagcagattttctttcatgtttccattaccaaggacgtgaatagagcgtttgcttactcattccggatttacagggaaaaatgattttacccgatataattccatgaaaatactgaaaaagagccgttaagtaaacctatttgtgctgaatgtcgaaagcataattccgaatattatggcagggaattcggttttttgatttgaaatcagagacatgaccatagtccgattcgtattcattgtcaaaaataaacaaataaaacaggagtaaagcatggacttcgcaatccaagcgggcgatctggggaaatattatggtgactgtatcgtggcgggcgtgttcgagtcccgtaagttggctgaggcggccaaagctttggacgaaatgtgcagaggttatctgaccaaggtgcttgaccagggagacatggacggtagagcaaatacaactttactgctgcacaacgtcccggctattggaagcaagcgggtgttgctggtcgggctgggcaaggaggaagaatacgtagaaaaggtattcctggaggccattcgtgcagcttttaaagcactgcatcagacaggggtcaaagatgtcggtttgtgtgtggcagatttgattgtaaaaggaagggatactgcctggagcgtactgcagtcaaccctcctggtagaagaaagtatgtaccgctttgatcggctcaaaagtaaacgtgaggaacgtcagccatccctgcagaaaattatctttcttatcggggatgaagctgcaagggcaggcgcggaacaagcatttaagcagggagcagctattgcgtgtggtatgaatgtaacgaaagatttgggtaatcttgcgcccaatatctgtactccgacctatttggccgaacaggccggcgaaatggccaaaacatacaatctcaaactttccgtgctggaagaaaaagatatggaagcgctcggaatgggtgcattgctggctgtggcacgtggcagccatcagcccgccaagctgatcgtactggagtatcatggccgggaaaacaccgagaaaccagttgtactggttggaaaaggtgtcacctttgataccggcggtatctcactgaaaccggcagctgatcttgatgaaatgaaatacgatatgggcggcgcagcaagtgttttcggtacgctgactgctgtggcggaaatgaagttgcctatcaatgtaacagccatcattcccacaaccgaaaatatgccaggtggcaatgcaaccaaacccggggatgttgttaccagtttgtccgggcagacaatcgagatattgaataccgatgcagagggacgattgattctgtgtgacgcgctgacatacgccgaacgttacaatccggaggtggtggttgatattgccacgctaacgggggcctgtgtagtcgccctggggcatgtggtcagtggcctgatgggtaccgatgagccgcttgttcaggaactgcttcaggctggggaaaaggcatctgatcgtgcctggcggctaccactgggagaggaatatcaggaactgctcaaaagtaattttgccgatatggccaatatcggtggtcgctggggaggagcgattaccgcggcctgctttctttcacgttttaccaggaaataccgctgggcgcaccttgatattgctggaacagcgtggaaatccggcaaggagaagggtgcgaccggacgtccggttccgctactaacacaatttctgatcgatcgtgcacaacagcattaatatcagctggtactctaatttctgcgggcaggtgtgacacagattgatttttacacgggcgcaaccgacagattgctgatcgcctgtcgtttgtgttcgaaagtagtacagcagggattgaaaacagttgtttatattccggatacagaattggcaaaccggttcgataagttgctctggacgttttccccaaccagttttgtcccacactgccaggcagatgacaaactggcgggggtgacgccagtggtcctgaataatcagccagaaatgccggaagtggcttacttcgatgtgctgcttaatctggatgcggcaattccatccggatttgaacattttaagcgggtcgttgaaattgttgatgaaatagaggacagcaagctgcatgcacgcaaacggtaccggcgctaccaggagttgggacacgacattcgccatcatcggcttgaggaaaattaactgattccgagctatgcacaagctctctatattctcggactttgagtttactatctgatcaggagcaatctggtggcagatgatcaacccgatataacgcaggaaccggaagatgaaatcctgctgaataaagtagattcgatgttgcgcagacatcgacaggaacaatcttctctcatgcagcctgtagagcagattattgtgagctcatttgattccctggaacagctttcttccgtatccggtgaattgcccagggatattgccgagtcagcacccgacattgacgggattcctgttttgactgatcaggtgacactgacgatagatgaatggccatccccaacagaaatttccgagctgttgtatttcgcctttgatgcagcattaagggaagcatgtatcagtctgaatcctgctgaacggttgaccctgatccaggctctgggaaaacggctgcccaaaaatatttaatcttgccttcgttcgttataatggccggtttcattctaccgctttactttgtgtctgattgtcatggaactcgcaaaaagctttgatcctaaggatatagaaaatcactggtactcggtttgggaaaccgccggctacttcagtccggtcaaacgggaggaggttaatgcctactgcatcatgctgccgcctcccaatgttaccggtacgctacacatggggcatgctttccagcataccctgatggatgcactgatccgttatcaccgtatgctgggcgacaacacattgtggcaaccgggcacggatcatgccgggattgccacgcagattgtggttgagcgccagctggatcaggaaggaaaggatcgtcgccaaatggggcgtgaagcttttctggagcgagtttggcaatggaaagaagaatccggctccaccattacccggcaaatgcgccgtatgggaacttcctgtgactggtcgcgtgaacgctttactatggatgaagtgctttcccgtgcggtgactgaagtattcgttcgtttgtatcgggaagggttgatttaccgtggcaagcgcctggttaactgggatccggtattgcaaacagcagtctccgatctggaagtggtgtcagttgaggaacagggatcgctttggcacattctttatcctttcgaacatcgggtagaaaatggcgagaaaggtctgattgttgctaccacacggcctgaaactatgctgggtgatgtggcggtggcagtacacccggaggatgtacgctaccggcatctgattggacatcatgtgcgcctgccgttgtccgagcgcacgattccgattattgcagattcctatgttgatcccgcttttggtacagggtgcgtaaaaatcaccccggcacatgatttcaacgactatcaggtagggttgcgccacaaactgataccacttagcatttttacgctggatggcaagatcaatgacaatgccccggttgaatttcagggattggatcgttttgatgccagaaagaaagttattaccgatctgcaggcacaggaattactgattgaaactcgcccgcataaactgatgattccgcgtggggatcggaccaatacggtgattgaacccatgctgaccgatcaatggtatctagcgatggaaggcctggccaaacaggggctggcagcggttgaaagcggcaaggtcagatttgtgccggagaactgggcgcatgtctataaccagtggctggaaaatatccaggactggtgtatttcacggcaattatggtggggacaccgtatcccagcctggtacgatgaagatggcaacgtaattgttgcatatgatttggaagaagccagaaaactgtctggtaaggaaaccctgcatcaggatgaagatgtactggacacctggttttcttccgcgttatggcctttttcgacattgggctggccggaacagacgcctgagcttaaaaccttcttgcctggatccgtgctggtaaccggatttgacattattttcttctgggtggcacgtatggtgatgatgtctctgcatttcaccggcgaagtgccctttcgggaagtgtatatcaccggcctgattcgcgatgcggaaggccagaagatgagtaaatccaaaggtaacgtacttgatccgcttgatctgattgatggcgttgcactgacggagttgatcagaaagcgtacgaccggcctgatgaatcccaagcaggcagaatccatcgagaaggccacacgcaagcagttcccgcaaggaattcccgcattcggggccgatgcgttgcgctttacctttgccagcctggcctcgcatgggcgcgatatcaagtttgatctacagcgctgcgaagggtatcgcaatttctgcaacaaattgtggaatgctacccgttttgtgctgatgaattgtgagggtaaggacacaggattggatgaagggctgccactgaatttctcaccagcggataaatggattattggtcgtttgcagcaagctgaacagggcgtaatacaggctttcaatgagtaccgatttgaccttgctgcacgtgagatgtatgaatttatctgggatgaatactgcgactggtatgtagagctggcaaaagtacagttgaacagtgaagatgaagcacggcaacgtgccactcgccgtacattggtgcgggtattggaaacggtgttaaggcaagcgcatccgatcatcccgttcattacagaggaactctggcaggcagttgcgccgcttgcaggtaaaacgggggccagtatcatgtgtcagccttatcctcaacctgatcagttacgtattgacgagcaagctgctgcggatattcaactactcaaggaagtcgtgaatgcttgtcgtacgttgcgcggagaaatgaaactgtcaccggcagaccgtataccgttattgatagaaggtgatcgtgcccgattgataaatttcttgcctcacttgcaggcactggccagattatccgaagtggatatcctgccaggtgggttaccggatactgatgcaccagttgctgtggtgggtgatttcaggttgatgctgaaaatagagatagatgttaaggcagaacgtgaacgcctcaacaaggaaatactccgggtggaagctgaaatcagtaaagccagagcgaaactggacaatcctgattttatccaacgtgcgccagaaaaagtggttcagcaggaaaaagggcgcttggtcacgttcagcacaaccttgaaaaaacttgatgaacagttgcgaaaactggattgaccattagtcgctgaacgatgatagaagtacagttatgtacgattcttttcttacgttaatttataaacctttttgagatttaatctatatagacaatgaccagactggaaaatgatacttttattcgcgcactgctgcggcagcctgtggactatacccctgtctggatgatgcgccaggctggccgctatctgccggagtacaaccagacgcgggcgcgtgcgggtgatttccttgccctatgcaaaaatcccgcacttgcaacagaagtgactttgcagccattggacagatttccgctggatgcagccattttgttttccgatattctgactatcccggatgcaatggggttgggattatatttttcgacaggagaggggccacgcttcgagcgcccgttacgtgaagaacgagaaattcgctcattgatcgtgccggacccgggtacacatttgcgctatgtcatggatgccgttacagaaattcgcaaggcgctgaacaatcgagtgccattaatcggattctcggggagcccgttcacgctggcatgttatatggtggagggtgcaagcagtaatgattatcgtcagatcaaaaccatgttgtatacacgcccggatctgctgcaccatattctggaggtaacagcgcaagcggtgatcgcctatctgaacgcccagattgaagcaggtgcgcaggcagtgatgattttcgacagctggggtggtgcgctatcccatgccgcctatcaggagttttccctgcgttacatgacccagatcctggaaggattaaaacgtgaacatgacggcgaacgtatcccgaatatcctgtttaccaagggaggtgggctgtggctggaatccatcatggccagtggttgtgatgccatcggattggactggacgattgacattggcgaagcgcgtcggcgtacgcaagacaaagtagctttgcagggtaacctggatccagctgtattgttttcctcaccggaagcaattgctgctgaagttggaaaaatactggcaagttatggtcatgggcatggccatgtatttaaccttgggcatggcatttcccagttcactccgccagaaaatgcaaaagcactgatcgaaacggtgcatacgcaaagcgttcgctatcatcaagtcagctaatttttagtatgggcagcgggttatcagaaattgataacccgtttttgttgtaatcgtcaatattctgctgggtttatagccggaaaggaaagttttcagattatttcactgtagggttgttaccaaatatctatagaacctgagaattggtggattcttttattttgcacgaagatataaaatcttttgggttgctccgggcgcttgtctttcttctgtcacgaaaagatctatccttgctttgacaagatccgagagctttttataaccgtaaagtctggagtcaaaatcgggttgcaattttgtgagatagctcccaaaggttccgatctgcgcccagccagtatcatcactagattgttcgagtgcagcgagaacaaatttctttggaaatacctgttttggttttgcttgattgttggctgactgaacagtggcattctttgagtcatcacttgctttgtgcgtggttatatcagattctgtatcgccgcctggacgtaaaatttctgtaaatataaatttgtgacaggcgttgcggaatgcttcaggtgtttttttctcaccgaagccaaaaacagtgagcccttcttcacgcaaccgcattgcaagacctgtgaaatcgctatcacttgtaatcagacagaatccatcaaatttgcgtgtgtagagtaaatccattgcatcaatgataagggtactgtccgttgcattcttaccggtagtataggcaaattgttgaacgggcttgattgcatgtcgttgtaatacttttttccaggaagcgctggcaggagcagtgaaatcaccgtatatacgctttacagtggcttcaccgaaccgtgcaatttctgccagcagcccctcgatgacagcagcctgtgcattatcagcatcaatgaggacagccagacgaagagaaggctcttcagattcagtttttgtgaccaagcgtggggatgccaagatatctcctgtctcctgatgtataagtaaatcagccccgaaatgacttaatcgtccattttagtgcgaataatgctcttccggcattttaataacaagatcattattgatgattttctttactcgggacaggagaatccaaagctgaatcagaggctggctagcacttttgcgaccgtttcccccatcatggacggggtcgggcagatagtaacacccagttcttgcagttgttccactttttctgctgcactttctccggctgaggagatgattgccccggcatggcccattcttcttccgggaggcgcagttaacccggcaatataggcaaccagaggtttattcatgttttctttggagaagagtccggcttccacttccatcggaccaccgatttcaccaatcatcaatgcaattttagtttccggatcttcttccaatttttccaggatatcccggtgtgagctgccgatgatcggatctccaccaattccaaccgaggtggaaatcccgatattcagtcgccgcatctggtcggcagcttcataaccgagtgtgccggaacggcctaccacgccgactaccccctgactgtaaatatgccccggcataataccgagcatcgaacgcccgggactgatagtgccggaacagttgggcccggtcagtaccatccgatcctgttttggaaaaagacgcaggaaatttttgactgtcatcatgtcctgggtcgggataccatccgtaatggatacgcaatacttgattccggcatcggccgcttccatgattgaatctgcagcaaaagcaggtgggacaaatacaatactggcttccgcaccagcctgttcaaccgcttccctgacggtattgaataccggcagtcccaggtgtttctgtccccctttaccgggcgttacgcctcctactacattggatccataatcgatcatttcctgagcgtggaaggtgccgatccgaccggtaaaaccttgtacgatgatccgcgtccgctcattaatgagaattgccactttttgttcccctttctggtttcggttattcaggctgcgacctggttgcgtgcgtgtactgctttctcggctgcttcggccagagtttctgcggtgataatgggcaggccgctgtcggtgataatgcggcggccttcttccacattggtgccggacaaacgtacaaccagaggaacagttgttccgatattccgcaccgcctggactacaccctcggcaatccagtcacagcggttaataccagcgaagatgttgaccagcatggcctttacattgctgtctgccagcaccagccggaatgctttttcagtccgctcggcggaggcgccaccacccacatccaggaaattggcaggctcgccaccagccagtttgatcatgtccatggtggccatggcaagtccggcaccattgatcatgcagccaatatctccatccaatccaacataactgaggctggcctctgctgctgcaacttcgcgcggatcaatctgtgtgttatcgcgcaactcagaaacccggtgacgccggaacagtgcgttttcatcgaaactcatttttgcatccagtgcgatcagctcattattccgtgtgacaaccagcggattgatttcgagaatattggcgtccagatcacgcaaggcacgatagcagcccctgatggttttgatggcgtgattgagtagctcgccatccaatcccagggaaaaagccatggttcttgcctgaaaatcctgcaaaccgacagccggttcaatatggattttcttgatagcacctggatttgtggcagccagtgtttcaatgtccattcctccctgagcggagccaaccatgacgatacgttcatggctgcgatcaatcatgagcgcgagatacacttcccgagcaatgtctgtgcccacttcaatatataacttcgagcagagcttgcctgtcggaccggtttgatgcgtaaccagtttcttgcccagcagggattcagctgctgtttcgatttcctggtgtgatctgcatatcttgatagcacctgccttgccacgtgccccggaatgaatttgggctttgactacccagacgttactaccaatttcccggctgcgttgcacagcctcttccaccgaatacgccaatccgccttcagccagtttgataccgtattcagccagaatttccttggcctgatattcatgaatatccaatattctctcccatgagttttatggaattgttgggttaagggaaactctgaaaaagagtataactgatagccagataaggagaaatcagctaaaaaagcgtaatttacgcatgataactgagcaccttagtctgattttcagtacagttatttttcggagcttccttaaatacttatttgcttttggcggcaattgcttctgccattttgacgatgttgtttgccattctttctgatgcagcatcgatcagcttgccatccagtgctgctgcaccttttccctgggcagcagcttccttcatggctgccagtatccgcttggccttgtcgatttcagctgccggcggagtaaagacttcattggccagcgcaacctgggaaggatgaatagcccattttccttcacaacccaatgcagcggctcgcctggcggccagcttgaacccttccggatcctgaatgtctccaaaggggccatcgattggtcgcaggccaaacgcacggcaggcaacggtcattctgctgatggcagcatgccattgatcacccgggtagtccgggttgagtccaccgatattggtggtgcgggcacgattactggcggcgtaatcagccacaccaaaatgcagtgcttccagacgtcctgcagttcccttgcgagcgatatcttcaacattggccattcccagcgcggtttcaatcagcgcttccaccccaatccggtttttcaacccctgctgcatttcgagctgattgagcatggcttccaccatgtagacatcttcataaactccgactttggggatcagcagcgtatcaatcttgtgcccggcctgctcaaccagatcaaccacatcgcgcaccatatactgagtatccagcccattgatgcgtacagaaagagtgacaccatggcttttccaatccagatcattgatggcctggatgatattttttcttgcctggagcttgtcatccggtgcaaccgcatcttccagatccagaaatatgaaatccgctccgcttttcagtgctttttcaaacatttcagggcgggaaccggggacggctagctcgcagcgttgtacacgcggtgttttgctttcatacaaggtatgactcattcttcctccaacagattaaatacgatgttatatgtgaatatcgaaatgcatggtgcgctgtgcgcaaacgtcacagctgtccataaaggattgccaggtgtatgggatccaagccggaaataaactgctcccccgggggataaaatcagatgcacagaagtgatgttcttgagtaatttgacagcgttgtccgccagattggcgaaattatagcactgacgtcgatccgatttcagtcaatcctgatctttcacgcagtgctgacgggcctgttcttctgcatgagcagcgaatagatggattgatatgccgaagcagatgcctgccagctaaaatccttttgcatgccgttacgctgcaggtttttccagagcctggtgttgtgataagcattaatggctcgtttgattccttccatgaatgaatcagcagtcatctcgtgaaagtgaaagccgcttgcacttttatccgccagcgtttcaggagtcagatccactacagtatccatcagtccaccagtggcatgtacaacgggaggggtgccgtagtgctggctgtacatctgattcaagccacacggctcaaaacgagaaggcatcagaaagcaatccgtgccggcattgattaggtgtgacaaggcttcgtcataaccgatacggactgccatttttgtagggaaagcttgtgccagggcagccagttgttgttccaacagtgcatctccacttcccagcagtgctaactgggcaggtagatcagccagcatgggcgctacctgcagcatgatatcgctgcctttctggtgtgtgagacgactaacggttccaaataatggaatcgcctggttattttccagccccattgtctgctgcaaggcaagtttgttggcggcttttgccgacagattcctgctggtatattttttcacaagatatggatcggttgccgggttccagatggcggtatcgattccattgactatcccggtaatatcgtcgctgcgcttagccaacagcccctgcaaaccgaatcccagtggttcctgctggatttcccgggcatagccagggctaactgtagaaatatggtcagcgtaatagattcctgccttgaggaatgacaggttgccataaaattcagcgccgtgcatgctgaaactttcatccggtagccccagttttgctacctcatcagacggaaagttaccctgaaaagccaggttgtgcagcgtcatcaggctggctgctttttttcccgaatggaaatgaagataggctggcgtcaatccgctttgccagtcgttacaatgaacgatatctggtacccaggcaagcggactggcatcactggcgagaagcgcgccaatttttgataataagccgaagcgctgtgcattatccggccagtcctgcccggtatcatccagataaattccgcctgtacgctgataaagcgctgggcaatggataacgtataaaggtacactggcagattcgttaatctgtaaccgggaagaaagtagtgtggtgggtgggaaatggggttgcagatcaaatgtggccactttgcgtctggatttcagtccggccagtaccgctggataaccgggtaagagcaggcgagcatccattttcaatgcacgcaatgcgacaggcaatgcggcactgacatcacccaacccgccagttttgcataatggaaaaacttccggggtgacaaataacacccgtatatttttgcgaggggaagaggaaggcatggcttgatatatgttctgacttattgttgtgttttataaaaatcgatcaggttgttggttgatgcatcgtgcccggttaccggtttatctgcagccaattcagccaggatttttcctgccagttgcttgccgagttccaccccccactgatcgaacggattgatttcccagatcacactttgcacgaatactttgtgctcgtagagtgcgatcaacataccaagggttgctggatcgagttttttgaacaaaatcgaggtggtagctcgattgcctggaaacacgcgatgaggaagcaagcgttctatcgcttcgacagacagattttgatttgtcagttcggctctgacttcctgttcattttttccgcgcatcagtgcttcggtttgagcaaagaaattcgccagtaacatagggtgatgctcgggcagcgaatgctggcattggcacggtgccagaaaatcagccgtaaatttctgcgtgccctgatgcagcaattgataaaaagcatgctggccgttggtaccgggttcgccccagatcaccgcaccagtgctgtagtcaactgcttccccggtacgagtgacacgtttgccacagctttccatttccagttgctgtaaataagctggaaaacggtgcatggattgatcgtagggcaggattgcctgattggttacatgaaaaaaattgatttgccagactgcaatcaatcccagcataaccggcaagtttttctcaaaaggcgtggtcaggaagtgttcatccattttctgcgctccggctagcagtaaacggaaattgtccattcctactgccaatgcaattggcaggccgatggctgaccataatgaataacgcccgccgacccaatcccagaattcaaacatattgtccggatcgataccgaactggctgacagctgcgcggttagtggaaacggcgacaaaatgtgctgcaatattctgttcactgcctccgctggccagaaaccattcccgcgcggaatgggcgttggtgagtgtttcctgggtggtgaaggttttggaggcgatgatgaacagggttgtggcaggattaaggggctgcaatatgctggaaagatgcgcgccgtcaaggttggaaacgcaatgaacctgcagttgcggcacatgataaggcttaagtgcttcagttgccatcaccggaccgagatcggagccgccgataccgatattgaccacatcggtaattggcaggccggaatagccccggtgcgtgctgttgtgaatttttccggtaaaccgttcgatctgctgtaaaacgcgtttaacctcctgtgtgacatccacgccatctgtaaaaatgggtgtattggcacgcaaggcgatgtgcaatgctgcccggttttcagtagagttgatcttgtcgccgttggccatgcgagccatccagtcggccagattttgctgtctggccagtgccagcaataaacgaattgtcgtttcatcaaccggctgtttgctgtagtcaagcaaaatatccttaaactgcagtgagaatttgtcgaaccgatgtgggtcttcgctaaacagggtgcgtagcgggcggtttgccatatccggctgatgcgtgctcaatgcttgccaagcaagggatcgggtcagtgtggacatatcattctccataagataggcagccggatcagtatttttcaaaaattgcagcgattccctgtccgccaccgatgcacagggtaaccagtgcatggcggccatttatgcgctgcagctcataaatagctttgatcgtcagtatacaaccggatgcaccaatcggatgccccagtgccacggcaccgccgttcgggttggttctattcggatcgaaacccagttcccgggcaaccgcacatgcctggacggcaaaggcttcattggactcgattacatccatatcagccagcttcaatccggcacgattcagcgcttgcttaaccgctggtaccgggccgattcccatataacgtggatctactccggcatggccgtaagcaaccagacgtgccatcggttgatgattgttttgtgtggctgcgtgttctttcatcagcaccagtgcggccgcaccatcattgatgccggatgcattaccggccgtgactgtgccgttttcccggaaaaccgggggcagttttcccagtgtttccatactgatgttgtcgcgtggatgctggtctgtatcgaatattaccgtacctttacgactggaaacctcaaccggcacgatctgttcccggaaatagccgctatgaatagcgtgaatagtacgctgatggctttccagggcaaactgatcctgctgttcgcgggtaatacgccatttttcagcgatgtgttcagcggtgatccccatgtgcacctgatcaaatggatcggtcagggcgcctaccatcatgtcggttgcgatactgtcatgcatacgctgtccccagcgcagtgcgggcaacagatacccgccacggctcatcgactcaacgccggcagcaatagccacatcggtatctcccagctgcaccgcctgcgcagcagagataatcgcctgcaatccactgccgcaaacccggttcagagtaagtgccgctacatgctgtggcagaccagcttccagcgccgccacgcgtgccagatacatatcccgtgcttcagtggggataacatgcccggcaaacaggtgtccgatgcttgcgggatctatattggcacgggcgatagcctctttaatcgtgatggcggccagcgtggtaggcgccagatccttcagtgcgctgccgtaatcaccgattgcggttcttgtgccactcagaatgacaacgttgcgcattgaaaatggttacagtacgtagcgagccagatcttcgctctgcgagagtttgccaagacgttcatcaacatacgcagcatcaatgacatgtgtgcttccgctgtagcgagtggcattgaatgaaatgtcttccagcaatttttccatcacggtatgtagccttctggcgccaatgttctcggttatttcattgaccgaaaaggcaatctcggccagtcgctcgatggcgtcttctgaaaaattcagttcaatcccctctgttttcagtagtgcctgatactggcgaatcaggcaggcatcggtgttggtgagaatttgcttgaaatcatccgcgctgaggctgtccagttccacccgaatggggaaacgtccctggagttcggggattaggtccgatggtttggccagatgaaaagccccgctggcgataaacaggatgtggtcggtacggatcatgccgtactttgtggaaatggtcgtgccctctaccagcggcagcaaatcgcgctgaacgccctggcgtgaaatatcggaactggatacttctgagcggctggtaatcttgtcaatttcatcaagaaacacgatgccgttttgctcgacattctgcactgcattcagtttcaattcctcatcattgatcaggcgggcggcttcttcttcagtcagtagttttctggcttcacggatacgcaacttgcgtgactttttcttgctggcacccatgttctgaaacataccctgaatctgggaagttagttcttccatgcctggcggggcaaaaatttccatgctggcttgtgacatggtaatttcgatatcgatttccttgtcgtcaagctcaccttcgcgcagtttcttgcggaatttctggcgggttgcgttattttcttcgctagggttggcatcaaagcctgaatcacgtgccgatggtagcagggcgtcaagtatccgttcctccgcgcgatcttcagccagaggcttattcttcctgatctcgtgctcgcgagcctgtttgatggcagattccaccaggtcgcgaataatggaatcgacatcccgaccgacataacccacctcggtaaacttggtcgcctcgatcttgatgaaaggcgcatcagccagcctggcaagtcgcctggcaatttcagtcttgccgacaccagtcgggccgatcatgaggatatttttaggggtgatttcgtggcgcagtggctcacccacttgttgcctgcgccagcgatttctcaatgcaatggcgacggatcgtttagcggcttcctgcccgatgatatgtttgtccagttcgtggacaatttcctgtggcgtcatatgtgacatgataggttttcctggcttggattaattcctggtgttaatcgagctgctcaatgacatgcacctgattggtatagatgcagatatcaccggcgatggtcagcgccttggcaacggtctcggcagggcccagattagtattttccagcagtgcacgtgcagccgcctgcgcataggcgccaccactaccgatagccgctagcccttgttccggttcaatgacgtcgcctgctcctgtgatgatgagagtggcttcatgatcggctactaccagcatcgcttccaggcgacgcaggatacggtcagtacgccagtccttggcaagttcgactgcagagcgcaagagatgtccctgatgtttttccagtttggcttcaaagcgttcaaatagcgtgaatgcatcggccgtgccgcctgcaaatcccgcaagaaccttgtcgtgataaagcctgcgtaccttgcgtgcactggctttagcaacgactgcgccaagcgtgacctggccatctccacccaatgctacttgccggccgcgccggactgatactatcgtggtcatattttttgtatttggctaaaaaaacgattataacgccgttttataacgagattcagttacgggtgcagatgtcgccagaagaggggctgtcttcaagcagggaatcaatcaggtagtaccgattttatttgtatgtgtatgtggcggggagcggggagctatgaggcaggttacagcagtatccgctggtggatatcgtgctgcctgattaacgtattgtattaagtatgttttcgttgtattttttttgtgctagctcgcgcaaggcaataacgatcggcttgtcgcgtccggcatcaatcattggcgtggaaccaactgatatctgccttgcccgcacggtcgctgccagtgtcatattaaaacggttcgggatcactttcagacaatcttctacggtaatgcgtgccatgatggataactccagtaaaaatttacaaaaatgtaaaaacgtaaggctgatcaggaaaattcagcaagcagagcgcgctgcctaacaagctgacggattgttttcagccgttcagcccgaataatgcaggagatttcctgtgctgctgtctccagttcgtgattaacaacgacatagtcaaatctattgagatggctggtctcgctgcacgcagccgacaaccgccgttcaatggtcttgctttcatccaggccgcgttgctccagacggttttttaatgtttccatggatggaggcagaataaatatggaagcagcctgcgggtagagttcgcgcacctgttgcgccccctgacaatctatttccagcaggacatcctgttccgccaccatggtttcttctatccacttgcgtgaggtgccataaaaattgccatacacctcggcgctttccaggaattcaccatgtgcctgcatttccctgaaagttgcgtgatcaacaaaaaagtaatcacgaccgttctcttcatcccgcctgggggggcgtgtggtataggaaattgagagggttacattgatatccgtttgcagcaaagtacggattacactagttttaccggcaccagaaggtgcgctgattacaaacagacaactcataatatttcgttttattgaaattctggcgtattttaacaggtaaatacccggaaactcccgggattatttattgttgataatggaagtcatcaataaatttgaagcggatcgttgtttcagttagaatcttttttcttcaggcgcgtagctcagctggttagagcaccaccttgacatggtgggggtcgttggttcgagtccaatcgcgcctaccagaagacaatcggattctggtatcgtcacgcgcttcggccatactccatttttttctatgtctcgtcttgagttctattgatcgggaatttctttgattttcgctcacttgccagtatgcggatcgcctgcgcgttactgggagaaaagaccttgtcagccgcttcttgccacggcagccagatatatcccaagtgctcacgcggagaaatgacaaccggtatcgtttccggcagctctagtccaaacatgtgctcggtattgtgtgttattcccggcgggtagcgccaacgccattcttcaaaaagtttatagtgattttgtatttcccagttgcggaggatgtaattggcagtattcaggccggtttcctctctaacttcacgcgcagcagtctgctgcagtgtttctcccggattctggctgcctgtaacagactgccagtaaccggggtggtcagcgcgttccaacagcaacacccgcagatcgaccgtgtggataacgaccagaacagatatgggtattttgtaggcttgcaacagacaaatccagctaatcggttgtgatatcggtctttcgcagacggatatgcagctcccgcaattgtttctcctcgacagtactgggcgcctgcgtcagcagacattgagcgcgttgtgttttggggaaagcaatcacatcgcggatagaatctgtgccggtcatcatggcaacgatacgatcaagaccaaaggctatgccaccatgcggtggggcgccgtattgcagggcatccagcagaaagccgaatttcagttttgcttcgtcatccgctatgttcaatgcctggaataccttgctttgtacatcctgccgatgaatacggattgacccaccgccaatttccatgccgttcaataccatgtcatatgccctggaaagtgccttgcccggatcggatgccaggaaatcctcatgcccctggctgggagaggtgaaggggtgatgtaaggcctgccagcgtttttcttcttcgtcccactcgaacattgggaaatccacgacccacaaaggttgccacaaatttgtggccagaccgcgttcatgcccgattttgacccgtaatgcgcccaaggcatcgttaacagttttgaccttgtccgcaccaaaaaataccagatcaccattctgtgcctgagtgcgttcgagcatcgattgcacgacaggctcgggcaggaatttcaggataggggattgcaatccctccatacctttggtcaggtcattaatcttgatataggccagaccttttgctccgtaaatgccgacaaaccgggtgtactcgtcgatctccttgcgggacagctccccaccgccaggaacacgtagtgcggcgactctcccgcccggtttttgtgcagcatcgcggaatacctggaaagatacgtcctgcatcagatcagtcagctctgtcagttccagtggcacacgcagatctggcttgtccgatccgtagcggaacatggcgtcagcataactgatccgggggaagggattgggcaagctgacattgatcacatcagtaaacaggcggcggatcatgtcctccatcagatccatgatgtcattttcttgcagaaaggaggtttcaatatcaatctgggtgaattctggctggcggtctgcacgcagatcttcgtcccggaagcagcgggtaatctgatagtagcgatcgaatccggacaccatcagtagctgcttgaacagttgcggagattgtggcagtgcaaaaaaacagccaacgttgacgcgcgaaggtaccagataatcacgcgcgccttctggcgtggatttggtcagcattggcgtttccacgtcgataaagccgtgctgatccaggaatacgcgtgtcgccatggtgaccttgtgtcgcaaccggatgttgtgttgcatcgctgggcggcgcaaatccagataacggtattccaaccgtatcgcttcgcttagattgtcatcatccatctggaacgggggggtgagcgaaggatttaaaatttcgatagtgctgaccaatacttcgatttccccgctggggatcccggggttgactgtcccctcaggacgatggtgtaccaagccggtaatttccagcacaaattcattacggattttttctgcaatcgggaaagctgcaacattatcaggatcacaaacaatctgaacgattccctcgcggtcgcgcaggtcaataaaaataaccccaccatgatcacgccggcgatgtacccagccgcataaagtaattgttctacccagatgacgtgtgttgatggcgccgcaatagtcagtacgcataagtgacgttaatgttgattgaatgaaaaaacggttcagataaccttactgtgtaaaaatcctgctagtctgtagcaggcgcagacggcgcggtggttgtggtcggtgttgtcgccgcggtatttgcagcagtcttatcggtgctggtagtttccgtgctggattcctcttttggttttgaatccggtctgccagtattcttgtttctgaaatctgttacataccacccggttcccttcagctgaaaacctgcagcagaaactttcttgacataatcagtgctaccgcaggaagggcactttgtgattggagcatcactcattttctgtagatactccttttccaatccacatgcatggcaggcatactcatagatcggcatgctttttctcctttaaataaagtctttgaaaacggcattatacttgactgccagagcaatttcccggatggctttgcctgatcgcgggctgtatcagctcggctcgagcctgttaactttcctttctaccgtatttatcctcaaaccggacgatatcatcttctcccagataggagccggactggacttcaatcatttccagcggcactcgtcctgggttttccagccgatgcggtgtccccagcggaataaaagtggattcattttcactgaccagaaaggttttgtctgcccgggtaacctgtgcggttccacgcaccacaatccagtgttcggcgcggtgatggtgcatttgtaatgataatgcggcaccagggttgacaacaatgcgcttgacctggaagcgttcacctgtatcgatcgaatcgtaccagccccacgggcggtatattttgcgatgtgaacgggtttccggccggtttttctgccttaggatgtcaacgatatgtttgacttcctgtgttttgtcctgatgtgcaaccagaatcgcgtcagaagtttccacaattactacgttattcacgccgatacaagcaaccagtcgatgctcggagaatgcaagagtgtcataacattcttgcaataacacatcgccgcgcacaacgttgcctgattcatcctttggcagggtgtgccacaacgcatcccacgcgccgatatccgaccatccggctgaaagtggaatgattgcgcctggcggaagggtatccggatgagtggaaagtgattccatcacggcataatcaatggaatcgccggggcaggcagcaaaggcagttttatcaatccggtgaaaatcaccatctactgattccggctgccatgcagcgcggcaggcatccagaatattttgacggcaggtatcaatggcagcaagccagacagatgtgcgcatcatgaacatgccgctgttccataaataggaaccttcttgcagataattctgtgccgtgaccagatctggtttttcaacaaagcgggagatctggaaagtacccggttcgtgtagtgcagtaccgtactgaatatagccataaccggtttccggcgtatcaggcgtgataccaaaagtaaccaacataccgctttcggcaagcagtatacccttgtgaacagccgtctgaaaggcagctatatctgtgatgacatggtcagatggcatcaccagcaagatcggatcattcccttcttgtatagcagccaatgccgcgatcgtcagagcgggcgcggtattccgcccaaatggttcaagaatgatcttgccggttttgccgataagccgaagctgctccgcaatcacaaaacggtactcctcgttgcacacaatgatgggcggttgaataacgatatcatccagcccatccaggcggcgcacggtttcctgcagcagggaatgctgatcaaccagcggcagtaattgcttgggatattgctggcgcgaaagtggccatagccgtgtgcctgagccaccggaaagaatgactggggtaagggaatgtttcatgcttgtatcagattggttatgaagaatagggcagatttttgctgaccattcgaaattttgaattcaggggcgatccaattctctggtcagtatttccacgatacgccgtgcagcattgccatcccataaattcggccggcgtccctgcttgccgcgtccttgtaaaatgttgtccaccgcagactgtattcgtattggatcggttcctgccagtgtgttggtaccttcatccaccgtgactggccgttcggtattttcccggatggtgacacagggaattcccagggcggtagtttcttcctgcaaaccgccactatcagtcagaacaacggtggcatccttccagagatgaagaaagggcatgtaagcctgtgggccgatcagtgtaatgttgggccccagatcgatgttaaattttttcagattattttgtgtgcgcggatgggccggaaagatgagcggaagctgtctggcgatctgttgcaatgcctggctgatacgttgcagcgtttcagggtagtctacattgcttggtcggtgcatggtgacaacgccatacgggcgatctttcagtgacgttttaagtggattggtctcaaatccggaagtgtctactcggacaagctgttcgacttggtagaacagattatccaccataacatggccgacataatgaatggctgaggccggttttccttctcgtaacaaatgctgttgtccactcggctcggtcacaaaaaaccagtcggtaatactatctgtcaccaagcgattaatttcctccggcatgcacatatcgccgctgcgcaaccctgcctcgacatgcgcaaccggaatgtgcagtttcttggcgacgatcgaacaggccagggttgaattgacatcgccgacaaccagtaccgcatctggttgctctgccaggcaatattcctcgaaggcgatcattatttttgctgtttgctgtgaatggctgccaccaccggctgccataaagatatctggctgcgggatgcccagctcctcgaaaaaaacatcgttcattgcccggtcgtaatgctgaccggtgtgaacaatcttgtaggccaatttatcctgctgctgcaaagcgcggacaattggcgcaattttcataaaattagggcgtgcaccagcaatgagatgaatttttttctgcataattttttccgcgagacagagacaatgagctggattgtaaaccttggaaactttccgagtttctttatctgccaaaagataattttgatgctaccagttttcctgggaatcctctggaaaactgtctacgttgccatcgctgcgttaaaaacaggctcaaaatacttatttattgcttgtaaactgtatttgctcggttaagcgcctcatcctacgggccggcctcacggctgttcgctgcgctttgcttgtatcacctgtgtttgccttgttgactgcttcactaatacttttaaaagatacctggtagacagcaagtggccttggctggattgttcctgattcagaatcgtatcatgacaagtcggcaggcaatacttgggaaatctctgaaaaacttactgtatttcgtcatgattgatatgttgcaacagcgtcacgggtcaagctaaaaccttgacagggattgctgatggtctggcttgctgaggtactcaaatataagatacactcaaaatcaatcttataaatactctgctcaggagaagtattcatgcctgatcctacgttgtgtactgaggaagatatcacacgcctgatccacgctttttatgcccgggtacgggatgatgaagcacttggtcccattttcgacgcacatattgatgactggagcctccatctgaccagaatggtggatttctggtcatctattttgcgcggcactgatcgttttagtggtacgccaatgcccaaacatatagccctgcctgatctgaatgcggagctgtttcagcgctggctcaagctgttccataaaaccgctgctgaacaatctaatcaggccatggctgaacaggtttgcatgatggctgatcgcatcgcccgcagtctgtggatgggttatcagatcagtcatcatcccgaggtgatgcctgtggggttgtctcatggttgagtcatcacaaatcaggaagcagctgccagcgccgcaatgggctgctttcctcagcctgggctttcggccactgtatattgcaggctgtttctgggcggctatttcggtagcactatggatatatgcaccccaatggctgacgggtgtgttggctggtatgctctggcacgcacatgaaatgctgtgggggttcgtcgccactattgcagtagggttcctgttgaccgctagtgctaattggactggcatcaatccgttgcacggtcgtgcgctaggcgggttgacactgttgtggattgtggcgcgagctggttttcttatgccgggatcgatagcatttggtatcgcaacactttgtgagctgctgtttttcggtctagcagcactggcgctgggccgggttatttatcaaaagcgcagccagcgtaattacggtataccactgcttgtgctggggctgggtgtggctgatggtctgtttctgtggtttacacaggcaggggattatgctttgttgatggagagttttcatgccggcctgctgtgtatggcagtgatcgcactgttgattgcacgccgggtgattccatttttcgctatgcgggcagtgcagggtttgacgatcccgatgcttaccggcagtggtcagtggcagcttgcagcgagcattttcgctattgtgttcttgctgttagggtgggcctcggcagcggcaatcgcactgacagccgccgggattcttgctctgtggcaactgcttgcctggaagccgtgggccgttcgacaggtgccgttattgtggattctttatactggatacgccgggctgggtattggtttgctggttgcagccgcttattctgcaggctggatctcccgtgctgcctggccagtgcatgtaatcggcgtggcaggctttgcgatactgattatcggcatggttacccgtactgcattgggtcacctgggacggccattacgtactgatcgcagcatggtcattttgtatatgttaattatcacggctgctgtactgcggctggcggcgctgttgccaactgcttacgtgccaggcctgttgcatggttcgtctgcgatctggatatcggcctttgtactttacctctggcgtttttttccaatgttgatccggccgcgtgcagatcaatcgcctccggtgatgaagccgggaaatattccggcacagcctcactgatcgttgaacgtatgaatattcaaccaagaggattcatgcaatgagttatggcttgttgataacgctgcatttgctggctgcgatcgcttttgcgggaacagtattttttgaagtcgtaatgatcgaaggtatacgcaagcagctgccgcacgaaatcatgcgtgaggttgaacgcgctattggcaaccgtgctgtcaggatcatgccctgggtacttctggtactgtattccgctggaatagggatggcctggcaacatcaggcggccctggcacagcctctggccagcagttttggactgttattgagtatcaagatcatcttggcaatcagcgttttcggtcatttcgtgatagccatgatatggcggaagcgcggtctgctgaacaggcggcgttcacagcgcttacacctgagcatcttctgccacgtactggcaattgtcatcctggcgaaagccatgttttatctgcattggtaaccagggcgctgcctgcttcatcaagaatttcagagtgttactgaagctgggtgcaaggcttataatatggtattcaatccttcagtttgaccaggagaagttatgccttcatttgatatcgtttctgaagttgataaacaagaaattcgtaacgctgttgatcagcttaacaaggaagtttctgcccgttttgatttcaagggctcggatgcacgtgccgagcagaccgactatgagctttatctttttgcggatgatgaattcaaactcggtcaagtgatggatattctgatagccaaatttaccaagcgagagattgatgtgcgctgtctggataaggggcaggttgagaaaataagcggtaacaaggtaaagcaaaaaattacggttaaaaccggagtggaaagcgatctggccagaaaaattgtcaagctgatcaaggatagcaaacttaaagtccaggcgagcattcaaggtgaggttgtacgggtaactggtgcaaagcgtgatgttttacaggaagtaattcagctagtgaaaggtggtattacagaattgccattacaattccgcaattttcgggattgaatagtcttgcaaccgggatttgccatgtaaagtagggcgtgtgctggggaggagtagacgacgaatcgtccggagccccctggattccctcgcaatgtgatcattttgtgaatccttgccagcacgacttgtaaatactcttcgatgaaagaactagattaaaaataattccactgcaactgaaaccttagtacatctgctttgaatcgctcatgaggagcgttgagtacgttggtgcggttcagcatgtgatagaccgctgtaatttcaatctccggtaggatttgccattccaggccaagctccagatcccttacgcgatccttgggagcattgcgcacgaatttcagaccgccatcgtaatgttgccattttacaaaggggaacaacgttccccagcggagtccatcaatcttatacattgcctgaacgtaaccaccattgagagaagtgtcggtaatcatcgtctgagtcgtatttaattgaggtccctgtccccagttccattctgcctgcaacccgaacggttgcgggtaaagaatggcgtgaagtccaatcctctgatctttgaaaccttttttaggtgcatccagggtgggggtgactccgtaggcattcggtccattcgatgcaaggtagcgcccatggattgcctggatgcctgcttcaatgatctgtccattttcgaactgatatggataggtgaaacggctaaccagatgcacatcattattcagctcgaaacgattggctccctggccgttataaataccgaatgcaaacatgccataatcacccgtgccttttagattcttcgtcatgatatctttgaagcggttttttatatgggatggtgtccagtagaagaatgcaccaatgtcccgctcgtccggacagcagctgttcatcgcgtcattacggtcgagcgtaagacgtagctgactggactgtatgttttcaaagccataagggatcttggattgtccagccctgatgcggaattccttttttttatcgaagaaaatatcggcataagcatcccgcagttgagcgaaatgagttgagctggagccggccggtgtactggcgaaatccgattgcaagtacagatagagatgatcggtaatgtcaccggaaagagccagacgcgcccgcctgatcaggaagttgctgttcgggcctaccgaacgatccgaccataaggatacgttatccttgtcatcccacagactcttgctgtaacggaactgcgcataacccttgatgccgatcctgtcgtaccattttttttctgccacggatttttctgcagaagataccggagctcccgacgcatgttcggcctgcttgtttgtttgcttggattgcgcttccacgcgctgttcgccatcttgtgccgatctggtttctgcatgcctggcgggtgattcatccggcccggacttttcctcggctgggggcctggatactgtttcttccacctgctggaatacgcccagcttgatcctgtttttacccggcgctgcataaacctgtttggtgatggcatctatgtagagggtaagtttttctgcgcttgccaggaacgggaaggacagggtgaacaatacagacaatgtgaataatacaaatgatttgatattcattgttgtttaatgattttgttctgaatcaacagaatgaaagtgtgcaatcagttaattgcaattgagagtaataattgaaattatttttcacagttttgtaaagatacgggtatatcaaccaaggtgtatcgatcctggtgcaggtattatcctgaggtcttgtgacaacggtgttacagaaactgcggaaaaatatttgaatccagacaggattcctgcagccgggcaggagatcgcctggtgcaggaagattaatgctgaaggatgagtgacataatgaagagagtggaatggagcgagttatagcttttgcgtatcaggttggtgtgtgattcggagtatggatattgatatgaacagagttttctggctgctggtttatttttcccattccaactcgaatatcctgtgcaatagtttggtaaagtgggtagatagctggacgtatgttttgaagagttttatcaatactaaacattgatgggaagcgcaaaccgtggtgttcggtcggcgccccaataaattggatttcaaaacccagtttattaaaatgattggctagacgttcttctgtaagaatgaaaagtaacttaacgccgtataagcgtgctaattcaactgcaccataataaagccccagtggaatatagggaaagcgtgacgtctgattagaatcaaaatcgttttcagtgaggtagacgggattgctggcttcaccttttctacggcgaaatgaagaaataactgcaaggcgggaaacttcagcaatttgttttctgggcaattttactggatcaataatggagcgattcagggtatttgcgcaggatttctcgaacggtaaaagccaatcagagctatcagttggtggaataatgatacggacacacccgataaatttttcctgttgggtattacggattagtaaatgcaacgcatgagtatcatattcatctgattccagctgatcttggcgtaatgcctcatatttcagatcttcgcaataaactgaatgacgaatgtaataagcttcgtgttttaacgcctcagtgaaagcgggaacaatttcaaaatattgcttgaaggcggttcccaagtgggtagttttttgggcgaacataatgtgcctcttgtatgtaattgcttgaaaagtgctgtacaaataaatccagatctaattactaaaatccagaattaaggcaattaacggccttattttctaagtattgagttttcagcacaatgagcttacaagacctcttccgagcagcgtacaagatagtgatttaatgaataaatattggatcagtcccgggctgaggactcacgattggtagcattgctgcattgaaatatggcttgagcgattgctggctgaggatcagcatcgattaaaaaatgtgaagatgcttcgtaaggattcgagaggttaatgtaatgttggtgtgcaaaaatcgtattatagaaatacttggatttgtgcgtttttattcgagtgaatttggtgagtgtgttggagagagtgtcaactgggcgcagcaaccagattcgtatctggatatatacacgtctgaacgggagagtatcagcttttttcagtgtacactgttaggttgtggatcagggttggcctgtttcccagcttatcgagaagaaaatggatcattctttaatccgcttaatttaaagagaaatttaatatcatgtagatcattgcgataccgtttgggcagattctctgagagttttcggattttttccaaagttgcttgcggcaaagttttgtcttcagtttttatgatcgttagaatggggatcaaagcagtagaaagaatttgtatcttcttttcaggaaacatttctgcagcaagttgtctgaattcctcggaagaaaaagcggcacgcagtgatcgttcataatccaatgtaaaaatagcaggttggtactttttattcagataagcgaaataaaggactgaatagagtgatttgagtcgcgataaatccaccaggaataaagctccttcttctctcaatacccgcttgatttgtctgaaacaatttttcagtaaacgttcgctgggcagatgatgtaatgccagcgtgctgataacagcatcgactgagttgtcaggaatggtgttgagtatcgaaatatcatctctgataaaagagatgttgctcactcccagctgatcacaataatccctggcattttttaacatgttttctgacatatctacgccaataaattcaatctgtggattaatttgggcaatttgtgtcagttgtgttgcggggccgcagccaagatcgagtaccttattacaaccctgtataacctgagaaatacgagcggtattaaacaggtaagtggcggacataataccgtcaatacgtccggcttctgcaaaagccgctacctggtttttatcctgcatgaccaaatctggttcgggttcgcggttaaattcatgttttccaagtatttctcgtagtaacgttggaataaccgaaattctcatgtttcttgctcctgtatcagattttgactagcagtttactaggattggaatacaggtaaaagacaaataccgggagaaatatatgttttagtaacacgtagcttgggttatatgatccagcagaaaattatattggggagaaaggaggtgttgaatgtaaaactaaaaaaccccgcaccggctagccgtatgtggggctttgttagttgattagtagactagtattgattaggcttttttacgaagacgtgaagtgccaaagccgagtaagccgattccaagcaaagcaagcgttgccggttctggtactacgctcccttgaaaatcaaatgtacctacaccacttttaacagccacgatacattcacctgttaagcaacctgttgctgtgtcatagttaaaagctactgcatcacctgtattgttaaatgcattgaacatcaagtcataaaaaggattgggctgagaaaagaaggattgccctgcgggagatgtcaaaaaatcagtgtaggaatttaaagctacccctccttgaataatagctgactcgcctgttattagtgaacctgtcgcaagtatgaaatcatcagctatcgtaccaccaacagatgctgggtttgttaaagttgcctgtgtaaacgcagtatctaaatttggatcggcgtacatggtgaatgtaagggtatctaaggtatacgtacttccggtagtaccgaaactaccggaactcaaactggttgttaaatcaaatgtaagataaatcccgtaatctacagtgatacgggaaatacctgctcccacggtagagcctgcaagtgcaaaattcgaaaaatcaatatagccagattcagcagcagtgttagtagaagcatttagaataatttgtcctgatgccgttcctgcaagcgagtcggcctgaaaatcagcatgtgcagaatttcctgtaatatagcttgggctcactgtaaatacttggtatgccaatgcctggctggaaattcctaaaatacctaaaccgctaagaatagccgggattaattttttgttcataagtcacctttaagttttaatacatagatcaagaggcaaatatcgcgcatttttgttcaaacgcttacttttatataagcataagatatgccaattttttgattaatgcttaacgatatgtttataaacataaatttccttaaaaataaatagagatttggttcttttttgttattcagaaaaaatgtaaaaaaaatcgacaaaggctagccaaaagtagtggatattgagtcgaggggtgttagctgtgttcaactagtgacgtaatctctggtcggctggtaattattggtaaatgactggcatttcccattctaaagagaataactggtatgttttcaggaaatattgttttccagccggccaaaagtttttgttgcagggttgctggaataccttcgtttattgcttgtggcagtgcatagattgcagaagcaggcatgggttgcagcacacgcccttgtttggtcagggtaagccacagtctttgaaatgagcgcccggcttgtagtatcgattgagtgtcgattttttttacacttaatgcgcctaaatggggagcaagccgacagggtaaatagctggagcgaaaacccaatacgtggtgcattccgaaagagttggccagttgtgtgattggccaatggcgcaacaggctgaagaagcctcgcgataatggttcaatacctaatgcaccgggtggtaacccttcggtgcaggtagtgtgccagccaatatcaaagcgaatggcggagaacagctcttcatgcaaaagcgggttgcgaaaacgttcggtttcagcaatgcgcatcaggtaagcagtttgtttgcgtagtgcaggagtatccagccagtgtaatttgcaatctgaatatttttgtattgtctgatgtaatgcctctcgttcgatatcagtcataccagggccgcgaaagtgtaatctgcggttggtgtgacgcaggggaatcattcctcgaagggagtcttcagtctgatctgcatgtagggtgatttgcaggatcaagtgagggttgcttgcttcgggaaatggcatcgcttcagcatagaaattgaagcgactggcggcgagtgcaatattttctgctatagctcctaaagataataatgctaacacccatttatacccaccttctggtggaaattcagttctggtgtggtgaatatgaataatattgtcggttatcttgaagtaaacctggtgtcggttatccgctgaaggcgccagaatggcgctttgcaggatgtaatcaagttgttgttgggttactttgtttgtcttgctatgcatgtttaagtttgcgatgagccagggaaatggctaatcgactcagtgggttcctgtttccccagggacgccatgtgaatactagtttgtttagataggcatcaaagtgatatcccttgggtgctactctgattggcccgcgaccaagcagaatttttagagcctcggttgcggctgctcctgcacaaagctggcaggccatgatggtggacggtcctttgtggttagccagatcgattgtagtcggatcaactagatagctcatttgcaggcgtgcaggtgcgagccctataaaaaaacgtaaccccttttcttcttctaagctattttttaagccaaaataatcctcaaaggtcatgcctcttggcatgaagttgagtactgctgtgcccatgcccaaaggagcagcggttactgcggggatatttttggcggcacaggatgcaaatatatgttggcgagcattgaaggcaaaaaaatccaggccatcaatgtaaatatcaacaccagccagaaatgcttcggaattgccttcatttataccatcgggaaatctggaaatttccaggtcgggattaattttaagagcttccctgatcatgacatcaagtttgctcaatcctatggtttcaatgttggcgccaatttgtctgttgaagttggccagatcaaaagtgtcaaattcggccaaatggaatttacctattcccaaccgacagagtgtcaataaatgaagtccgccaactccccccagcccggcgatagcgactcttttttgttgtaatcgattttgttcttctcttgtcagccaaccgatgttgcgggaaaaggccttgttataaataaatggctgctgcatattgataagtttaaatctatttacctaaagacagaatgtttctgcatgatcttaattcgttttctataatttaaatattagtcgttatttgatttcttgaaaaatctaaaacatctataaacatgttgctaatatgaggttagctgaagaggttgggctgtctgtagattatttattgacttttgatttatccgaggaaaggggatgcaatgcgggtacaaggatcggctggctgtttttgtgtcgtgtattccagctagtgaattgatctgtttttttatgaatttgtgttccaggtgtaaaaggactgcgggtgcgttgacgcgcagacaggttttttcttctccaatttgttggaatccaaacatacggtgctggggagtagcatggcgtgggttaacttcgcaaaaaaagtctgttgcctgataaagattgcgtgcataaatatatgcaaactggaaaagtacggcgatcatttcctttgaaccatgctgaggatcaagtaccagtttcgagagttcacaaactctcctctttttctttcggaagtagtctatttcagactggtagagttcgtcagcaagcaggccttcttctgaatcaatttttagtgtgagtgttccggctacaatgtcgccgattgatgctaaaaatgtaaattcattgggcttgtgtgaaaaaacagatgcactttctgtattgtagccgcgcaaggcatacatctgtttgatcagtgtagtggctttaatgcgttgtttgagagagctgaccaggtgaatgctgtaaccgttgtgttgcaggaggcaatccggttcagtgtgatcggggtagttactcgggctggctggtattcggtattgttgaggggggaggggctgtgttctgctgtagttgaatgaaggtgagtcggggtgatgaatattaaatgcgagatttgctagctggatattctttgccgtaactgccggcgtggattggttcgcgatctgcatagaacatactcctcataagtcatttcctgaattaaacaaatgtaattcaaagaatggttgtttgataaactggagcagataaatcatttactacctgcaatatgctttcaataaaagcataatccatgccatttgtaataatggttgttaatcagatggttataaatttttctgttttttgatgaagagaattgtcgctgtaatctgttatgaagattgcgagcagtcataatcaattgtttttattgaatattatttgtctctttagagagacggttgggctggggtgatggttgttgcaaggcggctgcgccagagtattcgaagcaggagcaacaaaactcgttctcgtgaatgctgtgggcatgaagcaattcggcagtgggggtgcgaaagcctggattgccgtgacctcgtaggctatgcgaattatgtggagcttaccttccttaataaaaagaacagaaggagcaagttgctggttctgctatatttatttttcttgaatttgattgtatatagacatacatagatgaaaaagttttgagtttgcataaggataaatttggctgaaatgatcagaattttgttgttcctcattagcttacaggcagtatctgcttttgcggtggagattgcgtcgcgtattactgatcgtaaaatcgttgaatcattggcggagcttagggcagggcaaaaagcgctggaagaaaatagatttacgttttatagcgatgcaggagaaaatggatcagcgttttgaagccatagaccggcggctggattttatccagcagctgatgctggtgagaattgccgacatgtttggtgtggttggtttcattgtatgggatcgctgtgcaacactgcgtcctatggacacacgccttaagcagcttgaacgggagctgtaaaatgacctttggctgcagtctgacgcgcatgcttcataccttgcgcgaactggcgaaggaagataaaaagattgaggtaattttgcgcagtttctcgctgttataggcggttcctaggatgcctcagttgatgattggccgccttgacaccgtgaacctggcgtatgcttttacgatcgctcttgtacctttgcattgagtatgagggtgattaaagagtataaaaattttcgacacacttgtttgtcaggtcaagccctcgttgtttctccgcaagagggtgggcattgatagaatggataaagttgtctttgtcccctctctcggcacatgacagagcgtgatttctgttttcagtatttgattagctgaaaaaaacttgtgctatattggttgcttgcttctgtccgctgtacaacttctttttacccggatccgggtatttcaaattcttgattacagtttctcaatttatttcggatatcagtaaaagtgttttttgaatgggtagtcgatcctgctgcgtgggcaggtttggcaacgctgatttttttggaaattgtgctggggattgataatctcgttttcattgcaatcctggcggataaactgccgccggatcagcgtgagaaggcacgtattgttggcttatctctggcgcttgtcatgcgcctcatcctgcttgcatccatttcctgggtcattacgctgactacgccgttattgacagtttttgatattgggctgtcctggcgaaatatcatccttctgttcggtggcatattcctgcttttcaaggggacgatggagttgcatgagcggctggaaggacattccgggcagaaagaaggcaagattgtgcacgctgtattctggcaggtcatcgttcagattattgtgttggatgcggttttttcgctggacagcatgattacagcggtggggatggtggagcatcttgcggtgatgatgattgccgtcatcattgcggtggctgtcatgatggcatcttccggaccgttgatggcattcgtctcgaaacatcccactgttgtgattttatgcctgggttttttgatgatgatcggcttttcgcttgtaattgaaggctttaattaccatgttcccaaagggtatctctatgcggcaatcagtttctcgattctgattgaggtgtttaaccagattgccaagcataacaaggaaaagttcgtcactactggagacttgcgagagcgtaccgcagcagccgtattacgactgcttggcgggagaggcggcgaagttgggttgggtgagactgcagaagtgatcgcgcagcaggttgccaaaaatgatctgttcgcccgggaggaaaaggagatgattgaaggcgtgttgacgctggctgagcgccctgccatgtcaattatgacgccacgcactgatattgattggctggatttggaagatagcactgaaatgatcagattgaaaatcatcgacagtggccattcgcgttttctattgtcacgcagtagtgtggatgagtttgttggtgctgcattcgccaaggatctgctgcgcgatatgctggaagaaggaaagatcaacctggaaaagtcgttacgccatccgattgtggtgcatgagcgtgtgcccgtgatcaaactgatggagcagctccgcaatcaatcgttacagctagcagtgattgttgaagaatatggatcagtcgagggaattgtgacgccggcagatattctggaagcaatcgctggtgaatttctggacgcagatgaagaaaaaatggtggcggaacaacaggcggatggttcgtggctgatggatggatggatcagtatccgcaaggtatccaatttattggaatacgatctggttgatgaggctgaacgctattccacgctcggggggtatctgctctggcagttaggctatattccaagtgagggggagcaggttacggttgatggtctgatttttgaaattgtttcagttaaccgacataatatcggtaaagtgcgtgtgtgccgcgtgcagcctgaaagtgagtaaggggattcaatgaggatatctggaggattgtttttgccgctggcgaagtgaaaggagtggaggccaaaattgatttttccattggacacatgcctgtcgaaattttttacactgtctgcaaggctgttttcctgtcgctattttgtcagaagatgacttgaaaattttcatttgctggcaaatagttatccccgggttcaggatgttccccatttttggcatgattgttgcttgatctctaataataaaacaaaaccttaaggaacttctggacgaatccgacatggtcatcacgcacgtggttttgtgggatgggccgcaaggcgcgaatggatcattcccttcgcaacgagcggaacacagcaggccacccgaaaaaccgcgtgctcatcgcgttgtgcgccttggcttcgtagaataggcccgctatacgccttgcgatcatcgcagttttaccagcaacgcggctcatggaggatttgtgcagaggctccttaactatccaagcagaagagaaatatgcacatcttccaaaaatggcggtgggttgtgttgagttttttagctctgtatgctgctgtcacttacagcagtgaacctgttccccggggaatacccggtaatgttgcaaacaatatcgaaatattggtgctgcaggctcgtcaatacgaacatggcgagggcgtgccgcaagatagaaaaaaagcggtggaattgtactgtcaggcagccagactgggttcgccggaaggacaatatgcactgggatggatgtatgccaatggacgtggtgttgagcgtaatgacaatattgctgcgagcctgtttgaaatggccgccgcccgggggcatgcctatgcacagaaaatgctgcagttcatgcctgtgccagccaatccaaaggcacagttaccggattgcttgaacagaaatatttatgctcgcgccaaggcaatgccaaacaaatattacgttgaccagtccgtgtctgcacttgtggagaaactggcaccgcaatacgagatagatcctggtcttgtgctggcggttatttcagttgaatccggttttaatgtgcaggcagtttcagccaggaatgctcagggattgatgcaactgatcccggaaacagcggagaggtttcaggtcaaggatgcttttgatgcagaagacaatatcaagggcggcatggcttatctgagatggctgctcgctttcttcaagggagatgtggcgctggttgccgcggcatacaatgccggggaaggggcggtcgagaaatatcgcggcattccgccttattcagaaactgtaaaatacgtcaacaaaatcttgtcgcgctacaacaaaaccacccatccattccaacctggtgtggtcagcagaacttctttcatcttcacctcggctggagctgggcaatgagacgtcggccatctcgcaaaataaattttcatcacttgtaaacatctgtaaaagcaattggctttgtgaacaccgcaggcgtgaagcaatccaacaagttctgtcgaaaaattttacaccgtacatgagccatattcgcagagtacgttggcgcgctctcgttattgagggcgatttataaattgggtgagggtgtggctttttccaggtttttctctttgaattcgcataaatctataatcaggcattgctgacataaaggtttcctggctttgcagatatagcgtccgtgcagaattaaccagtggtgggcatcttgccgaaattcttccgggacaaccttgagcagtttgcgttctacttccacaacatttttacctggagcaatcccggtgcggttggctacgcggaagatgtgggtatcgactgcaatggtgggttcgccaaaggcggtattcagaatcacattggcggtttttcggccaactcccggcagtttctccagttccgtgcgggtgcgtgggacttcactgtgatgttgctcgatcagtaactggcaggtggcgaggatatttttggttttggtacggtacagaccgatgtgttgaatgaatggactgaggccgatttctcccagtcgcagtatcttctctggtgtatcggccattgggaacagtttgcgtgtagccaggttgacgcttttatcagtggcttgtgccgagaggatgacagctaccagtaactgaaacggtgtgctgtattcaagttctgtggtcggatgggggttggcctgcctgaatctggtgaatatctctcggcgtttggtggcgttcattctttagccggaatgttggaacgtgcaagtgctgcgcgcgcacgttccattgctgcctggatggctgctttcttcatatcggttgcttgttgtgtaacgaagctggtatctgctccgggtttgttctgtttcggtttccgggattcctgttggttgcgtgccaatctgagttgcctgagatgatacctcttacgcgcgctgtcagccatttgttgctggatttcaggtgtggcgggcttaggcacaggcaccatactgatgcagtccaccgggcagggtgcgatacaacgttcacagccggtgcataactcggtcaggacggtatgcatgcatttggccgcgccgatgatggcgtctaccggacaagcgcgcaaacagaaggtacagccgatacactgtgcttcatcaatgacggcgactgctggtggtttggggtggccataagccgtattgagtggcttgggagcaatgttaaggatggcggcaatagctgcagtgccggcgtcgccaccaggcggacattgatcaatatctgcgcgcccctcagcaatcgctacagcataaggacggcaaccatcaaatttgcactggccgcattgggtttgcggcagcacggcatcaatctgctcaatcaatttacttttatccagcatgggttgaacgagagcaaagtagtgaggtgatttctggaatcagagccggaccacggtaaattaatccggaataaacctgcaccaggctggcgccggcttctattttggcttgtgcatccaggggtgacatgatgccacccgccccgatgatgggaatggcctgctggagatgcatggcaagctggtggatgacggcagtactgcgctccgttaatggcgtgccgcttaatccgccttgttcatcaccatgcggaaagtgctcaaggccgtcacgtgcgatggtggtattggttgcaattacggcatccatacggtatttcagtagcagcgaggcgattgcttcgatttgagcagattccagatcaggtgcgattttgatggccagcggggtgtagtggccatgttgatcgctgagtcgggtttgttccgtcttgagtgcgcccaacagttgttccagttcggtttcattttgcagctgcctgagttgtttcgtattaggtgaggagatgttgacggtgatataactggcatacgggtacgccttgcgtaaacagatcagatagtcatctatcgcgttttgcaggggcgtatcagcatttttaccgatattgatgcctaatatgccttgataatccgcctgccggacattttctatcagtttatctatgccaacgttgttaaatcccatccggttgatgattgcttcagcctgtgggacgcgaaacagccgtgggcgaggattgccaggttgtgggcgcggagtgacagttcccacttcaataaaaccgaaccccagccgggccagtgcgctgatgtacgcgccgtttttgtcgagaccggcagccagcccgaccgggttaggaaaatccagccccatagcgcgaaccggtgtgcagtagatagtgcgattaggtaacagcccggttttctgcagtaatccgagcgtatccagggtaagggtatgggcagtttcggcatcaagcagaaacagcagcggacgtagtagagtgtatgtcattcagatggttgtgcaggtttcctgacattgccattggttgtcaattagcagttgtagtggttggaaattggctttatagcgcatttttcggttattttcgatccagtaacccagataaaggtaaggtagctggccatgatggcattgtgcgatttgccacaggatattaaaggtgccgtagcttgttccggtgacatccggatcaaaaaaggtatacaccgaagaaagcccgtccggtagctggtcaatgatgctaaccatacgcagttgttgattctcgtgaaatgttaccagaaaggagtcgaccatactttgcaggagaaaattgcaatactgttcatgcccattttgatcatcaagatccatgcctccgccggggtgacgtaatttctggtagcgctggtagagatcaaagtgtgcaggatcaaaatgaaggggatgccgggtggcttgtaaatgctgatgtcgtttccatattctgcgctggatacggttggggtggaacagttctgccgggatacgcgccgggatgcaagcatgacacagctcgcaatccgggcgatagatgaaattgccgctgcgacgatatccctgtcggatcagttgtgtgtaggcatcagcatccgatgcattgccggtcaatacgacccgggagcgtgcgagccgccctggtaagtaactgcacggatagtttttggtgagctggaaatccatgattgctatttcggttgttgcggactattgcggataggtgaaattaaaatgccattttctattttgttcaggctggccggtcaacttacccagtaatttagagaattggagtcttggaatctctcgcgcgcccattgacatcaagtgagctgttttcatctggcagtcgatcaggccatagccctgacgctccagttgcctgaccagataaaccagtgcaattttggaggcgtcgggtacccgggaaaacattgattcgccaaagaatgctttgccaatggctacaccgtatagcccgccgaccaattctccatccacccaggtttcgaccgaatgcgctatcccgcgctgatggagtgcagtataggctgcaaccatttcgggatgtatccaggtgccggtttgtttttcgcgcggtgctgcacaggcttgcatgacttgcgtgaaggcgctgtctgtccggatctgatagtgatttctcttcaacgtcttgtgcagtgaacgagaaattttcaattcttgcggaaacagtaccattcttgggttcggactccaccagaggatgacttccccctgattgaaccagggaaaaatcccttgccgataggcagagatcaggcgttctggcgacagatctccgccagcggccagtaaaccattaggttcgatcagtgcctgttctagtggtggaaagggggtatcggaaaagagcgtgcgaatcatggctgaaacaatatcttcaggtaaataatggcaaatggtgttttcttgatgcagatcaagatcatcatgtctgcaattatctagtatctatcatcagggagcctctgcacgaatcctccatgggccgcgttgctgacaaaatcgcgatgatcgcaagacgtccaccgcaggtcgtagtcattctacaaagccaaggtgcacaacgccatgagcacgggttttgcgggtagcttgttgtgttacgctcgttgcgaagggaatgaaccattcgcgccttagaacctgtttacgatcttttgagtagtagcgccaggaaggccagatgaatgaactgcaagctggtattgagcttacgctcgcagtttttccataaccttcggctcttctccagccaggcaaagctgcgctcgacgatccagcgtttgggtatgactgcaaaagtgtgcagttcactgcgcttggcaatctgcaccgtaacaagttttcctagaatttctcgcgcgccttcggcaaacggctctccagtatagccgctatcgcacagcaggctttgaacctgccccagactctgcttgcagcgttttagagcttgcaatgctcctttgcggtcagtcacttccgccgtcgtcaccgcaatggcatgcggcaagccctgggtatcgacggcgatatggcgcttgatacccgataccttcttgccggcgtcataacccttctggccagccgtgtccgtatttttcacgctctgcgcatccacgatcaagaacgtgctgcaagcgttgcgcccccgtttctcgcgggccgcgccaacctgatttttttaatgcctgctccaacacactcacgccgtgctgatcgggctcactccatttgcgccaatgagcatacacgctctgccatttgggaaactcaccgggcaggaatctccattggcaaccggtgcgcagcaggtacagcacagcgcagaatacctcatacagatccactgtcgtgggcttggtgctgcgtcgcacgctgcgcaatagcggctctatctcggcaaacttctctctgctgatatcactggcatattttgttctcttcatctgcacattatcaaggatagcagaaagatcgtaaacaggttcttacgcgcccatcccgcaaaaccacgtgcgtgatcatgggggatctgtgcagaggttcctaaatgtaccagtatctgtaatacctataaaggggatcacataatctggcatgccatcacgaaatggatagctttcggcgtcatagctgtcggcacgtttggtgttcttatcctgatggcgtttatgcaagtaggtgtgcaggaaaattatgcctttagaggtggctaagtgtgcggtgaaagcagaggcaacacaagaaggctggtgtgaattgtttggccgggatggttttttattcaataacaataatcagaagagcagtatttcagttcagtccaggcgtaaatagcaagaaaacagcgctaccttgatatagatcaaagtatttctcccgatagttatttagcatttgtcatgcaacatttgcatatacataaaacaagaaaggagaacagggtgagtcataatccattcggaaagcgtgccgtattaaataccgtgatcggagtattcggtgcttcaatgctgctgggcgcgccgcaggcatttgccgaaggtgcttcaacacgggttttggaagagcagattagattgcttgaacagcagctgcaatccatccggggcgagctggataaggttaagtccgataccgtgatgcatgagcaaaaagttgatcaaaaattgcggatagtctctaaagcggaagcaaccgagcatgaagcccataaacacatgctgtttttccggggtggctttgcgcatagtgaccatcttcgcaatggtgtttccatccagagtgctgtagctcctattggggtgcaggatcaggcaggcaaaagtgcctggtatgtgggggctgggtttgatttcagcctaaccaatgatgtttggggcctcgcgccgggaaccagtgtatttgccgagttgatgtttgaatataagcagtttagtaacaaagtaaaaggaaatccgcttgccaatgacccaacacagttagcagggcctgtattgggtatcagtattccaaataatccgcgtgatgtaactgtcagtcaatttacgttgacggcagcaccgaaaatcaagtttatggaaggcagcaaattcaggccctggataattccagctggcttagcgcttcacgttgtcagtccaccttctgaatctattacagtgttagcaccgggtgtgatgtttggcgtaggcgctgattacaacatctggaaatcaatgtatatcggtgcggatgccagataccatctggctggcaagattgatggggtggatgtcagtggatttaccgttggtggttatctcggaattgggttttaaagcagtgtaagcgttctttgatatagaaaattagttagaaactgtttcaatcgtagtttgttttctcagtagtgacgagtatttctctcttctcgcttcgagcaaaatcggagcccaagcaacagattttgtgacgaagcctttataccccgcctaagttttggcggggtttttttatgagtgtcaggaggacaggttaatctggttgcgcaaggcatcaagcagtttatcgtacaggccattaaagctgccgttactcatgatcaagatatgatcgcccggttgtgccgcagtagtgatggcgctgatcatggcagacagatcatggtgaatgtcagctttattgccgagggcagtgagggctgaagctacgtcccagcccatctgatgggcatagcagaatacctgatcggcctgattcaggctggcagcgaggctgtcctgccagacaccaagtttcatggtattggaacgtggctccagcacagcgaggatgcgtgcagaaccaatcttgtcgcgcagccctgccagagtcatttgaatagcagtggggtgatgtgcaaaatcatcatagatgtgaatatcgtgaataatcccgcgcagctccatgcggcgtttcacatttttaaagtgggataaggcttcaatgccaagtggtgccggtacgccggcgtgacgcgctgcagccaacgctgccagtgcattcatgcggttatgttctcccagtaactcccagtgcaatattccctgcggtttaccctggaaacggattgactggttttgatcgtgctccgtggtgatttgccagccttcatccaccccgaatttttctacaggcgtccagcatccttgatgcaacacgcgctgcagggtttcatcacagccgttgacaataatcaatccattgcgcggaacgatgcggacaaggtgatggaactgacgctcgatcgcggccagatccgggaaaatatccgcgtgatcaaattcaaggttattgagtaccgcagtttggggttggtaatgcacaaatttggagcgcttgtcgaagaaggcggtgtcgtattcatccgcttcgatgacaaagaaaggagagagcgtttgttcttcgtcgatatgccccagacgggcagacaggccaaaattctccgggacgccgccgatcaggaaaccaggagcaagcccggcatattccaaaatccaggcaagcattgaactggtggtggttttgccatgcgtgccggcaacggcaagcacccaacgattatgcagcagatgctgtgccagccattgcgggccggatgtgtagggtagatgtgcatcgagaatggcctccattaacgggttgccgcgtgtgacgacgttgccaactacgaataaatcaggcgccagcttaatctgatcggtgctgtagccttcgatcaattcgatattttgattgcataactgtgtgctcattggcgggtagacgttggcatcgcagccggtgacggtatgaccagcagcgcgtgccagtaccgccagtccgcccatgaaggtaccgcagattccaagaatgtgaatatgcataaatgttccggcagggtaattgtgaaggaggcaatcggttgagcgggtgattatacgcgaggcgtgaccgggggatgtatccgtgctacgctggtttccgttaaatttgggaagggaggcatgaatggcgcttctgccattatatataccaaaaaacagacgattacaggttgtgattgcgggcggggggtacgcagggattgctgcgatgactacgttacggcgctacaaccctgacgcagaaatcacgctgattgatcctggaatcaatcatctcaaaatcacccatttgcatgaaactttccgctatccattatctgatttgctggttccgtatacggctttggagcagcgctttggttgtcgccatattcgcagtacattgtcgctggatgaatcgatgttgtgtcagtggcagcaagatcattacttgcaggcaggtgatatccaggttccatttgattatctactggtagcatcgggtgcaaggatggcatgccggagtgatatggatagtcacactacaaaaaatgtatttggcctggaggatttttttactgtttccggcgctgatctgctgaacagctttctggaaacgaaaaatagtgaaagatcgtatatatccgtaattggcgggggagcaaccggtatccaatttctgtttgagctggccgattatctgtatcgccaccggattaatcacggtctacggctggtggatgataaggagcgagtattacaacagtttccaaaaggattttcctggtatgtggaaaaacgcatgctggagctggatatcgagttttatccagcggcccactttctggagcagcgtacggataaacttctgctggaagataaaaccagcgggcgacattttgtattgccttccattctttcgctggcattcaccggcaacagaccgggtaatctgatcaaaaccaacttgttcggccaggtgatggcagctggcaagccactggaacatatatttgcagcgggcgattgttcggtttatcaatcagtgggatcgaatacgatgactgctcagtcagcagtgcgtaaagggaaactggctgcccgtaatatgttgcgccactccggtatgctcaaggtgcttgagccgtatctgcatcgtgatctcggttacgtggtcagcctggggccgaatgatgcagtaggttggctggcggtcgaaaacaatgtagtgacaggtattcctgcacaggttatcaaggaaattgtcgaagttcagtacgatttgctgttgagcggggtggatacttatctggtgtagtttgttaacaccgacagaagaaatcagataccgcgcatcatggcaatgccgtgcgcgccatgttcctgggcaattgccagatcggtcggctgtaatcctcctaacgcataaaccggcagcgggtaatcccggaggaggacagaaaacttatcccatcccagtgagggagctcccggatggctgagcgtggggtatacgggactcagcgtgacaaaatcaacgcccagctgctcagcgcgcttgagttcttctgcgttgtggcaggaagcaccgcaccagttaacagttggccgggcagtcagtgatagcaattgagttgaagtcagatgaatgccatcagcctgcactgtttgcgccagtgcgatattcccgttgagcagtactgtcacctgatgattattccgggcaagttgcaatacagtctgaacatagcattccagttgatcgggcggcatagctttttcacggatttgcagaagttttatgccactctgaaaagcttgtcggatggataacaatgatgcttccacacccatttcagctgcacaggtaatggcatagatcgagggtaacatcaggctgcgcagaatggggatattggccggaagcaaaggagaaacagtgacattgtcggcggtttgccaggcgagctgctgctgttcacgaggagcgggttcaccctgccaactggttacccgataaaacctgagttgtaccatggcatgcgggtaactgaatagccgtgtcagccatggcgtggcttggtcgggggtaatacccagttcttcattcagttcgcgtgccagtgcctgaacaggagattctcctgtttctattttccccccgggaaactcccagtagccagaataaggcttgccagttggccggcaagtgagcaggaaactgctatctggacgaataagaatggcaacgacgacttcaaccaacggtaagtcgggcatattatttttgccctattctgcctttgccaatttttgctgacctgcccaatcacgggcgaattggcgagcaacccgtccattgcgagaacctcgtgccagcgcccagcgaagcgcttcctgccgggccgggccggataatctgctgataccatgttgtgagagccagtgctgaacaatttccagatattgctcctgatcgaatggataaaaagacagccacagaccaaagcgttctgatagtgaaatcttttcctcggtggcttctcccggatggatttcgccctccacatgccgggttgccagattttcatgcatgaattccggaatcagatggcggcgattagaggtggcgtaaaccagtacattgtcggatgcggtggaaatggagccatcgagaatgactttcagtgctttgtaacccggctcatccgcttcgaatgacaaatcgtcacaatacagaatgaagcgctccggacgctgatcgatgaattcaacaatgtcggatagatcggtgagcccttgtttatctacttcaatcatacgtaagcctcgatctgcatagtggttcaataatgcttttatcaatgaagatttgccggtgccgcgtgcgccagtcagtaatacattattagctgggaatccggagacaaactgctgggtattgcgatcaagtgcctgcttctgctcttcgatattcagcagttcattcagcgtaatcgtatgcgggtggcttatcgcctgcaaaaaaccggtattgccatgtttacgccagcgaaaggcgatgtgtgcatcaagatcagcgtgctgtatccgggtagggaggatgtcctcaatgcgcgttaacagttggtctaagcgttggaaaaacagttcggaatcattcatatcagctgcggtaatcggcattgatttttacgtaatcataggaaagatcacaggtccatattgtggtggctgcatttccccgattgagttttacctgaatagtaatttctggtgcctgcatgatacgttgcccttctttttcacggtagctggcagcacggccaccgtgttcggcgaccagggtattttccagataaagctgaacaagattgacatccagatcatcaatgccggcataaccgatggcagccagaattcgtcccagattgggatcggatgcgaagcaggccgttttgatcagcggggaatgtgcgatggcataggcgaccttgctgcattctttcgctgtcctgccaccttctacttgcacagtgatgaatttggttgcaccttcgccatcgcgcacaatcatctgggcaagcagaatggctacttcggtaatggccgcctgcagcgtgataaatccggggtcggttgatgtagtgatcaggttgtgcttcgcctgaccggtggccatcaggatcaatgcgtcgttagtagatgtgtcgccatctacggtaatgcagttgaaggattgattggccgtgtggtgtaccaaatcgttcagcaagggttgcgtaatagctgcatccgtagcgatataactgagcatggtggccatgttcggatggatcatgcctgaacctttggcgataccagtgatggtgacggtcgttccgttcagctgaatttggcgggaaatgcctttgggtacaatgtcggtcgtcatgattgcctgggcagcagcaaaccagttgcccggtgccaggtttgtcactgcctggggcaggcagacggtaattttttctaccggtagtggctccatgatgacgccggtggaaaatggcaaaatctgctgtgcctggcagccgatgagcccggccagcgcggcgcaggtggcgtgtgcgtgatcaatgccggactggccggtgccagcattggcattgccagtattgatcaccagtgcgcgaatcgacaggggagatgcaagatgtaatttagctaccgtaacaggtgcggcacaaaaccggtttttagtgaaaacaccggcaacttgtgtgttttcggcaagcctgatgaccagcagatcttttcggccaggtcgtttgatgcctgcttctgccgtccccagtgatatgccctggatcggcagcagctgttcaggtagtagaggtggaatgttgactggcatgaacgagagtctgtgagaaaaaacgttatcgtaacctatcctgcaggaaatcgccgggttgcctggaattattctatttatctaaaactgaatggagtttcgcgagtactttgttaaaataacgatttttagcggtttcggatacattctggatacatctatggaatcaacttttctggtagacaatatgttttttatcgtggcggcaatgctgagtggtggcatgctgctatggccggtggttgcacgtaactccgtccgtgatattggtacaaagcaggcgatccggctgattaattatgaagatgctctggtgctggatgtcagagatgaaggtgaatatgccggtggtcatccgcccaatgccgcccatattccggtggagcagatagaagaacgttggcaggagctggaaaaattcaaggataaacctgttgttatcatctttacgccagggttgcggccggggcgagctggttccgttttgcgcaaaaatggttttaaacaggtttttaatctatctggcggcattgaaacttggcagcgtgagaatcttccattggtgaaaaagtgatggatgataacgatacggaaagagacaaaatgtccaaagtagtgatgtatgtatccggattttgcccctattgcaccatggcagaaaaattattgcgtgcaagaggcgtggaggagattgagaagatcagagtggatttgcaaccagggcagcgagctgagatgatgcggcgttccggacgacgaacggttccgcagatctatattggacagacccatgttggggggtatgacgatttgtcaatgctggatcgacagggtgagctggccagtctgctggctgactgaatgtctgccggtatctgattgttattggaagctgacttatttattttgataaatgtatttaaccggaatcaaccatgactgaaccacagcagcagcccgtttttgttattgaaaaagtgtatgtcaaggatttatcactggaaattccccatgctcctcaggtttttctggaacgggaatctcccgagatcaatcttcagctggctaccagtgataatgtcatagaaggggagatccacgaggtaattgtgacggcgactgtcacggcgcggctgaaggaaaaggataaggttatgtttctggtagaggctcatcaggctggtattttccggatacgtaatgttcccgggaatgagattgagccagtattgggtgttctgtgtccaaatattctgttcccctatctgcgtgaaacgatctcggatacagtaacgcgagctggattcccgcctgtgattctcaatccggttaattttgaggcaatttatcagcagaagcagcagcaggaagcggctggatcacagcctgatcagcctgtggataatacaaccaggcactgattcatgagattacagctatttcgggccgggtttgttaccgctggcctgttgtttccattgttgtttttttcctgtaaggccattgcacaggaaggcagtcaaaatgagtttctgtcgattgcgacgtcggcaactattctatacgatgccccttctctcaatgccggaaaattatatgtggcgagtgtaaatctgcccctggaagtggtggtaaaggtggtgggatgggtaaaggtacgggattatcatggataccttgcctgggtggaagataaaaatctcagcccgaaacggtttgtgatcgtcaatgcttctgttggcagtgtttatcaatctccggatcagaattcgtcgctggtgtttcaagcccggcaggatgtggtgctggaatggctgggtgctgccgcaaatgggtgggtaaaagtaaaacatcaggatggccaggtcggctatatcagaactgatcaagtctggggtgtatgaatatcacggtgcttggcgcgggagcctggggaactgcgctggcaatttatctgtcggcacgtcatcacgtaacgttatggacccgtaatacagggcatctggcagaattggcggcgttgcgcgtcaatcagcgttatctgccggggcagcatttgccggattccatccatctcgcttctgcgctgagtgatgcgttggagcgggcggagctggttcttatagttgtgcctgttgcagggttgcgcgtaactttgcagcggatagctgctttgaatcagtcattgccgcttgttctgggttgcaagggatttgaggcaggcactgcaaagcttccctgccaagtggttgaggatgtttattcggcggagatcacttgtggcgtattgtctggcccaagttttgcccaagaggtggcaatggggcttcctgctgcactgacgctggcttctgatgatgatgcttttgctagacggattgccagcgagattcatacttcaattttacgtgtttattccagcagtgatgtggttggagttgaagttggcggggcgctcaagaatgtaattgcaattgctgccgggatttctgacggacttgcgtttggcaataatgcaagagcagcactgattactcgcgggctggcggaaattacccggctgggtgtggcgctgggcgggcataggaaaacctttaccggtttgagtggaattggagatctgattttgacttgtaccggtgatttgtcaaggaaccgtcaggttgggatgatgcttgctgccgggcgtcaactgccagagattttacttgaaatcggacatgtcactgaaggtgtgtataccgttcgagaggcgcacgaaatgggacggcagctacaaattgatatgcccgtaactcaagcggtttacagtattttgtacgaacaaatcccggttgagagtgcaatcagggatatgcttgatcgtgaacctggtgcagaaacagattgagagcaggttttactgatgtgatactttctcgattcgggtggaacgagaatttatcaaaaatgaagctgatttctggttaaacacttgaccgccgcaaagcggcttgatataagggtttatacagagttgtctgtgtaaaaagaggtgttttcctgcaacctaacgaagcaaaacaaaggggaattttatgaataaatctgaactcatcgaagcgattgctcgtcatgccgatattacaaaagcagaggcgggtaatgcactggatggtgcgttatctgccattaaggatgcgcttagcaagaatgacagcgtcaccctggtaggttttggaactttcaaggttggggaacgggctgcccgtacgggacgtaatccgcgtaccggtgccgagataaaaatcaaggcagctaaagtgcctaaattcactgctggcaaagcgctgaaagatgctgtaaactagcgctccttcgatagcaaagaaaagatgggtgggttcgggtgcttagctcagctggtagagcgtcgcccttacaaggcgaatgtcggcggttcgatcccgtcagcacccaccaacagcattattgggtaaagttatcttgtagctgatctcttattagagagtgtaatactgggagtggtagttcagttggttagaataccggcctgtcacgccgggggtcgcgggttcgagtcccgtccactccgccatatctttactttgcgtaatgtccggtcatgatgatatggcatcttttcctccccctgtttttccctgtttcctttttttcgggtattcgccgtgtttgattttgtaaaccaaaagaagacgatagttcagatcgtgctttttattgccctcttgccgttcttgttctgggggctggagtcgtatcaaggcatgggtagtgcgagtgatgttgcatctgttgatggtgaggaaatcagccgccaggaatatgagcaggctttacgtaatcaacaggaaaatctgcgtaatatgctgggggaaaattttgatgccagtctgctggacagcccgcagatgcgtatggctgttctggaaaatctgatccagcagaagctgttgcgtcatgaggccgggcgagttgggctggccgtactggattcccgtctgactgccgaaattcagaatatcgctcttttccacgaggacgataaattttcgtatgagcgttaccgtgaattgcttcagcgccagggaatgtctcccgcaatgtttgaagcgaggctggcgggtgatcttatgcgacaacagctgctggaaggtattaccggaagtgtgatcgtctccaaaactgttgcggacagaatagcctcactcagtgaaaccaagtacgagattaatcgggtgacaatcaatcctgagcaatatattaatcaggctgaacccgatgaggctgctattcagtcatactatgacagtcatcgtcaggatttcacgttaccagaacgggttcggatcgaatatgttgtgctttctttggaagaattagcgaagcaggagcagatttctgatgaagaaatcaaaaaatattttgatgagcatcaggatgagtttggtcgggtcgaggaacggagagccagtcatatattgctgaccgttccggttgatgcaactgaagagcaaaaggcagccattaaggctaaggcagaacaaattctagaacaagtaaagcaggatccggacaaatttccagaattggctaaggagttgtcagaagatccgggttcggcgaaagcaggcggagatcttggtttctttgcacgtggcttgatggtcaaagcctttgaggatacggcgtttgagatgcagctggatgaaatacgcggcccggtagaaactccgtttggttttcacattatcaggctggctgcagtgaaagatgcggatgtggccaaatttgatgaagtcaaggaaggcatcagacaaacgctccagcgtcagaaggctgctgacagatttggcgagctatccgaagatttcagcaatatcgtttatgagcagagtgacacattgcaacctgtagcacagatgtttaatctgcctgttcagcaaagtgactggattgatcgtaattcgaaggagccgtcagtcgttgccaatgaacgtatgcttcaggcaatattttcggagggtgccattcgtgaccattacaataccgaagcgatcgaagtagcgcctgatactttcgtttcggccagagtacttgagcatcatcccgccagcgcgcaatcactcggactggtcaaggataagattattgaacttctgaagcagcaaatcgcggttgaaaccaccgaggaagaaggcaaacagaagcttgccaaattgcaggcgggagaggctgatgattccctggaatggggagagccggtagaaatttcctatactcagaaaagagggggagatgaagagatcctgcatgcactctttcaaacagatgtggaaaaactccctgcttatactggaatcaagaccaacaagggtagttttgacctgattcggatcaatcaggtgaaagtaccagctaccgaaagtgaatcatcccaatatactcttctcatcaatcagttgcagcaggtgcacggccaggaagaattaaatgcctatcttgctggcctcaggcaacgctacgaagtaaaaatcaagccagttgaggagagtgactgataagaagcgaagcagtagcctgcaggctactgctcgtcagtatccagattaaatgcgacagtattgaatccggcatcaacataggtaatttcgccggtaatgccactggccagattgctgcagagaaaagcggctacgttaccaacttcctcggttgtcacattccttttcaaaggtgcaactttttcagcataacccagtaacttgccaaaattaccgattcctgctgctgccagtgtcttgattgggccagctgagatagcattcaccctgatcccctgtttaccgagacttgacgccataaagcggacattggcttccaagcttgccttggccaatcccatcacattatagttcggcataacacgcacggcaccgaggtagctgagtgtcagcagagcggctgatcttccctgcatcagcggcagagcagcttttgccagtgcagcaaagctgtatgaactgacatcatgggcaatctggaaggattgccgatcgacgctttccaaataatcaccagtcagggctgtgcgcggagcaaaggcaatagaatgtacgattccatccagtccatcccagtggctcgccaattcgctgaaacagtggttaatttcttcgtcctggctgacatcacagcgaaacagcagattgctgttaaattctgcggccagcttgctgacgcgctcgcgtaaatcttctgattgataagtaaatgccagcttggccccttcgcgatgcattgccctggagataccgtaagcaatggatcggttactaagcaggcctgtaatcagaatttgccggtcggctagaaatcccataatcgaaaactccaattggtatttgtttaactaaaacatgtcttggccgtatgaggtttttacggtttggcttgctgaattgctgtccttgtataacatgtagtgcgcattgtatcaccgctcatgggctccgtctttctgggcaatgtcccttgcaatcttgctggatgagccttgattcaattgacgggttgtctggtatgataaaccgatctctggttgcagttcgctacagaatatatgttgctgaatgatatatcctggctgaacggtttccaaagctttcctggccgattttccggttcctttcttctccatcagcactatgacttcttcaacaatatcagcagtttcagaagcagtacaaagaaagattatcaacgccattgcgacagagctcagtgttgcgccacagcaggtcagcgcagcggtagccttgctggatgatggcgcaaccgtgccttttatcgcgcgataccgtaaggaagcaacgggcaatctggacgatacacaactgcgtctactggaagaacgattgatctatctgcgcgagctggaagaacggcggcaggtcatcctgacctcgattggggagcagggaaaactctccgatgaattgcgctacataatcgaacaagctgcaaccaagcagctgctggaagatatttatttgccctacaaaccgaagcgtcgaacacgggcacagatcgcgcgtgaggccgggctggaacccttggcagacactcttctgacagatccgacgtgcgacccagaacaggaagccgcaaactatatcaaggtggtgtcagcagccgaaggagtagaggcaatcaatgttcccgatgtaaaaacagcactggaaggtgcgcgtgatattctggctgaacgttttgcggagacagcgaagctgctcgccattctgcgtaataaactttggcaggaaggcgtggtgacttcagtggttgttgccggtcaggaaatgtcggaggaagaaaaattccgtgattactatgcttatgccgagccagtgcgcttgattccctcacaccgcgcgctggcattgttccgtggccgggcactgggagtgcttagaattgatctggacctggatgaaacttctcgtgaagtaattccacatccttgtgttgccatgattgctgcacatttcaaaatcgaaaatcgtggccggaaagcggataaatggttgggggatgtttgtcagtgggcctggcgtgtcaaagtgcatccgcatctcactgcggaactgttgttgcaggtgcgcgaggcagcagaaactgaagcaatcaggatttttagccgcaacctgcgtgaattgctgctagccgctccggcggggcccaaagctgtactcgggcttgatccgggttatcgtactggctgtaaagtggctgtggtcgatgccactgggaaattgctggaaacgacgacgatttatccgcatcagccacaaagtaactggcaggattcactggcaagcatcgtgcaactggtgctccggcatggtgttgagctgatttcaattgggaacgggacagcgagccgggaaaccgataaattagccaccgaggtcattcggctggtggcagagcaacaccccgaattgaagctgatcaagcttgttgtcagtgaagcaggtgcctcggtttattcagcttctgcactggctgctgcagaattttccaatctggacgtaagcctgcgcggcgcggtttccattgccagacgtctgcaagatccgctggcagaactggtcaagatcgaacccaaatcaatcggtgttggtcagtatcagcatgatgtaaaccaacgtactctggcacgatcactggctgctacggttgaggattgtgtcaatgcggttggcgtggatgtcaataccgcatcagcacctctgttagcacaagtttccggccttaatcgcgtacttgcccagaatatcgtcagctatcgcgatgctcatggtcggtttccaaatcggcgaacgattctcaaagtgccgcgtgtgggtgaaaaaacatttgagcaggcagcgggctttctgcgcatcaacgacggggataatccactggatcgttccgctgttcacccggaagcctatccggtggtggagcgtattctggcgcgcttgagtaaaggaatcgggcaggtaatggggcatccggaaacactcaaagggcttactgctgaagaatttaccgatgaaaccttcggtttgccaactgtgcgcgatattctgtccgagctggaaaagcctggccgtgatccgcgcccggaatttaaaaccgctacctttcaagaagggattgaatcactgactgatctgcaatccggcatgattctggaaggcgttgtgactaacgtggctgcgtttggagcatttgttgatattggcgtgcatcaggatggtctggtgcacgtttcctcactggcaaacaagttcatcaaggatccccaccagattgttaagccaggacagatcgtcaaagtcaaggtgctggcagtggataccgtacgccagcgtatcagtctaaccatgcggattgatgatgtacctgaagcaaccggacagcctaaaatacataaagtacataaagaaacaggtaaaaacaaccgccagccccggcgtgattctcgtcaactacaggttgcatccagagtagataaatccacacctgtcagtgcactggctcttgcactggcgcgggcgagagaaaagaaataaaactggatatatgagagaaaagataacttatacgcatggataccacgattcagtgctgcactcgcatagaaatcgtactgtcgaaaactctgctggttatattaaagacaggattatccccgggaaaaatttactcgatattgggtctggtgctggcactattaccgttgattttgccagacggttagcgcctggccaggttactgctgtagaaataactgctttagcacttgagttgaccagagcagaagttgagcggcagcatctggaaaatgtgcattttttggttggtgatgccaccactctggatttacctgacaatagcttcgatatagtacatgcacaccaggttctgcagcatatgggcttctgtacaggcgctccgtgaaatgaggcgtatctgtaagcctgatggaatcgtggcagttcgggatagtgattatggtgggtttatctggtaccccatgattcctgcacttgatcaatggatgaaatactatcagaaggtgaccagaagtaacggcggagagcctgatgccggtcgctatttgctctcttgggcgcaacaagccgggtttacagaaatcaaatcaacctccagtacttggtgtttatccacccgggtagtcgtgcctggtgggacagtatgtgggcagatcgaattttgaaatcggacatagctgatcagcttcgtaatgacggcattgcaacagaacaggatcttgagtgcatatcacaggcctggctggcctgggctgccaaagaggacagttggatgtccattgtccatggagaaatagtttgtcgcccttgaattaccgaaaaatttctttcaggagacttacgtctccgatatgcgctcaatcacgcagtacggacaagaaattatgcgactataaattgacagagttattgatcagtatcagacattacagcatgttgcgttttgcaatattgaccgtttactttgcggtgtctggtgggctgttagttaaatttttcgattgtagtttctctcaacattatcctgaattgctctggttatttcaggttggcgggggaactgtcaccattgcatttttcatatatgaaattgttctggatgataatttaagaaggttatggaaatctgttgccgcgactgtcagaaaaaaggatgatgtcttgttaagccatcgccagtactggaaaaacattttggttccagttgcaacgtatggaatttttattgggacactcgttttctggctatgtatcgctcaggaacactatccctgtaattaattgtgcattggagtgtgcatggtgaaatccatgtttcacgggaggtgtatcgcagcacatcatggatggtgataaggagatttagtctacaaagccaccatgataaccggtttgccattattcttccggccagcgtatggcaaactgttccagcagaacattcttcaatttatcggatggaacatggtgcgctattacgcgaccatctggatgacgatgcctgaattctccatccagcagtgaaagacgtccaccattgggcagagcgcgcgcagccatgatctgttttgtaaaactggattccggatatgtgctggtgtaccagttggctactttgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcggctactttctgatcgctggctggcatttcttcaccccggaattcgtatatgtccagccagtggttatctgtccaaacctgatgaaaccagcgcccagcctcatgcatcagccggcggcgatcatgcaatgtatcctgctccagattttcctgccacagcagagcccgtgtcagcgaatagccacctacaccaacatcggtcagccattgctgaccacccagctcgacgctgataaacaggtgggtacgtgctggcatctccaaacgatcggtcactcgcaggcgtacccgtgccgccagcggtcgtgccttgaacccaagttgtaagagaatctgtagaaacagaccattttgctcgaaacagtatccgccgcgctttgccagaactagtttattaaacagagcttctgtttccagatggatcggttttttcagaaatacatctagattttcaaatggtatcgtctgcgtatgtgcgcgagtcaaagcatgcaatacctccagtgtattttctaccgcaccctgataaccaatccgttcgaagtattgtgataaacagacaggtggttctttgttcatttttgataaaaatcggtgtatcacaaagaaaaatgtgctggcctgacagcaggaactggtttctggtaacaatactcagcctggttgaagtatgctcggagaagccatcctgtaaaaataccggaaatgcttacagattggtatcggttatgactgctggcctgatcccgttgtactttacctgagcatgcttgccaagcgcgacgatcacaactacgagtgtagccaccagccaagtggtgagatccgcacgctctcccaatagcaatactgatgcaataatggttagaaatggctgcaatagctgggtctggctgacttttgagattccacccaaagcgagcccgtgataccagggaaagaagccgagatattggctgatgaccgtgagataaataaatccaatccaggattccataggtaggttcaacgtggtaggcgcgtaaagtacggtcgggatgattaggacgggaaaggaaaaaaccagcgcccatgaaatcacctgaggcccgcctaacgatttggatagcctcgcgccttctgcataactgacgctggcacaaatcactgacccgaaaagcgcgaggtcggccagatgaagcttgccaccagcctgattcagtgaatagccgactaccactgccgcgcctatcagtgcaaatagccagaatttgccagatgggcgttcgcctgaaaacagggcggctgcaactgcggttgccagtggaaagatgccgagaacaacgccgccatgtgacgcatcaacataacaaattgcccaggcagctagtaatggaaagccaatcaccgcgccgagagcaacaattaccaacccttttgcttcttcacgagttggcaggcgctggcgggtgagccatagaaaaatggctgccagcagagcggcgcctgtccctcggccaagcgctacaaaaactgggtcaagcgcagcgacggctgcgcgcatggccggcagcgtgagtgcaaagaaaactacagcaataaatccgtagaaatagccaagattctcgttacgcgtgtttgtcatgaaggtcctgatcaggataggaaaaaattccaggatggcagacccaaactccggtacatgtgaacctggtgaagaagcatcatgaggagcattgttttctggtaaaacttgtctggttgttcagagaaatcagacaagtttgatcaaccccgggtaaagcgccaccagtgctaatgtcaatagctgcagcaggatgaacgggataacacctcggtaaatatcaagggtggtgacggatggcggtgcaacaccccgtaggtagaacaatgagaatccaaccggcggggtaaggaaagaagtctgcagattaagcgcgaccagaatgccaaaccagagcggatcaattcccagcttgatcagtaggggagtaatcatagggataaaaatataggcgatttcaacaaaatcgagaaaaaatcccagcaagaagatgatcaccatcatcagcagaatgaacccccatttcccgcccggcaaatggtgtaacagcagttcggccgcttcatcaccaccggtataggtgaataccattgaaaagaatgtggcgcctgccaggatggtaaataccatggtcgtgatcttggtagtttccatggcaacttggtgcagcatgctgattctgaattttccgttcagtatagccagaatgattgctccaaccgagcccatcgcagctgactcagtcggtgtggcaataccaatgatgactgttcccagcacaattatgaccagggacaaagccgggatgattgttttgaaggcgtgccaatattgcttgatgagggagccacttttgttgggtataggaggtgccgcttcttttctgaaccaggcaagtatcaggcagtagataacgtaaatggcaaccagcagcaggccaggcaccagtgccgcccggaaaaaactgccaaccggcctttgtagtacgtcgcccataataatcaacacaatcgaagggggaatgatttgccccaacgtgcccgatgcacaaattactccagtagccaaccgtttgtcgtaaccgtacttcaacatgataggcagggcgatcagccccatggtaatgaccgaagcacctactacgccggtagccgctgccagcagcatccctacgatgacagttgataccgccagaccaccccggatacggccaaacagggaacccatcgattccagcatactttctgcaatgccggatttttccagaatcagccccatgaaaatgaacagtggtaccgccatcagggtgacactggtcatgattgagtgcatgcgctcggcgaccatcaggaacagatgcaatccctcaaaatacaggccgtagaacagtgctacgccaccaaaagtaaaagcaaccggaaagccgaaagccagcatgatcaggcaaaccaggaacatggatagtgcaatcatttggcaatggctctggtgaatattctgtctgagagtgacagaatagcggtcagaaaaactatccggacaagggttgacaagatcatgattctttctgctgtggggcggcgtaatcagtcagaggtgggttatgtttttccgccagcagccgcagattacgcaagatttctgccaatgactgaatcagtaccagaccatagccaattggtagtaatgacttgaatgcaaaacggtagggcagcccgccaggatcgctggatgtttcctgtaactgataggaataactgacgaaatcccaggagctgtagagaattagcgtacacatggggatgacaaaaataagataaccgcagatatcgatgattgctttgcggcgtggtttcagatgggcgtaaatgatatctacccgtacattggcgtcttctcgcacaacgtaagcggcacccagcaggaatattgctgcgaacaggtgccattccagttcctgcatggcgattgagccgccgtgaaaaaagtaacgtgtgatgacatcagtgaacaccacgccgatcattagcacgcacagccagcctgccaaccagcctgttgcgccggaaatcctgttaatcaggcgttccagtttgcataagatttccactttgaatcctttcaaggggatgggacagtcgttgattttccagtggttctggcgatattttatgtgctgacagcttaatgtccggcgatgatcatgcgttcaatcagcagcgaaccgcagtggcgtgagccgcgcacgatgatatcgtcaccaacggcaacaatacctgacaacatttccttcagattaccggcaatagtgatttcctcaacggggtagctgatctcaccgttttccacccaaaatccggcggcgccctgggaataatctccagtgacgaggttgacaccatggccaagcaattcagtaaccagtaaccctttattcatttttttcagtagagcatcgaacggcagcgatacgtcgttttccaggatcagattatgattgccaccggcattaccagtggaacgcataccaagtttacgcgctgtgtagctgcccagaaaatacccttgcacgataccgttttccaccaccttgcgcggatgagtcgccaccccttcatcatcaaacgcacagcttgccagaccttttggcaggtgcggcaactcactgatctgaatggttgcaggaaatacctgtttgccgatgctgtccagcagaaaggaggatttgcgataaaggctgctgccactgattgccttgacaaaataccccagcagaccggaagaaatagttgattcaaacagcaccggcacttcgcaggtggcaatttttctggcaccgaggcgtgccagggtgcgcataccggctttttggcctatttcctcaatggcttcgagatcgatggccgcacgcgcaacgctgtaccagtaatcgcgctgcatgttattttgttcccctgcaatgaccgcgcagctgatgctatggcgagatagtggataacccgcattgaagccatgactgttggcatatacaaaccgggaagcaccggccgatacacttgcgccttccgaattggtgatgcgtttatctgttgccagtgctgcggcttcacaccggcgtgccagctcaatggctgtttcaacagacagtgaccacgggtgatagagatcaaggtcagggaaagaagtcgccagcagatccttgtcagcgagccccgcataaatatcatcagccgtgtatcgggcaatcgacagagcggcagagatggtttcgcgaatggcctgtggagaaaaatccgagctgctagcattgccccgcttatgtccaatatgaacggtgacagatagccctttgtcgcgtgtatattcaatagtctccacttccccctggcgcacggtgacattctggccagagccatcggaaatatgcatctcgcatgcgtcggcacctccttttttggcaagtgtcagcacatcatttgcaatttgctgcagggtctcgtaggggtaggtgaatggctgcagcggttccggataattagaattattcatgtaattgggttggagacggtttatcagagcattgaaaacagatccgttttcagatcagggctgatccggccgaaaacggaacaaaagaagaatgatcgttacagctacaggttgcttagtgatgatcgaaggtggttttgaatccatccatgtggcacgggcattactcttcagtgtgccatgcttattactaaggttccctaaagcgggttatgataacagtttcttgactgttcccgatacgtgtgactgtgcccaaccatcagcaggatatttccgactccgacctggaatcccggccgagtaagacccgtcttaaacaagaaatgcatgctttgcaggcactgggtgagcggctggttgagcttgaaccggccagaataaccgagttggatctgccagaaaaactgacagacgcactgcttgaagcccgcagaataaccagtcatggtgcgcgtcgccgccagatgcaatttattggcaagctgatgcgtgcaattgatcctgtacctgttcaggaaaaactggatgcgtggcagcattccagcctgcaacatactgcatggctgcatcaactggagcgatggcgtgatcgcttgatcagcgatgaggcggctgtgactgaattcgtgcaaagctatccacaaactgatgtccggcagttgcgtaccttgttgcgcaatgttgaaaaggaaaaactggcaaacaaacctcctaaaagttttcgtgccttgtttcaactattgcgacagattattccggaaatatcagcgtaggtgtgtcattgggctggattgctaaaataccgcctttacgaacgttgcaggtgtgaagcaatcgagcaagttttaaaaattatttttaaaattgctgaaaatgagcgaaaaattcggatttatctattgatttgaaggagattagcagatgcggttgagatggattgtatgttcagtatttttgatgttgatggttttgcctatgacatcatcgagtgcccagccagctggcaccaacgcaatagcggcgaagtgcaaaggctgtttgtgcccgggtgatccctgtcaactttgccggttgccaccgcatacggatgatccgattcctgaaaatgagccagcaacctgtcgtgctattcgggaagctgttccaccagcgtcatttcaaccaggagaaaatgaatatttttctaatctggataaatcgaccatgatgtgtattcgcagtggtggtgatgtcattccgaacacgcgccgtgcaccaggctatccggcacgggtttattgcaaaccggatctcactcggcgttgagaatttatttaccactatcatcgcatgagaattatcactttgaacctgaacggcctgcgttcagcagccaacaaagggcttttcgactggctacctcaacagaaagcggatgtaatctgtgtgcaggaattaaaggcacagcagaatgatattaacggtgtgatgcgcgcaccggatggctatagtggttattttcactgtgctgtgaaaaagggttacagcggggtcggtatttatacccgtcatgtacctgatcagattgtggagggaaccggtattccggaaatcgatgcagaagggcgctttttaagagtggatttcggcaatctgacggttatttcaatttatcttccttccggctccagcggagaacatcgccaggctgccaaatttttcttcatggagcatttttttcctctgttgcaatcattggcggaaggtggtcgcgaagtgctgctgtgcggggattggaatatcgcgcataaggaaattgatctcaaaaactggcgttccaaccagaaaaattctggatttttgccggaagaacgcgcctggctgtctaccgtattcgatgagttgaaattggtggatgtgttccgcacaatcaatccagagccggatcaatatacctggtggtccaatcgcggtcaggcatgggcaaagaatgtcggctggcggatagactaccagattgctacaccgggtctggcgagcacagcaatgggggcatcaatttataaaacagaacgtttttccgaccacgctcctctgctcatcgattacgacttcaatccatgaaatcggatgcatgcatcggctggttgcatgcgctgcgtatctatactcacccgagagtactgggcatgctggtgcttggattttctgcgggcttgccgctgctgctggtattgggcacgttatcgttctggctgcgtgaagcgggtattgaccggacaaccatcggtcatttgagctgggtgggcctagcctatggcttcaagtgggcctgggcgccgctggtggatcggatgccgttaccgctgctcactcgctggctgggacgccgccgcgcctggctatttttgtcacaacttttgattggtggtgcgttgatcggtatggccaatactgatccggctggagatttatcgcgcgtggtgatttttgcactgatcgtggctttcgcttcggctacccaggatattgcgctggatgcctaccggatcgaggcagttgccttgcggttacagggtgcgatggcggcaacctatcaggcgggttaccgtctggcgatgattctggcttcagcgggagtgctgtggattgccgcagcatttgatgtttccccgggagaatatagcgcctcatcctggcaaatagcatatttattcatggcgggttgcatgctgatcggggtcattgccacgttgatcatccgtgaaccggatgtgccagttggtcagtcagctattgtggatgaaatacaggtaaaggtagcacttgccggtttacacccggatggattgccagctcagctgcttgcctggctgtatggtgcaatgattgcgccgtttcgtgattttatcgtgcgctatggctaccacgcactgctgattctggcgttgattgccgtgtaccggatttcagatgtggtgatgggcatcatgagtaacccgttttatgtggacatgggctataccaaggacgaagtggccacgatttccaaagtgtacggcgtgctgatgaccattctgggtgccgggatcggtggtgtgctgattgcgaaaaccggtgtgatccgtaccctgtttttgggggcggtactatccgcagccaccaatctgctgtttgtgtggctggcgggcagaggccatgatgtcggcggactgatattcactatttcagccgacaatctttcagcaggcatagcctccgccgcttttgtcacttatctttcagggctgacacacaccgcctattcggccacccagtatgcactgttcagttcaatcatgctgctgctaccaaaatttatcgccggtttcagcggtgaatttgttgatgcttacggctacgcggtatttttcaccggtactgctctgctaggcgtaccggtattgctgttagtgtggaaagtggggcaaattgaccatgctggatcagtgaaaaataacttgcgaaaagagtaggtaaatagccagccttccggtcatagatagtctgggcaatttgggtttgggtatccatggcatcaatcgtggcgatgcagccctcaagagccagcgtctgcggcaacgacggcatctgggtcgagcgtcggcagaatgctgccaactcaacgacgggatgctaccttaaattcctccaggcagatcagccagaagagacggtacaaggtgtcgtgtagagggtgagtttgagatactgtcgaagccaatccagcttcccgttcgcccaggccagtacctcattgatcgggaccaccagcactttaaccagatcatgccgagtcttttccgctgccgagaatccgtgattgatacaaaaacatctgccagacgcagcttgccttccgtctctatagggtatccaaaaaacagaaaactacacaaatcaaccttctgtgaacaaagattttataactgattaatcgtaaacatctatttcagacagtcaacaacattggcattcgtacgattgccctgcattggataatatgaccccgtaaaaatttgagaaaagtgcttaactatgtggtcgggtttacttggcaggaacagttttcaccggcgttgctattgaaatgtgagagacagttgttatcgacaagcaaatagtaggcctgcatgacaatcgactgctatatgggtgtcatgcgctcagcaagattagccataatccagatggtgccagccaccatgatgatcaacagcgaagtagaaaataagaccaataacagatcctcacgcttgcgtttgcggtcaaggtgcaggaagtagcgaaagtgcaccacggtctgcaccaatgccagcaccgcgatagttattaacaacgggtcacgtgccatggcttgccactgtaccagcgcaaagggtaccagcgtgaggccaagcgctagaccaaacccccacatgtaagacatgaaatcacgccgctcattggccgtgagcgcgttggtcgcggatgtccgggtaacaataggttcactcatgccaatcccgccagataaactactgaaaaaataaagatccagacaatgtccagaaaatgccaaaacagtgccaatctgagtagccccagcttggtctcgctatccaggccatgaacggcgatttgccccagcatgcaaaccagccaaatgcaacctgccatcacatgcaagccgtgcagcggcacgagaccaaagaagcccgataaaaagccgctttgcgtgggcaggccgccggcagcaaacatggcgcgaaaatcattcagttccatccccaggaaaactacgccaagcaccagtgtgatcagcagccagccgaccaagcgtgatgtcgggtgtttgtatttcatggcgattgacgccataccgaacgtaaagctgctcgtcagcaacagcagtgtttcaatgaagatgggacccaagtggtacagttcgcgcgggccagggtcgtctgcagtgccttgcagcaaggtggcgtaggtagcaaaagccattccgaaaataatggcgtcgctcatcaggaatacccagaaaccaaacacagttgcttcggcctgggtgtgcgcatccgagtgttcgaccccgaggttcaggcccgggtagataaaaatctccttgttctggcgtgcgtcaaggtaaaactccaagcgcttgaaaagctctgagatcatgtgggcacctctacggtttcaatcgcggcacgccctttgttcgcggccgtgtgctcttggctgcgcttgatcggcagcgccaagcgtgcagcctggatccagtgctgatgcgtccggcagacagcttctgccgggatgattttaagtgtgtcacgctgaaagccgcgcatcaccagggtgccaatcgttatcaatcctgtcaggattacgagccaccagatttgccataccagcccgaatgctaacaagaagctagtgccgccaaatactggacccattgcgctgttctgcggtatttcgatattgacgtatgcatcgggttcctgatagccgacgccaaattccttggcggcggtaaaagcatcacgatcgttgatacttggaacaactgggaaattgtactccggcggtggcgctgatgtagcccattcaaggctgcgaccgttccatggatcgcccacaaaaacgcggtttttttcacgatacttgattgaaacccacagctgaattacaagcgccatgagcgctgctgcaaccagtagagcacctacaaatgcaacgatttccagtggtacgtagctagcctgttcgtaggcaacactgcggcgtggcaaccccatcaagcccagaatgtacagcgggaagaatgcacccatccagccaaaaatccagcagtatgcggaaattcttccccaacgttcatccaggcgaaacccgaatgctttgggaaaccagaaggtataacccgccagcatgccaaacagtacgcctggtacgaccatattatgaaaatgtgccaccagaaaaaccgtgttgtgtacttgataatccaggatgggattggccagcatgatgccggtaatgccgccaatcacgaatagaaagatgaacgccaacgaataaatcatgggtacactgaagcgtatgcgaccgcgaagcatggtccacatccagtcataaattttgactccggtaggaatgccgatcagcatggaggcaatcccgaacaccgcgttgatatggcccgattgacccatggtgaagaagtgatgcagccacaccaaaaatgacaggaatgcaatcgatatggttgcccacactaacgatttatagccaaacagaactttaccggagaaggtcgagaagatctcggaatagacaccgaaggcaggcaaaatcagaatgtaaacttcagggtgaccaaagagccagaacatgttgaggaaattcatctgattgccgcccaggccgttggtgaagaaatgaaaatcgaggtagcgatccagtgccagctgtagtgtcactacagtaagtggaggcatggcaaaaatcatcatgatagcggtgcatagcgcggtccaggtaaagagcggcatgtaataaagcttcatgccaggcgcacgttttttgtaaatggtgacggcaatgttgatgccggtgagtgtggagcccaaagaagccagtgtgagtgaccaaatccagtaatcaaccccgatgcccgggttgtataaggtttcggtatagggggggtaaccaaaccagccaccggtagaaaaagctccgacgacaagtgaaatcatcaccaacgcagcacctgctgcagttagccacaggctgatggaattgagtatcgggaaagcaacgtcgcgtgcgccgatttgtagcggtacgacatagttgatgagccccgtgagaaacggcatcgccatgaagaagatcataatcgtgccgtgcgtactgaaaagctgggcgaagtggtcggatgaaagaaagccgccacctaatccgactgcgccctgcgcgcgcatcaaaactgcttcggcgatggcacgcgttaacatcaccagtgccagcactacatacatgatcccaatcttcttgtgatcggtgctggtgagccagtcgaaccacaaagtgcgccaggcgcggtagcgcgtcagcaatgccaccaccaccatcacgctgatgattacgagcgcggctgcaaaactgcctagaagcccgttaataaaaatatcgctatcatcgctgctgagcatggccagaaacggaaacgaatccgcaccgagaagtcctagcggatgattgaaaatggtagaccagctcataggttattgacccttagtgatcgcgggcgccagcgcggttgacggcaatggtttctcatccatgactgatatcactaaatcggtgaagaaattagctttcacgcctgtgaagtaaacattaccatcgaaggtcggagctgctggtgccagcgctgtgctcagctgtgccttggttccttgcgttgcaatggcgttcaatgcggctgcatcgaacgggattccggtagcgcggacttgctgcacccaggcatcaaagtctgtcagcgtcatcgccacagcgacaaacttttgctggtggaagccatcgccgctatacatggtgttttcaccgaggaagtggcccggccggtcggcttgcagattgagctgtgtgaccatgccgcccatggcataaatctggctgcctaatgctggaatgaaaaatgattgcatcaccgtggctgaagtcagctccatggttagcggctgctcggcaggaaacgccagcatgccgacgctggcaatgccatgctcaggataaacaaagagccacttccaatcgtagccaattacctggacatgggttgctggtttactggacgcaagggtgtgataagggtcaaagcgttctgtatcttcccataccaagacgcttaaaaaaagaacaatggcgattgggatgccccaactgaaatattcgagtggtttgaagatctcccatcgtggcacgtatttggatttggtggcgccatagcgatagtgccatgcaatccacgccgtaccgataaacacaggcagcgcaatcagaatgaagaggatggccacgaccagccagaaatgttcactttgagctgtcgcaattgggccttgtggattgaggaagctcaaatgttcggcactgttacatcctgagagcaacaagagtgcaacataatgaacagacaaagtgccggtttgttgtaagccaaggccatgcatgtgtagcacagacactggcgttgtggatttgggcatcactgttctcatttggctctgcgtcgataataactacaaactaaactacaatcaaccagacttaattagacactcacgcatattaaccagttcaaaaactggcttgcagtatggttcatctaccagagcaatttattgcttcgtattgatcgagattcagttttgtgcatccatgtcataacataatgtaactatgccggcttcatcataggaaaattaggagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcgaaaattagtgccgatcgggtatccttatttgaatttgaacaaaaataatcttctatcatggacgtagtaaaaaaagctgtattcccgatcgcaggtcttggcacccgttttctacctgcaaccaaggcatctgccaaagaaatgttaccggtcgtagataagccattaattcaatatgctgttgaagaggcgtatgctgccggaatccgacacatgatttttgtgacaggtcgcaccaagcgtagcgtcgaagatcatttcgatacggcctacgagctggaaaatgagttggagttggcaggcaagaccatgttgttggatgtcgctcgcggcattgctcccgatgacatggtctgcacctatgtacgtcaatctcgtgcgatggggcttggtcatgcggtgctgtgctcaaaagagctggttggtcatgaaccctttgcagtattactcgctgacgatctaatgattgggaagcctacggtaatggcgcagatggttgagcaatttgccgaaaggcaagccagcatcctggctgttcaggatgtgccacgtgaacataccaggcgctacggaatcgtcagcggccgtagtgtggcgccagaccttgtggacgtcagcggaattattgagaagcctgctccagatgttgcgcctacaacgctggccgttgccggtcgctatgttttgaccccgggtatttttaaagagctggaaaacatgcctcacggtgtcggtggcgaaattcagctcactgacggtattgcccgacttttgcaacacgagaaggtttttgcttatcgctacaaaggtgttcgttacgattgtggaagcaagctgggatttttgcaggcaacagtagatcttggcgagtgccacgatgaagttggggccgaattttcagcatggctacaacaacgcgacgtacatttgaaggctgataattaattgtttaaggtggtgtctggatctgctcttactaacgatgcttgaaatgtaagtcctcaattgaggatttacatttcaggctgaattccatcatttcatgattttatattttcataagttataaactgtaggagtttatttctgaaattttgtctgaactgttaaggagctctcatgaacctgcaattactcctgagccagcttagcaatcatcaaaatgatctggccatcagcattttgttgcccactcatcggacttatccggataacaaacaagatgtgattacgctgaaaaatctggtcaaagaagctgaggaacggttatatacccagcttgataagcatgaggccaaggcaattatcgatactatcaataaagaaatcgatacacataatcacaactacaatctcgatagcctgggtatctttgcgaatcgtcgtagtgtaactgttgtacgctttccgtttacggtcaaagaacgggtgattattaatgataccttcgccgtgcgtgatcttgtacgagaaataaatgaagccgttcattattatatactgatcattgcgcgtacatccgcacgactgatcgaagcatttaacgatcgcccaatccatgaatttggcccgcaaactactttgcaaacgggtaataattttccgatggagagcccgttttcgttcgctgcagagggattggatcgtgctcaaattcccaatgatgcaggctacctcaaggaattctttaaccgcgtagataaaagcttacaggaaattcagaacaatcccgagcgtaaacgtttgccggtaattatcgtcggcgatacgcgcaatgcagcctttttcaaagaggtttgtgaccagccaaccgatatcgtcggagaaatcaccactgtgcctgatttaaaggtacctgctgaaaaaattattccggaagtgcaggccatgctggttgaatatcgcctcagccgggcaaaaacagccctgcatcatcttacccaggctcgcgacgctcatcaattactgacagatttttccactattttccgtgctgtgactgaaggaaatgcagcacgcttgttcgtgcgtcaaggctatattcagccgggtatcattgattttgacctaaagatcgttactgttcacgatgatgctactgcatcggatgtgacagatgatgtggtggatacatttatcgaactggtcatgcaacagggtggtgaaatctgctttttgtcagctgagcagctgggagaggagaagccgctcagcttacagacaagatattaattggtttgtagagagagtcatgattctgacaacaaaccctgcaaccggaaaaatactgcgaacatatacgcaatattccgaaacgatgattttcagtgcgctggaacatgcgcatgcagctcatcttgcatggcgtcagatgcctctgtctgaacggacaggggtgctgctgaaactggtagaagttctgcgaaaaaaatccgaacaatatgcccggctgatgtcagaggaaatgggtaaaactattcgtgcagcacgggcagaaatcgaaaaatgcgcctggtgctgcgaagtgtatgcagctaacgctgcagcttggctggctgaggaagaggttgcagcagatggccgaaaacatcgtatcgttattgagccgctgggtgttattctggcgattatgccctggaactttccgttctggcaggtgattcgttttctagttccgacactgctgacaggcaatggcgctttgttgaaacatgctgccaatgtcacaggatctgctctgaatattcaggaggcagtgagtgaagccgggttaccccaagggctgttcagtacgattctcgcttctcatgagcaagtcgaactgatcattgctcatccattatgtcagggtgtttcactgactggcagtgctgaagcaggcaaagttattgctaccacagccggcaaatatttgaagaaagccgtactggagctgggaggctctgatcccttgattgtactggcggatgcagatattgctgctgcggcaaaggctgcggtaacagggcgatttcagaataacgggcagagttgcattgctgcgaaacgcatcatcgttctgcaggaggtgcaggaagcatttactgcagcgttactggctgaagttgaaaaactggtggtgggggatccactcgacgaaaaaacggacatcggcccgctggtaaacgaacaggccgcagaaaaaatggaacaattcgtggctgatgcgcttgcgaaaggtgcgatggtacgaacaggcggcaaacgtcagggagcttattttctgccgactgtattgaccaatgtgactccgtatatgaatgtactggccgaagaagtatttggcccggtcgtgccggtcatcgtcgctcaaaccgtggatgaagccgttacattggctaacagtacccggtttggcctgggtgcgagcgtatggagtcgtgatctggtgtatggcgagcaggtagcacgcaaactggaagcgggcgccgtgtttgtcaacagcatcaccaaatcggatccacgtatgccttttggcggcatcaaggaaagcggtctgggtcgcgagctttcctggtgggggctgaaagaatttgccaatatcaagaccatcaacgtttatgatgatggaagataaaaaccactcaggagagactcacatgcctatttcaaaattcatattggtcagctgtatgctggcaattgtcgggattccttgtgcatttgcgcataccggtcatggcggtagcgagatgcctgccacatacgagcaggaatctgccgtaccagcagcgacggatgaatcgctggcggacgaacggcaagcttcggcactgctgaatctcggcacacataccttcccggtcagcacacaaaacaagctggcgcaacaattcatcaatcaagggattaatcttgcctacggcttcaatcatgcggaagccggtcgtgcattcaaggaggcagcccgcctggatcccgagttggcaatggcctattggggacaggcgctggtgctgggccccaatatcaacgcagcaatggatgccggtgaagaaccgctggcggtgaagctgatcaatcaggccaaatcactcatgaccacagcatcgccgaaagagcaggcgctgatacaagcactggaaaaacgctattcaggcatggccgaagcacgtaaagtcaacgataaagcgtatgcggatgccatgcgtgaggtgcatcatcagttcccggatgatccggatattgccatgctgtatgtagaatccaccatggatcttcgcccttggggctactggatgcgggatggttacccgtttgaagggacaaatgaaattgtcgcattgactgaagatatgttgcgtcgctacccgaaccatccgggggcgctgcacatgtatattcatctgatggagcccacctccaatccagaacgagctgaacaggcagcggataaattgctgacactgatgccacaagccggacacatgattcacatggcttcacatatctatcaacgtgtaggccgctatgcagatgctgtaaaaagtaatcagatggcgatcaaggcggatgaggaatatatcgcacagttcaaggcgcaagggctgtacccggtggtgtactatccacataacattcatttcctctggttcgcggcttcagctagcggtcagtatgtactggcacttaaaagtgctcgtgacgcagccagtaaagtggatgataagttactgagtcaaatgccttttactgcaattttccgggtcttgccttactggacacttgcccgatttggccaatggcaaagcgtacttgctgaaccggctccgcctgcggataatgcctttctcacaggaagctggcattatgtgcgtggcctggcctatatagcgatgggacaattacaacaggccgggatggaattagcgcaattgcacaaaattgtaaaagatccttcacttaataccccgttgctttctcaaaatacggcgtacaacgtattgcgaatcgcccctgaagtactggcaggcgaactcgccgctgcacatggaaaacttgatgtcgccattgcccacctggaacgggcagtccgacttgaggatggcctagtctatacagaacctgctgaatggcattatccaccacggttggcattaggagcgattctactggaagcagatcgtcccgatgaagcggagaccgtatactgggaagatctgcggcgcaaccgcgataatggttgggcactgtttggtttgcagcaagctttacgtgctcaaaacaaaacagtagaagcagatgtgatcaaggcccgtttccaaaaagcatgggaacatgcagatatcccactctctgcttcacgtatgggatggtaaaacggggtaaagattagcgtgagtggctgtagctcacgctaggagtggtgggtaaacaggctttatctataatcatccaagactgaacacttaatggctgacataaagcttgtcaatttcggcctggtagtgtttataaatattttttcgttttaatttgagagtgggagtgagcatttcattctctactgtccagggttcaggaataagcagtgcacggtgaactttggcgtagcctgggaagccgctgatctgctgggcgattttttccagaatgatttcttcagcatattcatcataagccagtgcatgcggatcattttttgtattgcagtgcgtagcaacgacttcccatccatgcttgctcaggacaaccagcgcgctcaaataggaacgtccttctccaataatcatgacctgttcgaagatcggatcatgcaaaatggccgcttccatgtcagctggcggtattttctcaccggtggacgtgacgataatatcctttagccggccggtaatggtgattcttccctgttcgtcgatctgtgcggtatctccggaatcaagccatccatctgcagataagatggcactggtggctttcggattgttccagtaacccagcatgacgttgggaccgcgaatcagcaaggcattctgctcgcccagcttgacctccactccgggaataggtttaccgacgctggccgggacattatcgttcaaccggttggcgcagacgaccgggctggtttcggtcagcccgtaaccttgcaggataggtaatcccagtgcgataaaagtatgcgaaacttctggcgataatgctgcgcctccactcattacttgccacagccgtccgcccagtttttccatcaccttgcgggcgatcaatcgatcaagcagtggccacagcaggtgtgaaatccgccagccagtacgcccctgctgatattcaaaacggctgtatcccacatcgacagccagcttgaataacagtctggccactgcagagccttcggccagtttttcctggattcccacatagattttctcgtaaattctgggtactgaaatcaaaatggtgggccggatgatcaagagatcttccggtaactggcgagtggaacgtgcataggcgattgttgcgccacatagcatgggagtgtagtagccggctgtgcgctcaaaagtgtgggacagcggcagaaacgacaacaatatatcatccggcgtcaccgtaacaatctgtgcacaagcatgggcattggacaaaatattgtgatggctcagcattactcctttcgggcgaccagttgtaccggaagtgtaaataatggtggccagggaatcaggctgattctcagcgagtggactattctccggtttttccggcagccagtcccgcaatgcgatagcgcgttgatgacctgtcagatgcacgtcttgtgaagtagtgctcataatgacgatacgcttcagttggccaagttgcccggcaacttggctaaatgtatcccaccgcgccatgttctccagtaacagcagactggcacctgcattatccagacaccaggcggcattctcagcccgatcctcgatataaagcggtacgaccaccaatcccaacccaagtgctgcctgttcaaacatgacccattgcgggcaattacgcaccatgatggccacccgatcgccaggagagagattttcccgggaaaacgcagtctgccagagtttaacagcgctggccatatcatcccatgtgtaatccagccaggcttcctggctgacatcgtagtcacgataggcggttgtgtggggagtgcgtctgacccgttcttggaacaacccatcaagcgtccgggccgtttcaacggggatcacgtccatgtttcgggatggtgtggcggcagttatataattcatgctggaatttctccttgtggattacccacctgctgcaaatcaggtgagaaatcatccaccatgatgacgcggcggcgcaagtctttcatttctgccagtaaagtagcttctctatcgctgataatgccttgcgccagcgcctgattgatttgttcatcttcgtgggtagtcagggttttatctttgactgcttgcctaagtctggcttcaattggttcgcaggagatggcgctaaccatggcttgcccgagtaatgccaggggatcatccttgtcagctggcaggtaaattcccattgtcaggcgatcacgtgcttctccaggggtcagaataagtcgggcgacttgatgtgaaagcgtatcagaaggcagctggcagcgcatgccgcgcggaaagaccatgagtcgcaacaggcaccgcgtgactttgctgaccgggaaattaagcaggaattcatggagtgcttgctgcatacggtagagtgcatcctgcatggaccagtgtaaaaatggcagatcggcagcagggcggccatcatcctcaaaacgtttaagcgtggctgaacaaagatacaactggctgagtacatcgcccagacgtgcggaaagacgttcacgtcgcttgagtgtgccacccagcttcagcatggcaacatccgttagcagcgcaaaggaagcagagaaacgtgtcatctgtcggtagtaattgacagtttcactggctgcatttgccggcacttttttgatcaatcgcagactgaaaccaaaaaccagactgcagaatgcattacgcaaggtaaaggctacgtgtccgatcaatgccttatcaaacgcttgcagactgcgcttcctgtcttgatcccaagctgcgctgatttcctgcagcgtgaaaggatgggcacggatagcaccttgtccaaagatgatcatgttgcgcgtcaggatattggcaccttctacggtgattcccaccggtgtctgctgataggtgcgtgccagataattggagggccccagacaaattcccttgccgccgtgaatatccatggcatcgttaatcgcctggcggctgcgttcggtcagatgatatttgacgattgccgaaatgaccgagggctcctcgcctagatcaactgcaccggcagtcatgacgcgtgcggcatccatcatataggtgttgccggcgatgcgggcaagtgcttcctccaccccctcgaaataaccaattggcaatctgaattgtacgcgtacccgaccataggcaccgctgctccaggcagataacttggctgcaccgacactggtggccggcagcgaaatcgatcggccgacggaaagactgttcatcagcatgcgccagccttgtcctgctttttcctgtccaccaatgatccagtctatgggaatgaaaacatccttgccagaattaggcccattctggaaaacgccattcaggggaaaatgtctgcgaccaatatcaatcccaggtgtattggtcggaatcagtgccagcgtaatgccgatatctttttcattgccaagtaatccatccggatcgtatagcctgaacgcaagccccagcaaggtggcaaccggccccagcgtgatatagcgtttttcccagttgatgcgtattcccagtacatctggctgaccattaaactcagcgcggcagacgatgcctgcatctggaatggatccggcatccgaaccagcttccggcccggtcaatgcaaagcaggggatttcagtgccattggccaagcgcggcaaataatgatttttctgctcttccgttccgtaatgcagcaataactcggccggaccgagtgagttgggcaccatcaccgtaaccgctgcggtgttgctgcgcgaactgattttcatcaccacttctgaatgtgccagtgcagaaaagccgagcccaccgtattccttgggaataatcagcgcaaaaaagcggtttccccggataaattgccagacttcaggcggaagatcatgccgttcatgcgtgatatgccattcatccagcatggcacataactgctcaacggggccatcgagaaaagcctgttcctccgtactcaaagttggtttgggataggccagcagcttgtcccaattcggtttgccgctgaagagttcaccttcccaccaaactgtaccggcatcaagcgcctcctgctcggtttgggaaatttgtggcaacagtttgcgaaaaaatcgtaaggcaaggttggagataatattgcgacgcaaaaacggcaccgtgaagagcaccacgatgagaacaagtaacgcgaagaacaggagcaaaacaaactctgacatggctttctccatgaatttttagtgattattgatcgttacactacccgagaataggatgctgtcaagattttgtttgtatccgtacttatgctcaacaaacttggagaagcttgatttttccggtaacaaatgtacctcgaagcattgggcagcattccgattgatgaaattggcctgcatgttgccttgacgatgcgccatgatatgccgcatgactggcatatgctgaagaagaatggctttgttgatctgactattgccaaattcagaatcccgaaaaaccaagttcccatgcgggttgtggtaaaattgcgcactcgtcgtgttgtgcccctgggctgggttcgtagaatgactacgacctgcggcagcatgccttgcgatcattacgattttgccagcaacgcggctcatggaggatccgtgcagaggttccctaacgatcagttttggatatctgtgatttcatcaagctctgctgcgacggctgtccaggctgtagccaccggcaccatgcactgccagcagagtgaagccacctgcgatggcaatatttttcgtgaacataatcatttgtgtttgatcagcaagatcatggtgaaaaatcacggcagctgccagtgtaaacagtgccagagcgacagataccaggcgggtttgccagccgacaataattgccagagctcctcctgcttccagtagaatgaccggcggcaatagtgctcctggaattcccgtcgcttccatgtagccgtgggtatctgcatagccacttattttggaaatgcctgcgagcagaaatacttgtgctagaaataaacgtgcgacgaattgactgattttttccatttgaaccgccttgtcagtaaatttatttcttgaaaatattttttattacttgcgtttaatccacgccttatcacgcacaaattgattggattgataatcctgtagcgcctcatcaatttgttcgcgggtattcataacgaacgggccatactgcacgattggctcgtgcaatggttttccgctgactgcaatgaaacgtgctccttgttctcctgccacgaagtcgaaaatactgtcgtcaacacctatcacaaccaaagaatgaagtgcgacagcctgtccgttaaattgtccattgccttcaaatacataaatgaagcttgtattctgcgccggtaactggtgctgaaaatgccgtccgggctgtagctgtacatcaaaataagttacttgcgtcaaatcatcctggatcggtgcaacggcattacccaatcggccgatcaacactttcagtcggtagtctgctgtttctatcactgggaatgccgctgcaggaaattcctgatattccggatgatccatcttgttgaccgcaggcagattaatccacagttggaatccacgcagcaagccattttcctgtttcggcatttcggaatgaatcaccccgctggccgctttcatccactgtgctgagcccggttcgaggttgccggtattgcccatgctgtcctgatgctgcatatagccatctagcatataggtgaaagtgataaacccccggtgcggatgtgacggaaagccggcaatgtaatcgttcggattgtcactgctgatgtgatccagtaacaggaaaggatcataattgcgcaatgctgctgtgccgatggtgcggtgcacgattacgccggccccttcaggtactgctgtcgcgggaatgattcgtacagaatttactaaggtattcattgttttctccttttccgtcctgtcatgcattgacaggttctgcttaccagaagcattatctacgttgtagtaataagaataaatagtgttttatgtaaaaaattgttcttgtattcagaacgacaaaaggctcctatggatcgatttgagaacatgaatacgtttgcgtacattgtggaagcgggcggtatcagtgcagctgcggatcgtatggatgtggccaaatctgtcatcagccgacgattaaaggaactggaagcacacttgggcgttcagttatttcatcgtaccacgcggcaaatgaagcttaccgacagcggccgtgctttttacgaacaatctgttcgtatcctcgcggatattttcgaagccgagcacgctgtatcacaatttcatggcgctttaaaaggtaatttgaaggtggcagttccgctcagctttggtttgatgcatctaggcccggctatcactgcatttctgcatactcatccggatatcaaatttgatctggatttcaatgaccgtcaggtcgatttgctggcggaaggttttgatcttgccatccgcattgccagcttacctgattccagcttgatcgcgcgtcacctggcaccaattcaagccgttatgtgcgccagcccggcgtatctggaacacatgggtatgccgcaggcacctgaagagctcatcaggcatcgttgtctggcctacagtctgatcagtaatagtgataactggcatgtgtatgaccctacgggacaattgatcaaaaccagaattactccctacctgaaagccagtaatggcgagtttctgcgtgatgccgccgtcgatgggctgggtatcgtattgctgccggctttcattgtttatcgggaaatcgaacacggtgcgttactgccgatattaacggaataccactattcgcaactggcagcctatgctatctacccgcaaacccgtcacctctcgcagcgtgtcagagcattcgtcgatttcctgagcaagcgatttgaagcaatgccttattgggattcttgcctgcgccatacaaaaaatatttcatgaggtttccttcaagttatcagctttacgggataaaacacaagctacggttagcgggtgtaaatttttgtgataacaacttgattcagggcagggaggacatgcagaagcttgacaagcaatctgaggctgttttaatactcttcaggcaaatttatgacgagggggtagagtatgaagaaaaataatttacaaatttgtattggcaccttcttggctgccgcgctggttttcgggcagacagtacaggcagatgagctgattttggatggtaaccaaaccatcagtgacgatacggatgtcagtgtcattgttgtcggtaattctggtaccaattctaagggtggtgatggtcatcttattgttaatagtggcgcaacactcgcgaattttgatggaaattctccaacgctccctggccggattgatggtgtggaatatcaccatgaggatggctatcttggctttaatgccagttcagctggtaccgccactgttacaggtgtggatacactctgggataactcaagtggcggtttgtataccggctaccttggacagggtttgcttgtcgtagaagaaggtgggagagttgtcagtgaacagggctacctgggataccagaccggttctacgggtgctgccgctgttaccggtactaattctcgttgggacaacttaggaaatctctacattggcgggaatgtttccggtgcgggtggtcaggggaatcttgttatcaatgatggcgggatcgtgtcggccgatgagggtaccaccatctggtccgccggcagtttctcaggtaaaggcggcatgctggtggggaatgtcatcaaccatggcctgatcagcccgggtaattcggccaatccgtttgacgtgctgacgatcgccggtggtcttgcattggaagagggcagtacactagcttttgagattttcggtccaatgttgtatgaccagctttttgttaatggtgattttacaatgggtggctcgttggcgctggattttgacaattttatccagccagcttttgatactacttatgacctgattcaggttggtggtagcctcactggtatatgggataattttgatatcaatatctccgccgggtttgatcccagtctgctgacttacagcatcgcgggtagtgatagccctgattccagtcaggtgcttcgtctgactgttgcaggtgcgggaaatcctattcctgaaccagctactatcctgttgatcggattgggcagcatgatgatgctgtggcgcggagtggcctggttagctagcagcagcaactaacacatttttccgctgcgtatgcgtgcaatagtcaagccggaggctggtctttaaactttaaaggaggttaagttcaattatgccaaccagttacgatgtcaggttattgcaaaaaaaggaaatagccgaaggaacgacggaattcacgctggaaaagcccaagggctttgagtatcgcgcaggtcaatatggtgatctggtgctgccaccttccaccgggctggacgacagcaacaacaaacatggcttttcattcgtcagtgcgccatttgaggacacgttacgcatggctacccgcatgcgtggattcgctctataaaagagcagcagccaaagttccggaaggggctatggtgcaactgcttgcgctgtggggagatttcacactacaaaaaaacgaggctgtaccggtagtgtttatcacaggtggcattggtattacaccagtgcgcagcattattgcgcaggctacgcatgacaagacaaattacaaaatcacactgatttacgccaaccgcacacctgcacaggctgcttacactgatgatctgaaatggcttgcaggagaaaataaaaattttacttttgtaccggtgtacacatcaacccaaggtcacgttaatgcagagctcatcaaacaacatgtgcctgatattattgcgtcgcgctattatttgtctggcccggaaggcatggttaaggccatgcgcgcactgctgattgagattggcgctgatgaagacaacatcagaacagaagagtttgaaggatactagcacaagcatatgacgacaaaaaattctactgacatttatttatatctgatctggtactttgcaccgaaaaagctcaattgatctatccgcaggatcattctgattcaaggccccctgtaaaaaagggagccttctactatttcaccagccagcgagtggacattccagccatcatatgatcgttgacgtggcagtggaataaccagttgcctggtgaacggggaaccatgtcaacagatctcatgctggcaggcatgatctcgattacatcagttcggcgaccattatccagcacggtctgcccatgccaatgtactgtgtggttatccacttcattgcccagtgcgatcagatgccagcgaacacgctggccacgtgtagtttcaaagccagacagattgccgaaaatccggccattgatcgtatgtttcaggccgctttcctcatcattttcttcgttgaatatcatgtatagcgcgataaactcctgatctacatcgcgtggaatagggcctctattcgaacgcgctttattagcagcggtgacaatgatggttccgattaaccccaggttgatttcgtgttctgccatgacatgcgagtgatagagccagacaatggatgaagggtcatccggaccggggccggcatcccgatcaacgacccaggtataagtgtagcgtccacccggaggaatactgccgcccgcaccaccatcagcaccttcattatccttgttatacatcacgccatgagggtgtattgaaagtggcagatcagtgttgttcagaaaatggaccttgatgatatcgcccactactgcgcggatggtgggacctagaatccccatccattcaggctgagatataggttgggagtaactgttgtcggtataaccgatatagcgatatttggtgtaaaccaatgtgtttccgtagacacccagaccattttcgggattgatcagatttccgccagatggcgcataattccaatctgtcttttctgcggcgatccagtactcttgtgtgtccctggcttgtactgaaaaagatgccaccagcagaagcagaaaaacaaacaaaatcggatatgaccataagaatggatagctgttttttgtatacatggatggactctcttttagtttgctctcaacgcatgacgctgttagggatactctgaaaaatgatctgtgttgcctcactacggtaaacacagtctcaaaatacgcatttactagctgtaaaccgtatttttcgcctgtgtttaccttgtgctggcttcttcattaatattttcagaggatcctgagtaacagatgttatgtgtgtaatgatcaagttgctggcaaatgtgatgaacccggtttgttcagataacggctgcctcgggagagaatctcaaccgccttgccaaaagtaaccagatccgatcgttgcaacatgacgcaatatttgcgagtacgctggcaatatcgtctgacggtaaaaaaatcttcatggttgatgcagtccgccggacaaatcacgatatttacgcaatcaagcagagcgagtagacaatttgcattgccctgcacgctactgcgaaatgccataaagtggccaccagcagcctcaatcagacggtgataatccggatagagtgctgcacgtccgcctatacataaaacagactgatcaatgagatgacagcaaccatctttcggacagctgatagcgggtgtgacgagatatggatgtggctggcctgatctgatccagtgcaaactggcatcaactggcgttttcagtgtgttggtattgacgtggcaatcaatcggagttttggtgtatgcgggattttcaggctgaagtcggactgtgttcccatgcgcggtgcgtgacaaagctgaacagatcaagtgatacaaatgctttaatctccatcccagcctgggagcttgttgcttgtcttgataggaaaatgtggtgaacactgctttgcttcgatgaatttcgggtaatttgctgaaatttggctgtgcatcctgaccgactgacgccaatgctgttttttccagaaatttcataatcaattccatctcagaaaaaaggctggcttgccccgggaggaggggctggcttgccgtcataaatcactggaagaggagagagagaactgccagtgattgctatgaaagttaatatccgtcagctttgaacgtagatcaaaaatatgcttgtaaattattttgtcagtatcagtttatcgttgcgtgtcaggcgtaagtgatattgctcgccccgatgctgaatgagtatttcattgcctatcccgaacaaagttttgctgctgatcaacttgatgggaaactgtgaaatcagtccatcattcaatttaggatccgtatggtattcggtattgatggtattcatatctcgttccagtcaaattagttaatgagaatgattatcattgtactggtaaaaataatttgtgcaagcgtttttttgaagaaaattgaattttggaaggggtgcagagattaatttctccggttatttctcttttggcgactttgactggaaacttttcaatccttatgctcggtaacgcatatctacatttgcccgtcgacgggcagtagcaaagacatgatagccgcgcttttgcaggccatgagcagtgcaatggctgataccactggagcgtccagtgatcaatgtctttttcttcatttttcgttttacgtggtttaggttgagaatccagattctcgtttttattgcaaccggttacgggtaaagataattaccatgggcagtgtagtgagggaaatcgctgccagtggccagaggtttgcaaggatgtcccagggtggaagcgccttgagaaaacagccttcgataatgatcaaaaaatgagtgagcgggatggtttgagataaccattgcaacaatactggcatattttcgactggcgtagatagtgtagtcatgaaagctgcacgcactgcctctctcgaagccaatggcaatgatgcgaacaaggagtttatggttcttccggacacacgcgtgctatcgttgcgcatgatgccgatggcaacgggtacatggcgtgtcacagacacatactgggcgtgtgctgttctggcacattcaatggaaggcgttgtgagcagcttgtcggataaacaattgagttcaatgagtaattgcgtggcggttcgattgattgatctttatggagatttgctcttatggctaacaacctgcttcctctcagcactctgggtgccgtcgagaccaatggcacggtgagtttcggattctggctaccttgggtatcggctgccgacggtaatgcagtcacggtcaagattattcacgagcacgatcagtttttgcaggagattccgccacgggaattccccatggcccatagcgtgcgctcgccttacggcgacttttggtcggcgactgtgccgattgtcgggacgacaccggcaaatcccggatcggcctggggtacggctggacggtatgtctatcgctatcagatcaacaatccgaatgtcggcatcctcgactggatcatcgatccgtgcgcgcgggagtttggcgttggtaagctttcagcgtttacgctcggttatcaaccgtataactggagtgtagccgaggcaaattggcgcacgccggagctctctgatctgataatttatgaagttaacatcgcagagcttggcggcgacctggagcgcacgcgcgatcttatggtctatcttagtgatctcggcgtgaacgctatcgaaatcatgccgttgtcaaacgttgccatgtcggttgattggggatatctccccatcggctatttcggcgttgatgaacgattcggtaagcgctctgacttccagaaactcgttgatattgctcatcagcaaggcatcgccgtcattgtcgacgtcgtatatggtcataccggagtcgatttttcctactacgacgcttacaatcgcctgcagtatcacgaaaacccttttatgggatctttcgccaaagattacttcagcagctttggaaagagcacaaactttgagagcccattcacacgcgactattttttcacggttaaccatcattggctcgaggtttatcacatcgacgggctgcgctacgattgcgtgccgaattactgggatgggccattcggtgtgggatatgcaaaccttgtctatgagacttaccaactcaccaaaaacaagattgcgcaaaatcagcgctattggaatcgtttcaacgcgggtgcaggcacgtcgctcaggctcattcaatgtgccgagcaattagaagggccagaggaggtgctgcgcacaacttactccaacagcacctggcagaatcataccttcgacgctgctaaggcggtggcacgtggcgaccagaggcgactggctgactggggtttatcgctcggtttacttggttacccggagcaagagaacaccaatggagacgtgattactaaaactgcgttgcaatacattgagaatcacgatcacgagcgcttcatttgtaatttcggtttgatgaatccggacgaagccggtaatccgctttttctcgagggcgaccgcagtcgctggtacatgctccagccctatctcatcgccatgctgatgagtaaaggcgtaccgatgttgtggcaaggtgaggaatttggtgaaagctattttttgcccgatttcggctcagggcgcgtggggcttttgcgctcgctgcggtgggattatttctacgacagcccgggtcagcagttggtgcaactggtaagaaagctgttacgcattcggcgcgatcagtcgcagatccgtcgcggcaattattttttctttaatgattgggaccgctatctttcaaagcgtgtcttgctgttcgcacgttacagcgacgcacaatacacgcttgttgcgattaacatcggcgatattgatcagacggtacctttctggtttcccatcggtggcgactacaatgaagaacttcatggcggtgatctggggctcaaaggaattacaccccttcaacaaacttggctcaaggttccttcccattatggtcggatttggacggtgtaggagtcgcaagggtatttattgttggataaataaaaatttgataggagggttccatgttcccgctactttttattttgatggtcgccagcatacctaaatgagtcattatgttgagcacaggcgtcttttgtggttcgtttataaccctaatcaagactatgcttaaaagtgcacatgcattgtatagagcgaggcgtgttgtcaaaaatagcgggcagaataagttgctcagtgattatcagggtaaagttctacggatgatgaacatcaccagtcagtgtggttttgagctgcaatatcaagggctggaaatgctttatcgccactatcgggaagataagccggaatcaccggccagtgatattgaacagctgctgtaacctgccacacaattcagattcaagtccctacatgaacaaagctggatagcacgaatcagaattgatatgaaacagccagtttgtagttgcgtcccggatctttcaacacgttgaggtgacggcgataatccttgtcagtcagattgtcgattccaaaatcaaaacgtaaccctttagccgggccgttttgtggcagccaggttaatgttagatcatgcagtgtatagccaggtgtcggggttccacctgttggtacacgatgttatgcactgacaatactgctgcgccagcccagggaaagatcatgagttggccaatttaacccggccattacaatccatttatctggctgaacattggacaatactccaccactcgtccggttgtgaccccgggtctgagcgtaggagaagccggtgtagccatatttcgtcgcatagctggtctctatttcgaatcctttcagcagggcatcatgtacattgtcactggttgtggtaccgcctctgcctaggttgccaggaaccgggcgaaagacaaaatcaaccatcagatcaacgaaatttttaaccttattatggaaataagttccgcgcatcgtcagttgatcgttttcaaacagcagattcgatttttgtatgcgtgcgccaatttccttattgaaggcagtttccggtttaagatcgggattgggggtaaacagattggaacaccttggtccacaagtgaaatgtgtaccggtcgtaaacagttcgcctagtgtcggtgcgcgaaatgcttcgctgtagccaccagtgattgagaaccattcagttaccttaagcagtccaccaagcttgaaattgacgcgatcattttgattggagctgacggatatgccatctgccttactgctgaaataatcccaacgtataccaggaatgagtgacaatcgttcccacaacgtgatttcatcctgtaaatacaagccaacgacatctgcttcaccccgggggaattccggtcgtgtggcaccattgcgtttgcctttagcttcattatgaaaataatcaacgccataggtaattaattgggttgtaaaactgttcaactcaaggcgcgagctgttgcgtgcattgatgccggtcgtggagaaatcagtttcatcgcgccgccggtcaaataaccgtttctcgagactgtaggtggtattgtggtagaccagtacttcaggattgagccaggcattatccacattttcataacgatagcgcagtgtatagttgcgctgctcggtatcccgatctaccagtgtgtttgccgtagaagcagcttgcgagttggaaggtactttaccggcctgatcgaacgtttgtgcagaaaatgtgaagcgatgatcgcctggtgtccagttaaatttggccagactggcataggattcaaagcgggagttttgtagtttggagccgtcgccgtgacggatatcgtcggctgcattacggaaggaaaaatcaagcagataatcgaattgttccccagccagcccgtaagcactgatgccgggaatatattgctcgttcatgctctggaatccccctcgaactttcatgccgaaacgctcaccggtacgcagcagatcggttgcatccagcgtggtgaaggagataacgccaccgagcgcgccactgccccatacggtggaagccggcccgcgcatgacatccacgcgtttgagcagactagggtcggtaaagatgcgggcattgtgaccacggttgaaatcctgtctggcaccatccagcaggaacaggatgcgatcatcccccatgccgcgcatgaccggactaaggcccagattgcgcggcccaccacccagttcaacgttaggcaggtaacggaggacatctcctatatcagctgcttgccgggtccgtatctgctcggtatcaaccacactgactgattcgggcacttcgcttacctttcgactggtgcgggtagcggtaacggtgatttccttcaagccagcggaagccagcctactttcagattttgtgccagctgatgttgtctgtgcatgaacagcattagaaagcatcgatacagccatgatgattgaaaaataaaaaatgttgagtgcggctggataatgcttgcatctcggtgacataaaaaatacttcctccagaaatgagtaatttctggctggctggcgtagtgctggctggctggaatggcggcttttgttgccgcggtaatgtttttagttattgatggcttcctcgtgctgctttattccttgttgaatttgttcatcgacccattgcgtgaacaaggggtgaggcgcaaaaccttctcccagttcgaatttgagtccctccaggaattttttttctggaccagtactggtcgtgcgtgcagggatgacgatggctgtgcccccttgtttgttggcttcggttaccatggctcttgtttttttaacccagggcgcacgtttttctggccaatcttcgcgccaggtggcaaccttgaaagctttgaaattttcaccgccattgccgcgcatttgatgggtgatattttccagattttgcaaccatttatcgttgtgctgatcatcctgcgcgccgtgcgcagtcagaatgatagtttctttagatgggtttttggagagcgcaagtgcacgatcaaacagtgcttttgcaaatagggggctatcctcataaccgcctgtccagatggccggtaaggatgtcaggatcctgggaacgggtttgctggattctccatgtccgtgcttgccatgtccattctgtgttttgctgttggctatagcttgcttggtttcaggatcctcgatatccatcccgaccaggtgtgcgatttccttacggaatgaatttttggttgcgaaggcactgacgataattgctgctttggcgccgcgctgctccagcttgtgcagtgcatgttcgattgtaagaggatccgccatggaaaaggcaaattcgattttgtagcgatccatcagggggtgtactgctgtacgcagattctcattccaatgaaaatcagaaccatgagcaaacaggataacgcccgtatcttctgctgccaggggcagatgacgattagcttcccgcttcatccacatcgtcagttgctgtggttcgattccaaaattattgagtactgcattctgaggtagcagctgtttcagtcgtgcgtcgagcgacatcatgctgtcatgtttggggcccagagcaaacaagataacctggttcttgctatttttaatggccggaagagatgttagtacgttggaaagttttcgttttgtactattcatgtagccttccggagattcgttttctgatctttctgggaggatcagggcattgatcgaacgaaaattgattcctgctgatgcctgtttgataattcgcatccagtcgttatacatcgcacgtctgtccttatcattttgtgcgccataacctactacaagtaggttttgacgggcagtatgttccatggtgcgcaaccaggcggcgagcgcctcaactgcgaaataactttcaccataaggttgcgcaaaaatagtgggggcaattttatttttctgcgtgatcagctgataaatgagttgataatgcggttctgctgcagaaataaacaaaggcaataccacaatacggctgacattgcggctatgcaggctggccaatgcagattgcagggtttgctgggtacgctcgtcagtaacgaataccagtgctgccggatgattgacggagaaaggtaagaatgcttcgcggatctcctcgttgcccacaaagcctcgatcggctgcaatcaccaaaaaaccggtttgatctgtcgattctgtattggtcgcatacgccccgccggtacttagcagaacaaatgccaataaataaaacgacataacagtttttactgttctaattccaaaagacatgctttctccgtgttgtgttatgaatcgaaaaataagaagagcaaaaactgaccagcagataacgttcagcacctacgccgtggtttcgggtagcaagctagataaattattgatgctggcttcgcctgctgcaatttttgctaatgccgtggcgaagctggaaatgcctgttcccttgaacaataaacaaggcttgcgccccaggcggcaaagtcttttgatctggtagtaggcagcatggctgacgcaatcagtcgggcaaatcaccgctgtggcgccatataccatttccggtaagcgggataacgcatcttcctgtccaccgtcatgatgtgacaatttgaggccaaactgtctggcaagtacgcggtagtgtggtagttgtgccgatcgaccgcccacgcacagaatgcaatcgtaagaagcggtgggggcatcaactatatcggctggctctttatccatggtatgagtggcactaaaagccagcagcagattctccagtgtatctcgctcggtatggagggtatcccgttcgcgataaagttcagtcagattgtggcaggcttttttgagtgatcgcttgagttcatcagcttgagcgaccttgatttgcagttgctcgttttctgttgtcagcagcatcaggcgctgccccatactgatcatggcgcagccggattccagcattttcaggcgctgacgcagggtttcatcttcccgtcgggattgctgtaattgccgaatttctacagtcgcctgttccagccgctggcgtaagcgcaattcggtctgtgcgtgttttcccttggcctgctccagttgctcggtcagctccttcagtgcctgctctgtttgacttacccgattctgcatggccgaaagcttggcgactgcttcatgcatgtgcatatgaaccgtatcgtgaatttcctccctggttccagaactgatgcgcttgtgggtaagtgctgcccacagtgatccggctactttcccgttggaaaagtgtgttctccaaagtgtcaatacttcgttgtcagttttggctgcctcgaattgtttgatatagctccgatgcaatctgtccagacgcttatgaatcgtttctgatacggcatttctggatgttgcgcagcaaaccgcctcgacatgtagagcatgcgcgttatttgttggagcattaaagtgaaaatgtctggcaaagcattcaagatctgaaggaggaaggcaaaggccgataacagggcagtgatgggttctgtccagctcccagagtttcatgcgttttacaggaggcgtatggatgccgattgttttttcaggtaataagctattgattcccggctgtcgcagaattgctggtgcatgcatgcggtatctcctagtggtgaaaatatcgatctgaatcaaattaggcaatatgaaacaagaatgatactaattatcattgtcatcatcaacaattacattgtaatcgatcggatatacctcgtgatcagggctttatttacacatcaagatgcgacaatttgtcgcattttcattcttttttgaatcagttattctctgatttttgacgtaaatcatgaagaagttaatgttttctctccctgcactggctggattatttttcacacttgttcccacggttacggtcgcaactgggctaagtgccagtagctcaacacagcaaccgcttgcagtgcctgcctcaaaatcccccagatctgcacttggggtaggggtaatactggatcaggaagggcggttatggttggcaaaagtggctaatcagcacttgctggtttccaggtcagaagatgatggaaagcatttttctgagcctgtgaccgttactcttgcaccggaaaacatagccaacgatggtgaaaatcgccccaagattcaggttgtaagtgatggtacggtgcttgtcacctggacacagctactaacagaaaaatatgccggaaatataaagttctcccgttcaaccgatttaggccggactttctcggagccggtcattctgaatgatgatggtcatgtgaccagtcaccgtttcgattcccttgccattgatggcaagggaagagtagtagtggcctggctggatgcaagagaccgtgatacagcgcggggaagaaatgaagagttcaagggtgtttcactctatagcagtcaatcattcgacaatggtgcgcacttcgagcccaatcggcagattcaccagcatacctgtgagtgttgccggactgctcttgcctggaccagtgaggggccagttgtgctgctgcggaatatttttagcgccaacacccgtgatttcgccgtggttaatctggacaagacggaagaggaggcaagaagagttacccatgatgaatggcagatcgatgcctgtccacataacggcggcagtcttgcgacagacagcaaagggcaattgcatctgacctggtttaccaatggtacagccggctcaggccagttctacaaacggatcagtggcaaccttgagtcgaaacccatggcgctgggggatatagatgcccagcccaaccacgccgcagtggtagcacatggtgaaaccatcctcctcacctggcgtgaatttgacgggaacgtctattccgcaaaaatgatgttttcaaataatggtggcgagacgtggagtgagccatggcgcctgatgttatctgctggtgcaaacgattatccgctgccactaattagcaatgataaagccttggttgtatggaataccgacaatgaagggctgcgaattctacccgttgaaagagtaattaatcgatccggcagctgaaagccatcttcaaaacaacaataaacagcagacaacttatgacatgtatcacaaattagtgatacggcatcaggcattgctgcaaatttaatcacaaatctgaaaggatggctcaaaccatgaagcaatttcctctgacattgatcggcctgttttgtgcagtatcaagttacgctgctccgggtgatggttcacctggaaagcaagcccagagtgagagtaacagggagtatgcgggagagcaattggcgcaagtggctgaatcaggcagtaatgcaggtgctgataaggaaaaagggaagaagaaaaaggcaggtgagattgccccacaaaacagaacagttttcagggaaatggtggtgacaggcgagatagagcgagattcgcgctttacttcaccttcaatgcgtgtaactcggacgcaggtcgagcagcagaatgcgcaaactacggaagaagtactcaaatacatgcccagcctgcaaatacgtcagcgttatgtgggtgatccgaatggtgtgctggggatccgcggggcagatatgttttcaactgcgcgcagcatggtttatgccgatggtctaccgctgcacaactttctgcaggcttctttcaatggtgcaccacgctggtcgctggtcgggccgaacgagatcgattcggttgatattgtttatggtcctttctcggccgagtacagtggcaactcgatagggggagtcgccaatattagaacacgtatgccgaacaagcaggagttttactttgaaggcagcttgttcattcagccttacgaaaattacggatcggataagggaacatttatcggtgatcggcagtatatttcctacggtaaccggatacaggacaaatttacggtgtttttggcctataaccggctggaagcccagggtcatccgcagtcctattttatcgacaacaccggattgttcaacgtccccggagggacaccggtgacggggggtatcaggacgccggatacgcgtggcacgcccagtatcatttacggtgataccggccccgagaaagtgaatactcacttgttcaaggggaaattcggatatgacattacttctgacttgcaagcgctgtttaccgtggcgtatgaagaacgtacgcgcaaccagaaccatcccaataactatctgcatacagcaaacggtaattatttctggggaggaagttcacctgtctgtaactcagttgtcacctgttcaaatccgggcaatgcttccctggatggcacccgtttcgacgtggtgcgaaatggttttggcagtagccgcgacaaacgcgagacattgaatctgggtttgtcgctgcgcggtgcgctaacgcctggctgggatgtcgataccacgctcagctatttcgatgtgttaaaggatattcgtgcggctgcatttttcaatcatgctgatccaggcaataccggtgccgggcaattgcaggattttcgtaaattcaactggtggaattacgatctcaagctgagtacaccgatgttgctgggttacgacaaactgtcgttcctgaccggataccattttgaccagtacaaccttagtttccggcaatatagcctgaccaattatgatgatctgacccggggtgcgttgcagactaatcgcaacaatgatggtcgcacatcgacccatgcgatctttgcacaatcgatgttccgtttcctgccggactgggatattacagctggtgtgcggcaggaatggtgggaagcaagcaaaggagtcgcttccaacgtggtggtgccggatcgcaccgagacagccacatctcccaaggtttcactgggatatgaaccccggcagtggaaattccgctattccttcggacgcgcgcaccgcttcccggtgattgcggagcttttccagtcactcggtacacctaccagtattctgactgcaaacgctctactcaaacctgaaaatggcgtgcaccataactttatggtggagtacgggctgccgaagggttatgcccgtattaacgtattccgggatgacatcaaggatgccatccgccagatcacttccgcctcaggagtacttacaaccagtgcattccagaatatcggcgaagttggcacaaccggagtggagctgatcttcgaacagagaaatattctcggtacacgatttgatttcatgttcaacggaacctggatgaattcaaaagtggaagaggggccagttgtgaaatttaccgaatcaaccggtgtgtctgccaactacagcttgaccggaaaacaggttattcgcctgccgcattggcgagccaactttttcggcacttatcatgtgacggatgcttgggacgtttccttatctggccgctataccagcgattcatataacgaccctgataacagagatcatgtgaataaggtatttggttctcagagtgattttttcttcatggatttcaaaaccagttaccggtaccggttcaataacgggttgaaaagccggttttcgttcggcatcagcaacctcaacaatgacaaggcatgggtataccacccctatccgcaacgtacttatctgcttgaggcagcgtttagttattgagcccaaataatccgctcgccgttattcggcgtcctgatggattattgggattgaagttacgggtaatcaagatatatgtcatctggtaaaaaccctgttgccagctacgtctccaggccatgtttagctcggggtgcgacaatttgtcgcattgagatgcctttctggccggcttatgattgaggcgctcagtatgggtcatcctataagggagcttctaaaatgggttcccggttgaattttacgcttcattccgcacaaccagatttttaggggtatccatcagttttaaagctttcaaaacagggaaaaatatgaaaggcagaaaaatcaaacaaaaacaaaaatggggattgggagtcgaaaaaatcggttacggcaagtctctaatgccattgacggttgcggtaaccggggtgctggcagctgttgcacccatctgggtacaggcgcaaagtacggatgaatcgatacaactgaaaacaatccaggtgatagcaccagagatagagccagcgatcacggtaccgagcttgccagaagcaaaacgtgccatgcgccgggtgccgggtggcgccaatgtgattgatagcgaaacgtatgccacgggccgtgcttcaacagtgcaggatgcgctggggtattcgcctggcgtatttgtccagtctcgtgccggtgctgaagagtcccgcctgtcgattcgtggctcaggtatacaacgcacattccatttgcgcggcatcaagattttgcaggatggatcgcggctgaatctggccgatggtggggcggatttccaggcaattgaaccgttggctgcccgctatattgaagtgttccggggaggtaatgcattacagtacggatcaaccatgctggggggtgcgatcaattttgttacgccaactggttacgatgctgaacgtttccgggcgcgtggtgaggcgggcagttatggctataaccggctgatggcctcttccggtggtgtgcatggctcgctagattattttgccagtatctctcgctacagccaggatggcttccgtgattgggccgctaccgataactggcgcatgtttagtaatgcgggttaccgtatcacccctgatctggaaacacgtttttacttgacctatgttaaatctgactcagagctgccaggtaatctaaccaaagcacaattaaaatctgatcccaggcaggcgaatgtgtccaatttgcttggacgacaaaaacgtgaccttgatctgattcgcgtggctaatcgcaccgttctgaaattgggcagcaatcaacaactggaattttccggattctactcacacaaggatctgtggcatccgatttacgaggtgctagcgcaacccaccaatgattatggcgtgggattacgctatatcaatgaaatgccgattgcgagttatcgtaaccgttttgtgctgggtttcgaaccgagctggggcaatgtcatggataaccgtttcaagaatgatggcggtaatgcgggtgcgcgcactgccaaatttgatcagcatgccagcagttatgtggtatacggggaaaatcagttttatttgctgccgcaactgtcactgattgcaggtgggcagtacacttataccacgcgtaaacaaaaggatctgtttacggcaggtgctctggatcgaagcaagaactaccagcgcttcactcctaaggccggggtgatctatgatctgaatccggatatacaattttttagtaacgtcagtaccagtttcgagccacccagttttgccgaattgaccagcgggccggttcaggcgccaacatttgcaaaagcacagcgtgcgattacatttgaagttggcagccgggggcgttttgctatggctgaatgggatatagctttgtatcgcgcgcatgtgcgtaatgaattgcttgctagttttgatcctgtacagaatagacctaatgtcacgcaaaatgcggataaaactatccatcaaggaattgagttaggcctcgacattgaactggtaaaaatgctttatttgcgtcagatgtatatgttcaacgatttcaaattcgataaggatgccgctttcggtaataaccagctggccggtattccgcgtcatttctataaggctgagctgacgtatcgccacgctgacggctactatattggtccgaatgtggagtggtcaccgcagaagtattatgtggatcacgccaatacagtacatgccgattcctacgcgctactgggttttaaaattggcaaacggagcaaaagtggattttcctggtttgccgaggcgcgcaatctgaccgatcgcaagtatgccgccactaccggtgtaatcgataatgcaaaaggcatcgatcaggctttgttcctgccgggagacgggcgctctttctttgccgggctggaatatcgtatgtaacacattcattcttccgctggctggatcggctggcgagagtgaatgtttaacttaaatggagtgaagatgtcgattaaacatttcattgcagcaatctttatggctgtaatttctgcagcaattccttttactgaggcggcagaacatgcccatgacgccaaggcagcaaaacccaagcatgatatgaacaaaatgtgggcagaaatgcgtacccgggcagttggtatggctgtttccgtggcggccgatgaaaagggagtattgtggctggcacgtatgcaggacggccatctcaaagtgagccgctctgaagataatggcaagcatttttccgaagaggtgactgtcaatccacaaccagaagcaattctggcggaagggcagaatcgacctaagatcgcggcacgtaacggcgtcattgtcgtcacctgggtgcaggcattaccaaaggtgttttccggcaatgtccgttttgctcgttcagtggatgagggcaagactttttcagcgccggtgacagtcaatgatgatcacgaagaaaccagccatggtttcagtacattgacactggatgatcgtggccatgtaacagtggtctggtttgatggacgtgagcgcgatgcagccgtcaaatccgggcaggaatatattggcagtaccgtttattacgcagtgtcagaggatggaggggcgagtttttctgcaaatcgtaaactggcagatcatgcgtgcgagtgctgccggatcagcatgacgctgggggttaatgataccccgtttgttttctggcgtcatatcttcgatggcagcatgcgcgactttgcactggcgcgattgggtgcacaacccagggtagttcgggccagtgaggatggctgggaaattaatgcctgtccgcatcatgggggggatattgcggcggatgcagtgggtgacattcatctggcgtggtttaccggtaatccggagcatccaggattattttatcggcgtattgatggtgaaaaaatgactaccactaccccccatgcatttggggatctcgactttcaaccaggtcatcccgctgtatttgcgcatgataaacaagtgtttctggcctggcgcgaatttgatggtgacaattaccggatgatgacctctgtttcggcagatcggggcgatacctggtcaacagcgcgcatcgtggcaacaaccagtggtgcagcagatttaccgatatttgtaacagatgcgcacaaaccgcttgttgtctggaacagtacgcaagacgggatacgtctttttgatgtgggaggtgattaatgatgcgtcgcttactatgtatattgctgctggtagtggcaggtgctgcttcggcagcggataacttgcgtccctttgtgtccggcagtatggcgcaaattcaggaagagtatgctggcaagccttttgtgatgtttctctggtcgctgacctgtacctactgtccaaccgaactggaaatgcttggaaaattcaagcggcagcatccagagctgaatctggtgttgattgcaacggatacaccggaggataggccggaaatcgtttctcatcttgccggttacggattaagtgagattgagagtaactgggtatttgctgaagatatgcctgaacgtttgcgtttcgagattgaccgccgctggtatggtgaagtgccgcgtacctatttttatgatcaagcacatgaacgcctggtcaagaccggtctggtcggtgaggcatttgtcaagaaatggctgacgcttgtcagcgcgaatacaccatcgacaggcaagtaatccatacccgtacttttccgatcagatctatgtatagctgatctgtctgtagccgatctgcagcaagttttcgttctttttagttgggcagcttgctctttagggctcatgcttgtaatcttttttatcaggctcaatcctgctctagttgcggcaggtggtgtctggcctgaaatttgaccatgcgggaggtgtcttgagcaatccattcgttgttagaaaggctgcagtactgggggcgggagttatgggtgctcaaattgcagcacatctggttaatgccaacatagagacattactgttcgaattgtcggccgaatcgggtaatcccgatgccaatgtactgaaggcgatcaatagactgaataaacaggacccttctcccttatcggtaattgaccgggcaagctgtattgaacccgccaattacgagcaacatctggaaaaactgggtgagtgcgatctcgtgatcgaagcgattaccgaacggctggagctgaagtcggagttatacgaaaaagttgcaccctatctgaataatcaggccattctggccagcaatacttctggtctttccatcaaccaactggctgcagccgttcccgaagccctgcgaccgcgtttttgcggtattcatttctttaatccacctcgttacatgtatctggtggaattgatcccaggaaaacagagtgatcagggcgtactcgatgcgctggaaagtttcctggtgaccagtctgggtaaaggtgttatccacgccaaggatacgcccaactttgttgccaaccgagtgggggtcttttccatgctggcgaccatgcaccatgcccggcaattcggtctgaattttgatctggtggataaattgactggcccgttgatcggacgaccgaaaagtgcgacgtttcgcactgccgatctggtcggactggatgtgctgacgcatgtcgtacaaaccatgtgggatgggttggtggatgacccgtggcacagctattacacagctccggactggttgcaaagattggttgatcagggtgcactcggacagaagagtggcaagggggtttatcagaagcagggcaaggaaatccatgtattgaatccggatacggatacgtatcaactggcacagagtgaggttgacagtgaaatcgaagcgctgctgaaacagcaagatcctgtagcccggtttgtggcgctgcacgatcatccccatccgcaggctcgattcctgtgggcagttcatcgtgatttgtttcattattgcgcagttcacctggaatcaattgctcataatgcgcgtgaccttgatctggcgatacgttggggatttggctggcgacggggccctttcgagatctggcaggcggcgggatggaatacgcttgccggttggatagcagcggatattgctgctggcaaagccatggctgcaacgccgctaccagcttgggtgcaggcggttggacagagtgctgctcagggagtacacgcacaggagggctcctatgcgccggtggcgaacaatttgcagccacgttcgcagttaccggtgtaccggcgtcagctattcccggacaggctggttggcgaggaaacggtttatggtgaaacaattctggaaacagacgcactgcgcatgtggcataccggagatcagattgccatcgtcagtttcaaaactaagaagcatactattgataatctggttctacaggggatgcaacaggttatcactgaagccgagcgtcattttcgcgcattggtaatctggcagaccgaaccgccattctcactaggcgccaatctgcaaaaggcggcagaaaaaccgaaaacagaagtatcgcaagctcctttggcacctccggcaccaccttcagcatttgatctatttatccggaaattcaaaaagtctgcacagtccaccattctgcaagcagcccgcagcctggatatggccgacaagctaatggctggaaaactggctgaagtggaagtgatgattgcccattttcagcagatttcgcagcagcttcgctacagtatgataccgaccgttgctgcggtcgataatatggcgctgggtggagggtgcgagtttgtcatgcactgtgatcgcgcggtagcaacactggaaacctacattggcctggttgaggcgggtgtagggctgctgccagccggaggcgggtgtaaggaatttgccttgcgcgccgcgcgtaatgcgattgatggggaccctttcctttatctaaagcattattttcagacggtggctatggcacaactggctaaaagtgcagagcatgcaaaggcattgcattatctgcagcctgctgatgtagttgtcatgaatcgtcttgaattactgcatattgccaaggcacaggcgcttgcgttggcagaaaccgggtatcgtccgccattgcgtccgcgtgaaatcgtagtggcaggggcaacgggagctgctacgatcaaaagtaatatggtcaacttgctggaaggtggctttatttccgagcatgattacctgattggcagcaagattgcgcatgttatgtgtggtggtgatattgtcgtaggcagccgggtggatgaagaatggttgctgaagcttgagcgtacagcattcattgagctgctagcgactgaaaagactcaggatcgcattgcgcatacgctgaaaaccggtaaaccgctgcgcaactgagtgatttggagttgcggaagatgggcgtgatgaaataaaaattcaagcattgaaggagaaactgatgaccaggcaagtgcaggaggcttatatcgtagccgctacacgcacaccggtaggcaaagcgccacggggcatgtttaaggatgctcggccggacgacatgttagtgcatgtgctgcaggcagtgctgaaacagtgtgcagggctggatccggcagcggttgaagatgttatcgtcggttgcgccatgccggaagcggagcaggggattaatgtggcgcgcgtagcattgctgctggctggtctgccggttagcgtgccgggtgtgacaatcaatcggttttgcgcttccggcctgcaggcggttgccatggcagccgaccggattcggttaggtgaagcggatgtcatcattgctggcggtaccgaaagcatgagtatggtgccgatgatgggtaacaaagtggcgatgaacccagctttatttaagccagagagtgaacaggtagccattgcttatggcatggggattactgccgaaaaggtggcggaacaatggaaggtcagccgtgaggcgcaggatgaatttgcactggaaagccatcaccgtgcgattcgcgccatcgaacaaggggaattcagggatgaaatttctccttatcccgttcatgaagaccggccggacctgaatacgcacgaaatccacgatttctccgtcatcagggatactgacgagggaccccgggcgaataccagcccggaagcactcgcccggttacgtccggtgtttgcagcacgaggatctgtcacggcgggtaacagctcgcaaatgtcggatggagcaggtgcggtggtggtggcgagcgaggcagctttgcagcgctttaatctgacaccgatcgggcgatttattggttatgcggtggctggtgtgccgccggaaatcatggggataggacccgtcaaggcgattcctaaagtgctgaaacaaaccggcatcaaacaggatgaacttgactggattgagttgaacgaggcattcgctgcgcaaagtctggctgttatccatgatctcggactggattgggcaaaagttaatccactgggtggggccattgcactgggtcatccactgggtgcgactggtgcgattcgcgtggcaacactacttagcggattacgccgccacaaactcaaatatggcatggtcaccatgtgcatcggcggcgggatgggggcggcaggcgtatttgaaacgctataaacaaagagcatcagtccgatagagcaaatcggactgattttggagggtagctgatttattgggcaggtatctgtaatcttcctgtgaaaattgtttgattactggtggaataagtcgcctcgccctgatgctcccaccactcattttctcccgcaacatagcgcgctcccgatgcagaaactgcaagattaagaatctccatcctgccatcgggaaaagtaagcgtcaccgtatcatcatcccgataaaccgcccgtactgcctgcctggaatctgaaacaaaagttaccgagctgatgattgaagtcgtggggcggggaggtgttagcggtgtgcaggatgtcagggccgcaagtagcgagaagaggataaaatattttagaaatagtttcatacgattacctggtattggggttgttataaagatctggctacaaattttctataacctgcgttgtttatcatatgttcgtgatttggttgttgcgcatgacaactgatacaaaggacagcaagattactcttgttattatcatgcttaaggccatttatatggtgaacatgaagccacttcctttttgaaggtgcagaaaaatcacttctacagctttggcagatccagcccaaatctcctctaagtttttggcttatctttgcaaaattttctggatatatatttagtggggcattgtttgatgtgtttccgggtaatctggaatgaagagatttcggatattgctcaaaaaaatcgtctattttgaactctctaagaattgtaggaccgtagaccaaaattttatcgtcgtatctgatgtagaaatataggatcagaattgatatgaacccaagaaataacagagtatggatgggtagctatagtggcccccgattttcagacaataaattaaggtggtaacctgctgcaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagtgccatcgaaccactggcgctgacccggcaatgcgaactggcgggagttaaccgctccacggtctatgcgccgcacatggccgcaaaaccggacgagcaggaattggcactgctgggactgattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccacccgcacccgcagcacaaagtttatccgtacctgctcagaggcgtgaatgtgatccgccccaatcaggtatggagtacggacatcacatacatccgcttggcacgcgggttcgtgtacttggtggccgtgatcgactggtactcgcgtaaagtgctgtcgtggcggttatcgaatacgctggatagcggattctgtgtggactgcctggagcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactataagcgtagtaaaaaatgacatagtttagaaaaattcaaaatagttttcttggttaaataaactgcttattcggtagaaactttagatttctctgttataaccatttcaggtagatctcggtggttgttttaattagaactgtcttttaggagcagtacctacgattgactgaacgtgatctttttcatcatacgtaatagtgatttgtcttttatgtccttgcattgcttctatgggcgtaccgataacttcccaaaatccaagggtgagaacatccattaccccgtgcccgatggcccgtccagcatctgcttcgttaccaagctcatattcataaatatcctgttgttttctgtcttccaatgttgtcgtagtaatgggatgcccaagatgcaattctatttctccacgtgtggcaccaaccctgattgtcccgagatcgggatcctgtttcccggacaatgccattccgactgagcacccagataaaacagttagggtgatcatggttaagaacatattggtgatctttttcatcgataaatctcctttgagaatttggtattgcttttaaacggctcttctctactgaattgaggaaatgagagaggagtgctgtgtagtcgatattgttttgatcgtgaggtggaagtgtttctaatagcgcttaaaagtagatcatgatttcagataatggcgatacctgacgttaacatcaccaatactttcacttttattcatcagaggtatctggctaaccgggtcttctcggatggtcattctctggcatcaaatcagtgttgatcggaatttacagtcttgcctttgtgttcggtgccgtctggttgttgcagcagccagttttgcctgaaatttattgggcgattgggctgattccgatagtgctggcagctttaattctttcccgactccaatttcgtttttccgtgttggtaagcaggtttctattgtttgttgttatgctgggtgctggttttttctggacagcgttatcggcgcagatgaggctggcggacagtctgccgcatgaatgggaaggaaaagatattgtggttaccggtgttgttccggacatgccgcagtttgcccggtacagcatgcgcttccggtttgatgtggagcaagtgctgacaccggatgcggtagtacctgcccgtattcagctttcctggcatcgggataacaggcgtaagggggttgctttaccgcatatcacagcaggagagcgttggcggttaaccgtccggttaaagcgtccgcatggcagcgccaacccgcatgtgctggattatgaagccagattgcttgagcgtaacgtgcgcgcaataggttatgtgcgagcagggcaggataacgagcggcttgaagcatggaacagtgatccgcactacttctttgagcgtaaacgtgatggaattcgtagtcattttcagcattatctggccgaatatccgtatgcaggggtgctgatcgcgctggtggtgggtgatcaacgtgctattccgtcggagcagtgggagatttttacccgaaccggcaccagtcatctcatggcaatttccggttcgcatattacgctggtggccgggctggtgtttttgctggcttattgggtatggcgtcgtgttggtcttgcattgtggttgcctgcccgcaagtttgcgctgatgtgcgggttgatcgttgccatcggttatgcattactggctggttttgctgtgcccgtgaagcgtgcgttattcatgatgatcatcatcgtggtggcgttctggggtaaccagcgcgtgcgtacactgcctgtgttggggtgggtgttattgctggttgtggtacttgatccgtggtcggtcattgcaccaggtttctggttgtcgtttgcagcagtggcgttaatttgcctggtagtatccggtcggattggtcgatcaagtgcagtaactggctgggtgcgcatacagtgggcgattacgcttggtttatttccgctactgctgatcctgtttcagcagatttcattgatatcacccgttgccaatgcggtggcgataccggtgattacccttgtcatcgtgccgctggcattactggctaccattcccgggctggaatttctgctgctggttgcatatccctttctgcaaattacgatggctgtgttgcagtggctgggggagcttcctctagccacctggcaacagcatgcaccgcctttatgggcggtgattgcagcgaccatcggggtgatatggctactgctgccgggcgggccagggctgggtgtatcagctggttttcctgcaagatggctgggtatactggcaggattgccattatttctggtttttcctgaaaaaccagctgcgggagagctctggctaactgtgctggatgtggggcaggggttatctgtagtgttacgtactcgcaaccatactctactttacgataccgggccaaaatatggtgacagtgatagcgggaagtatgtgattttgccattcctgcgtggagagggtattcagacgctggataggatgatcgtttcccacgcggattcggatcacagtggcggggcattgtcgatattgacgagcgtaaaaaccggaacgttgctggcatcaattgcggctgatcatccgatacggcaagctgttcctgataatcgctattgtcttgcaggagattcgtggtggtgggacggagtacatttcgaaatcttgcatccgctggaaccggagtttttgctacagaaacgcaagaccaatgaatcgagttgtgtactcaaagtaacaacgccacatggcagtgtattgttgccgggagatattggccagaaaactgaggcgagtctactgcaatatgctggtacttcgcttgcttccagcgtgttgattgtgccgcatcatggcagccgatcttcatcttcagaagcttttgtacgacaagttgatcctggctatgctatttttgcagtgggttaccgaagccggttcgggcacccgcatccggaaataatagagcgctatcaggcgcaagacagccagctacagcgcagtgatcatgatggagcggtgttattgcgttttgtccggggcactatagaagttgatacctggagaaagcttaatcgccatttctggcatgacaagtggtctgcagcagatgaggcagactgagcatcatccctcgtaacaagcgcctgaaatttactacccctggtttgtaggaaaaactcctacaaattttcaagccgaattcctacggttgatatggtaacagcccgctttccccaatttgctccctggttaaaaatgcttacatcatttttgagaacaacccggtttaatttgtatattagaaggagcagtaaaaatggggacaaatcagattttagatgaaatcagggaagtcaatctcagttatttgctgctggctcaacaaatgctgcgtgaagacagggttgctgcaatgtaccgtttaggtattgacgaggatatagcggatattctgatcaagctgactaacagccagttattgaaaatggctggatccaacatgctattgtgccggttccgttttgatgacagcctgattgcagaaatacttacaagtcataaacaggatcgcgcactgacacaatcccacgctgcaatactcatggcagggcaacctgctgaaaaaatttcctgagcgcccgtatagaggaggaagtaatcatgaaagtgaaaagtattttatccgaaggtaaacagattcagcttgccactgaattggtccggctgggtgcaaggctgcaagtgctcgaagtatctaccacactcagtcgcgaacgacttgtgaagctgtataaggaagttaaaggtgtttctcctcccaagggtatgcttccctattccgaggactggtttacaggttggcagcctaacatgcactcatcattattcatcaatatttacaattatattacccagtacacgaatgttcgggacattgatgccattatcaagagctatcagctgtatctggaacatatcgaggttaatcacctgcagtgtatattgagtttcacacgcgcatggacattggtgcgttttgtggagagtaaggtgctttctgttacatcctgcgttaaatgtaccgggaatttcctggttcacagcctggatattcaatccaaccatgtatgtgggctttgtcatgttccttcacgtgctggtaaaactaagcgagcagctgtgcagaaggccaaagaggctcaggaagttgagatcagagaagcgtgtgcggtctgatatctttttacagcgttttttgatccggtttcattgattttccacaaatagtcagcacttggttttcctgaatggagccaggtgctttacttcaagatcagccctgaaaaaatagcagagcttctctaacgatccttcattcacggtgtcagtaaatttctggtacctccgcataaaatccgggataatcggctaaagttaatcttgcctggccacctggaatcattctgacaattgaacctgcttaaagcacttgccactgtcagtggtatgacattggtttcgcgtatcctcggttttgtacgagatctgatcattgcaaggatatttggcgcagggatagcgactgatgctttcttcgtagcttttcgcattccaaatctgctcaggcgcttgtttgcggaaggcgctttctcccaggcatttgtccctgttctggcggagtacaagaataaccgcaccaatgaacagacccgtgaactcatcgatcacgtagccactttgctcggcgcggcattgtttgtagtgacattgctgggtattctggcggcaccgctgattatttatatcagtgccccgggatttgcagcagcgccggataaatttgcactgacagtcgaactgcttcgggttacctttccttatattttgtttatttcgctggtggcattggcaggcggtatcctgaatacctacagccatttttctgtgcccgctttgacgccggttttgctgaatctttcctttatcggttgtgcattgtggcttgcgccgctgatggatcctcctgtgctggcactggcctgggcggtattcatcggtggcattttgcagctggcttttcagataccctttctgctgcgcttgaaaagaatgccacgattgcgtttcaggtttcgtaacagcggggcatggcgtgtgcttaaacttatggggccggcagtatttggcgtttccattgggcaaatcagcctgttaatcaataccatttttgcatcattgctgataaccgggagtgtttcatggctgtactatgctgatcggctgatggagtttccggcaggcatgctgggtgtggcattgggtaccgttattttgccttcattatcacgtcactatacggagaatagctcggaggaattttcccgtctgctggactgggggctgcgtctaacttttttattaacgctgccagccgctgtagcactggcgttgcttgccataccccttataacgacattgttttactatggtgccttctccatggaggatgtctggatgacccgggaagcgctgatcgcctacagcattggtttgctcggattgatattggtaaaagtgttggcgccaggtttttatgcccggcagaatatcagaactccagtcaagatcgcgattttgacgcttgttgctacacagctcatgaatcttgcgttcattattccactaaaacatgccgggctcgcgctggcgattggcttgggtgcatgtcttaatgcgggcgtactttattccaaattgcgttcctacggcatttatcagcctttacctggatggggattatttatactcaaaattctgattgccttgatcgtgatgagtgtggggttatggctgacagcggggagtaataccgagtggtttgtgcttacagcaactgagcgagtggtgaaactggggctaatggtagtgcagggtggcatcagctattttgcgtgtctatggatattaggatttcgattacatgatttctcgcggcaataacccaatgtatcgctgacataccctgttttatttgtaggggtggtgtttcaatgggcatcccctctatgggatgcataagaagcagatgcttttaacccattcaactcaagcaataacagttttattctactgcttgagctgagagatatttttgttatatactgccgttcgcagcaaggtttatgaaattttttaaaggaactttaataatgaaatttgcttacgcagctgttatcgctaccgcagttctgctggtagcatgcggacgtcctcatcaagctgttcaagagtcggaaagagagaactatgaaaaaatcatatccggccaaaaaatagaatgcgaacatggggttgacgcaaatggcaagtgcttgaaagaaggtgatactggtatcccagaagcgcactaagctaaaaaatgtatctgtacaaaaaaaccgccttttaggcggtttttttgtacagatacaaacttcaccatggaaaaattgcagtgaaaaaacccctataagtatcatggtattttcagatattcgttatgtaagcattttattctccacgagacgggggattaaattcgtagagaataaagagatgtactgcaccagtcgtagtcaagccaaccaagtatggggtaagtaaatatatacctatttgttatgcttgctgcccattcgtataggatgagcagcgcgatcagctgggtaatactgttgctctatttactttacttaagttgttcatataacaaattaagaatacgtttagctgtttctgattcttcagcgactccatccgtgttaagtacactaacttcgctatttaaactgacttcacttatcttgatctgatatttctctgctgtagaatctttatcagtgtcattggaccagaaagccagtttggaaagtaagcctttccccttatccgctttgtggatttcctcaccggggctgatatagcggacaaagtaaatcccgctcgaacgatcccgatcttccaccgtaaagccgatccgatcaagctcaaggccaactcgccgccacgcgcggtcaaacggttctcttataatcaatatacctttccgggttttatccagaaatgcccgttcttcagctgcaccacttgcagcaatttcagccgttgcacgttcttcatccacaccgaaacgttgcatcaggcggttcagcatctctgcttccagttcgggatctgatttgcgtggctgccagatagtgcgattggtattgcgatctgccagcacttcaatcatgccccggtgactgataaaaatttcggttgcgccggattgatcctgctccaggcgggtacgaaacttgtcacgttcagcggtggaataaaggctgtcaaggaaagttgatagtgcacttcggataatatcctggggtattttggcacggttttctgcccagtcagtttccatgattcccagatcgggtgcttccaccttgagcagaaatcccatatcttgccagaattctttgataaccggccatactgcggcgggttcgcgtggcacaaccagccagcgctgagtaccggagcgttcgatatgaattccgttctgcagcgcagtggcagagagtacgggtaaatttgcccgctcccttaatagtccgctccgggtgctgttgtaagtcgagaatgtagcgctgccggacgcatcaacatccggaatggcaaatcgttcgttggtttcgggactggtcagatcaggcgggacttcaagtggaggaagtttccctgccgacttgtaatcaatctttttattttcgggtagcaggttgcagcctgaaacgaggatcgccagcgtaatatttacaatcagaaattttctcagacgtctgttcggacgcttcttaagcatggtaaacctttaaaccgtgataccagcctgcagcatcgcttttctgatcagttcgtgatgctggctggataaagccgtcaatggcaggcgtatgttttcgttgatcaatcccatttttgccaccgcccatttgaccgggatgggattggcctcgacaaacaaatcgatatgcagcttgaataatcgggcattgattgcccgtgcctgggccagatcgccggacagagcagcagtacacatttcgtgcatcaatcgcggggcgacgttggcggtaaccgaaataatgccgtgtccaccgagcaacagcagcgccagtgctgtggcatcatcgccactgtaaacagcaaaattatctggtacacgctgcaccaaatcacatccgcgtgcaatattgccagtggcatccttgatgccaacgataccaggaatctgcgccagccgtaatgtggtttcattactgatatctgctacagtccgccccggtacgttatataaaatcatcggaatatctactgcttcggcgattgccttgaaatgctggtacaacccttcctgagtcggcttgttatagtaaggtgcgacggacaggcaggcatctgcgccggcattcttcgaaaacacggtgagctcgattgcttctcgggtcgaattggcaccagtgccggcgatgatcggaatacgtccgtctgcataggaaacagctgttcgaatcagcagatcgtgctcatcaaaatctacggtgggagactcccctgtggtaccgactacgacgatgccatccgttccctgttcgatatgaaagtcgatcaaggcacagaatctatccagatccaatgccccgtcttccaacatgggagtgacgatcgctacatgactacctctgaacatggcactttgtctatataaataataataatcattattctacccgaaacaatctgctttcattcaatttcagcgattggccataagccaggcttaatgctgtttcgagaactgcatactaccgtcaccatatttaaccaggatagtatctccagcagagaaatgaccctccagcaattctctggacagcggattttcgatctgagactgaatggcacgtttcagaggccgtgcaccaaatatcggatcaaaaccagcctcagccagttttgccagagctgattctgaaactaccagtttcatctccatttgcgccaatcgggctcccagattactcaactgaattttggcaatcgacttgatgtgcgcttcatccagcgaatggaaaacaaccacctcatcaatacggttaataaactctggtcggaaataggttttaacctctcccattactgcttgcttgatggcttggtaatcatcgccgctcatctgctggatcatctgtgaacctaagttggaagtcatgacgatgaccgtgtttttgaagtctacagtgcgtccctggccatccgtcatccgaccgtcgtccagcacctgcagtaacacattaaacacgtccggatgtgctttttctacttcatcgagcagaatgacggaataaggcttacgtcgtatctgttcagtcagataaccgccttcttcatagccaacatagcctggcggcgcgccaatcaggcgcgcgactgaatgcttctccatgaattcagacatatccacccggatgagatgttcctcggaatcaaacaggaatcctgccagtgccttgcacaactcggttttacctaccccagtcggtcccaggaacaagaaagatccatagggtcggttggggtcggataacccggaacgagagcgccggattgcgtcagaaaccagccggacagcctcatcctgaccaatgacccgttcatgcaatttatcttccatgaacaacagtttttcgcgctcgccctgcatcattttggaaaccgggataccggttgcacgcgaaacaacctcagcaatttcctcagcgcccacctgggttcggaataattttggctgtgtagcctcctcggctgattcatcgtggtgcaattgctctgcaagctgtgtttccaattgcggaatacggccgtatagtaactctgatgctttttgcaagtcccccttacgccgtgcggcttcttcttcccgacgcagtttctcaagctcttccttaatttcctgtgaacctttcgcgcgggacttttccgctttcagtatttcgtccagatcagcgtattcacgttccagtttttcaatttcctcttcaagcagtgccagacgttttttcgaggcctcatccttttccttttttacggcttcacgctcgatcttcagctgaataaggcgccgatcaagtttatccatgacttccggcttggaatcctgctccatgcgaatgcgtgctgccgcctcgtcgatcagatcgattgccttgtctggcagaaaacggtcggtaatgtaacgatgggagagttcggcagccgcaacaatagctggatcagtaatttccacaccatgatgcaattcgtatttttcctgcagcccgcgcaggatggcgatcgtcgcttcgacgccgggttcgtccaccagtactttctggaaacggcgttccaatgcggcatccttttcaacgtatttacggtattcatccagcgtggttgcacccacgcaatgcagctcaccgcgtgccagtgctggtttgagcatgttgccggcatctatcgcgccttctgccttaccagcaccgaccatcgtatgcagttcatcaatgaacacgatagtacggccttcatcttgcgccagctctttcagtacagtcttcaatcgctcttcaaactcgccacgatatttggcgccggccagcagtgctgccatgtccagcgataacactcgcttgtttttcagtgtttcgggcacttcaccattgacgatacgttgcgccaacccttccacaatggctgttttaccgacgcccggctcaccaatcaggacagggttgttcttggtacgccgttgcaatacctgaattgtccgccggatttcgtcatcccgtccgatcacgggatcgagcttgcccgagcgggcacgttcagtcagatccagcgtgtatttcttcagggcttcccggctaccttctgcttcagcatcggttacctgttctccgccgcgtacagaatcgatcgtctgttccagtgcagcgcgtgtaacaccgtattgtttcagcaatcgtccggtctcgcctttgtcttccagtacagccagcagaaacatttctgaagcaatgtactgatctcctcttttctgcgcctccttgtcggtcaggttgagcagattgcccagatcacgagaaatattgatctccccgcctgttccttccacttttggcaaaagtttcaggctttgtgtcaatgcctggcgcaatggttgaacattcactccggcacgttgcagcaacgaggcaatactgccgtcttcttgctgcatcagtgcgagcagaagatgctgcggttcaatatagggatgatcctgccccagcgccatgctttgcgcatcggcgagagcctgctgaaacttggtggtgaatttgtcgaaccgcatgtcatctcctgaagtgaagtaaagattggaatgcccttactatatggcgtggtggcgaaatttcaacccagtggagcgatttgattttttaactgaagatgaactggtgaagtattggttgctggctggctagtgattacggggggaggcggaagtgatcgtcccttcaattcgaattgaaatggtggctatttgataattagccaagagaggtaattccttaattttaagagtgtttcttgatgagctctctgccgatccagatgagagaaatcgctccactactgctggaagcagtggagctggtgatgggcaggtttaatcaattttatttttgatttcagaagccttatctttggctgcatcataggtttcatttgctcgattctcggctgtttgtttcaagcattcagcttcgctgtccgtgcatgctgcttctttggcgcggttaattgccttattggtggatcgtttcacattgtctgtcaaggtgctaatgagagcgttgatttcttatctccgggtaaggatatagcatgttcagcgcaatgctcttcccggccgtttccacgatgcggatatgttcccgacgtagttcacgggcatgccgcaatccgcaagaatgggcaatcatgctgatttcgtgattaacgttgatagcgtaattggccactcgcagatatttctcttccacgaccaggccacgttgcaggcgcgggttattggtagtgataccggtcgggcaggtgttcaggtgacagcgcatggcctgaatgcagcccagggaaaacatgaatccccgagcggtattgacgaaatctgcacccgcacataatgcccatgcacatttggcagaagtaaccagtttccctgcggcaacgacgcggatacgctgtctcaggccggattcgatcagagcatcgaccacccgcggcagtgcctcggtaatcggcagcccggcataatcgatcagcgcctgtggagctgcgccgctgccaccttcaccgccatcaattgtcaggaaatcgggggcatattccagccctctacgcaggatgacatcgcacaactcattgatgaaatgccaaccaccaatagcagttttgatgccaactggtcgtccggtcagttcccggataaaggcaatttgatccagcagttcttcaatattaccaacatcgtgatgccggttgggactgatagaatcctgccaggggggaatgccccggatagcggcaatttccgggctgactttgcatgccggcagcatgccgcctttacctggttttgccccttgcgaaagtttgatttcaaatgccttgacggattgggcaatttcccttgcacgggtggcagaaaactttccttgctcatcccggataccgtatttggctgtgccgatttgcatgatgatgtcgcatttcccttccaggtgaaaaggagctaatcccccttcgcctgtgcttagccagcatccggccttagccgcaccaagcgaaagcgcgcgcacagctggtgcggaaatggcaccatagctcataccgctgatgttgatgatggattgcgccagaaaaggctggtcgcagtaaccttcaccaatggacagggcggggatgggcagctgatcttcttccagtatgggaaaagcggcattgacaaaaatgagcgccccgggttcacacagatcgtacgaggagccaaagccaacagtactttccatatttttggcatttttatagatccagctccgagtagcgcgattgaatggcatttcatcacgatctccggtaaagaaatattggcgaaaatactttccctgagtttcaaaaaaatagcgcaatcgcccgataatgggataattgcgcaatatggtgtgctttttctgggtggcatcgcggatgaaaaagatgactatggcacccacgataatcagccctaaaatagtggcagtactgaaaataattagattgatcaggctgtctgacatggtgtctggaatgatgttctaaatagatgagtgtgaagcatgttgcaaagtgaagcaatcagcaagcaggttcgacaagcgctggatgaagatattggcagtggtgatctgacagctactctgatccaatctgatcgatgtctgcgtgcacaggtgatcgcccgggaagccattatcatttgtggcattccgtggtttgatgaaagtttccatcaactatctccggccgccaggattgactggcgtgtcagcgaagggcagcaggttggcagtgatcaagtgttgtgcgtactcaatggcaatgcgcgggctttgttgacagcagagcgcactgccttgaattttttgcagatgctctctgcggtggcgacgcgtactcggcagtttatcgatgcaactgaaggtacgggtgtacaggttgtcgatactcgcaaaaccttgccaggattacgcttggcgcagaaatatgccgtgcgctgcggaggaggagtcaatcatcgtgccgggttgtatgacgggattctgatcaaggaaaatcacattattgcggccggcagtattgaagctgctttgcgcagagctgctgaaattgcgcctccaggggtattcatccagattgaagtggaaacacggaatgaattcatacaagccctgtctgccggagcacgcatggttctgctggataactttgatctgcctgatctgcgggatgccgttacctataatcgacaattcctgggcaagcctgctgtacttgaagcctccggcaacgttacgcttgatactgtacgagcgattgctgaaacgggtgtggaccggatctcaatcggtagcctgaccaaggatatacaggcggcagatttgtcgatgcgtttttacgatgaagcttccagtgcagcgatgacttcatcgtcattgatctgcggaaacaagtgataaaactggccgactgaataaaatattgcaggtgtttccaggcagataacctcatctgcgaacggagtaatatcagccagtgttttggctggcgcgaccggcacagcgcagatcagtttacgcggttgctggaggcggacagcgtgcaatgctgcaatcatggtggatccggtcgccaagccatcatccactacaattacgattcggtcatgcggatcaacagccggacgaacaggcgtataacgcatccgccgttcatgtaacaattcgagctgagtagctttttcggttgcaatgtattcgcgagtggcgccactctgggcagcatggccggccagataaacttgtccattttcgtcgacggcgccaattgcaaactctggattctccggcgcgcgcagcttgcggaccagcacaacatccagttcaccttccagtttgtttgcaatgatgcgagacataggcaccgcaccccgtggaattgccagtatcagcggattttgtccctgataagccttgagctgctctgccaaccggatggcggctgctgtacgatcctcaaacatttttctgtgcccccacagtacgctgatacttgtatcctacatcgacagatgttgattggcgatagttgctgtgctatgtgagtgctgccagcctgtttttaatgcagcgagacaacataggtggctttcagtgctctgctaagcgaacgtgtcaatggttcctgagtgcctggtgatcaatgaagccggtgtatgtgttccgatggagttgttcgggaagcggttattcccggaggaacgagaggagttgccccgttcactttctgcctgttgctgcggggtatctgcgctgactgaggtatctgccagcgtaataccgttttctgccatgatttcgcgcaatctgggtaaattggcttcgatggcttcacgtacggcagtatgatgcgaaacaaactgcgccgtaagctggtgatcgtcggataactgcagtgagatttctatcgggccgagatgggccggatgtagcttcagttctgcggcctgcatccgctgagtcgccagccaggtaattttttgaccgaattcttcaggccagtccggatgtccaaattctgcagcaatagccggggcactattcattgtggtatcagcaatatcagtcaatggagtgatgttggtgtgcattgctatagacgtcattgaagctgacaaggttttgccacttgccgcatcaattgcctgattaaaatcatgtatgggaatagagatcgtattgctgatgctcctgtttccgtccgacagttcgatggaaggggttgtggtattaacctggttgatcgtctgtagcgagctggctgggtgttgaccattggaaatcctgttttctggttcggcggataacggattgcctctcgtcaatatatcaggctcacttgtaaccagttgcccagtatttgaaatcatatacgtcattgaagtcggcaggattctgccactatcggcaaaatttgccgcatcaattacttgatcaaagccatttgcagaagtagatgccatattgctgatacccttggttatatctgtcagctcaatagaatcggttgtctgcggtaagccggttgagtgctgcccggcattcaaggttatgcttgtcggcagtatggataatagttttgccgtttgaatatccggtgtgggctgagattgattaatccattggctaaccgggatagacatcatgcctggcataggtgcatcagctggtaatgcaagctccagattttcagtatcgtcttcttcagcggtcggctcattctccatcatgctggtcaggatgttgccaaatgcctgttcaaccggctggcctggagcagaagggatggaagcacccggcaaaatggtcgtcatgagatcacttgttgtgacgcgcagacccatgtcaggaatagcaggcgaattcggcatagttgtcctcggagaaatttgtgcttgtgtaataaatatcaagcaattttgatgccactattccacgttctttggctgtttgctgaatatgcgtgaggtgtgttcatccagctgatgttgctcctgctgctgcaggcgcagttgataatgaagctcggcacgttgcgataaggtgtcatatgatttcagtttttttcgctgatggtggtattgcatgctgcctgcttccgtatgctgttgtgtcaccgcaacaaggttttgctgtgcctgaatggcggtatcaagcttgcagataaatgccttaaaattacgccactcggcgggtgtcacgccattaccggcagattccatgaattgcacctggtagttttcacggtattcgatcagcagccgcagggttttttcggactcctgttgcttgaaatttaactttcccagattaatggcggcatcatccgtctgcttacgggcatgttccagtaacagtttgagtgaatgagaagtggccatgattcatcttatccggttacagattcagggtagttagtttgtctatgcttgttgcatagttctcctgctcgaacatgccttgctgcaggaaagattcgagtgccggataaagctcgatagcctgatccagttgaggatcagtgccactgatatatgcaccaacactgatcagatcatggctgcgctggtagcgagagtacagcgccttgaaacgctgcgcctgaccaagctgctcgcgtgttaccaagctggccatcacccggctgatcgaggactctatatctatcgccgggtaatgaccggcgtcagccaagtgtcgtgaaagaacaatgtgaccatcgagaatggcgcgtgcattatcagcgatgggatcgtttggatcatcattttcggccagcacggtataaaaggcggtaattgatccactgccccgtcggccattgccagcgcgttctaccagttggggcaagcgagcaaataccgagggaggataacctttagtggcaggcggctcgccaatggcaagtgaaatctcgcgttgtgccatggcaaagcgggtgagtgaatccatgatcagcagcacatgcttgccttcatcgcggaaatattcagctatcgctgtcgcgtaggcagcgccatgcagccgcattagtggtgaggtatcagctggagcagccacgaccaccgagcgtgccagaccttcctcgcccagaatggtttcgatgaattcctgcacttcccggcctcgttccccgatcagtgctaccacgataacatccgcgctggtataacgcgccatcatgccgagcaagacacttttacccacaccactaccggcaaacaatcccatgcgctggccacgacccacgcttaatagggtgttaatcgcacgcacgccaacatccagtattttttcgatgggtgcccgttccagtggattgaatggacggctgtaaagtggaacgttgtgcccgcactggagtggaccgagccgatcaagtggttcaccggctccgttcaggacacgtcccagcagttccgggccgacactgatgtgctttgcccggtcagctgcacgtcgtcgcggatgctgtgtcgccccgatgcggggaggtgtaccggtatattcaactggaactacttttgcgccgggagtcagcccgtagatatcgccggatggcatcaggaaaagccgttctccggaaaagccgactacctccgctgtaacactggtgccatttggcagaaaaacaatacaactggtccccactgccagtttgaggccgactgcctccatcactaacccggccacacgggtcagtgtaccgctgatgagcagagggttgacaggctcaatcagttgttggcaattctgaatgaagccgcgccagagcgaggtatgtgtcggcccgatggtgtccatgatggtgcccgccagatagcgttatgtcagccagtctggatcctggctgagagcggccagggtgcgttgccagcgagtagacagtgtggcgtccacttcacaaccacctgattcaacccggcaaccaccaggttcaatttgtgcatcttcctggatatgccatttggggtgtgccggatgatcttccagatgcgtgcggatgcgggcagcatcatcaggatgcaaggttagctggattggctgtgaaacagaagttagctgacgaattgcatcttcaacaatcggaaggatcagttccggtttgatctgcaaagcctggccggtgatttttctggccagatcaacggctaatgccagcaaatcctgcgccatggtctggtcaatgtctttcacctcccgtgcaaacgtatttgccagtgcttgaaagcgttgtgcttctgctgtgactgtttgctttgcctgttccatgccttcctgataacccgctgtttttccttcctcgtgagcttgctgataaatctgttcgatctgctcggtagttggtaaaacaatagtgtcctgtctggttacttcctgatcagatatcatctgcttttcaggctggttaactggttttgtggcctgaggtgttttttgtgaagattccgttttctgtctggatttaagtggatcaagcgagccgaattcccacttttgccaggaggaaagatctttcttggggatgacgtaggctgcttccatatctttgcatttcctttttcatatatgcggtatctgaaaaatctgctgcctaccctgtgtggccagatagatagcagcgccttttagtcgtgatgccagatgatttcagccttttcaaggcttgacaggataaaagggagaggattcgtaacgacgcacaattttctgttattcacaataaatacaggcatctaaaggaaaccatcttctcctcttccacccagcgcgacacgaccatcatcggcaagctggcgtaaaatcttgagaattttcttctgttcagcttccacttcggagacacgaaccggccctttgctttcaaggtcttcacgcagcacttcagcggcacgttgcgacatattcctgaaaatcttgctgcgcagttcctcttttgcgcctttgagtgccgtgatgagcgagtccgactgaatttcccgcagcagcagctgtataccctggtcgtcaacctttaacagatcatcgaagacaaacatctcatccatgatgcgttgcgcgatttcttcgtcatactgggtgaaattttcaataacactgttttccagggcagtgggcataaaattcaggatctctgccgtggtacggacaccgcccatacgcggctttttgatgctatcagtccctgacagcagtttacttagcacgccatttaattcacgcaatgcaatcggctgcacactgtctagcgtggcaatgcgcagcaggacatcgttacgcagccgatcggcaaactgtgcgagaattgtgctggattgatcgcgttccaagtggactagaatcgtggcgataatttgtggatgttcattcttgatcagctctgcagcggcaatagcatccatccacttcagactttctatgccgctggtgtcatctccctggttgatacgatccagcagattggctgctttctcctctcccagagccctgatcagcacgttacgcagatagtcgagtccgtcctgtcccagcgaggttctgtcatcagcttgctggcagaactcttccagtaccagttctattttttcccgcttgatgtcgttgagagcggccatagcctcactcagtttctgtacttccttggggccaagatagcgaaaaacccgggaagcttcttcttctcccagcgacatcaacaggattgcactttttaatattccttcatcgttcattgccggatacccatcccttgacgacgttggccacaatggccggttcattggcagccagtaatctggccttttccagattttgttccagagtcattaccttgatcgtattgatcgcagcttcatcctgttctgaatccttggcagttaatgccggaacaggagcaggcggtggaggaggcaacagatttttcagaaatggccggaagattttttgcaggaagaacagcacaatggcggcaattagcaactgtttgccaatatctttggcgagcagaacagtatccggatctttccagagcggcagttcttccaaaatttcctctttcaacctgaattgactgttggtgacggtcaatgtgtcgccgcgagcctcgctgaaaccgatggcctgcttgaccaacgccgtaatcttttcaatttcttcgccagaaagcggttcgttgatcgggttgccttcttcattcatccttgtgcggtaattgactaccacggctgctgaaagccggttgatctgcccggttgactggcggatatgtgaaatggttttatccacttcgtagttagtggtggattccttccgggtatcggtaggcgttgtctgagcagtttcctcctgaccttctttggtttctaccggtgcctgggccggggtaggggggcgatttgacagcgcaccaggcacgccgccatcgggttgtgaaatagaaaccgattcggatttctgctggctacgaacggctgcagattcttctggattgttgttgggtcggtaagtttcttcggaacgttcaatgcgggaaaaatcgatatccgcagtcacctgtgcatgtacattatcctggccggtgacaggcgtcagaatagcttcaatgcgccggacgaaattctgttccatatcctgtacatatttaagctggccggggtcaagcccggtttccatctgattttctttctggccgcttaacaaattgccctgctgatcaacaactgtgacatttttgaccgtcagatcgggaatgctgctggaaaccagatggacgatggcactgacctgttcggggctcagcatgcgtccatggtgcaggttcagcagtacagaaacacttggttgttggcgttcccgggtaaacacgcttggcctggcaatggccaggtgcactcgtgctccctgcacggctgacaaggactggatcgagcgggctagttcgccttccagtgcgcgctggtaattgacttgttccagaaactgactggagccaaatttctggttttccaatatctcgaaaccagatagattgcccttgggtaatccctgtcctgccagatgcagacggacttcatgcacctgattgaccggaaccagaatcgagccaccactctcgctgaattggtatggaacgttcatcttttgcagggcatcgatgattgcaccgccttcctgttccgataagtttgcataaagcacgcggtaatccggtgtctgactccacagccatgttcctgcgaatagtgcgatcacggcagctgctgccaccatcaatcccagcttcttttgggccggcagttgtttgattttatccagctgactaaatgcctttttctctctctggatttcttcttgaatagttgccatgaaatcacctcctgcccggttgatcgggattgacacagcttaacgaatatttgagctgattctggtttggcatatgaatatcgaacgtggttaaacgaataccggaattatcaggatattcaccaagcctgaattccggaacagagaacatttgtttgtgctattccaaccgtaatccgggtagggggtggtgctaagctgagcaacgtcgaaattgggtttgtttttccatgaaaacagaagttactgctacatcactagccaaccatgaacagctcaggcaggcgtttactgtattcagccaggcctccagccagctttccggaatctatcgcgaattacagcagcaggtttcccggttgactgaagagctggcgctggccaatggagaattgcaacgtgagctggctgccaaggaagcactttcgcaacagctgggtcagttgttgacagcactgcctggtggtgttgttgtgctggatcatcaggaccgtatcagccgggtaaatccggcggcgattcgttttctgggagaaccattactggggataacgtggcatcggatcgagcaggaacgtctgcagccaactggtctggccggggaatggttggcagtaaaaactgctactgccgcacctgatttatgcaggatctttatcgaaaacagcctctcggaaaccaccagagaaagtattttgctgctgcatgacatcacagaagcccatgcgctacgcgaacaaaatcgccgtaaccagcggctggcagcaatgggcgaggtggctgccggcctggcgcatcagttgcgcacgcctttatcaaccgcattgctatatgccggacacttgagtgttgaaacacttgatgctcaggaacgaagcagctttgccgctaaaacgatagagcggctccattatcttgaacatctgatccgtaacatgctccagtttgtaaaaggagagtctgtgcctgcggggaaagtgaaattatctgtgctgttacgtaaattacagcaggtgatggcacctcagatgcagcaacgtcagcttcgcttcgtggtggaggataacagcatggggtccagcctgaatgtgaatcgggatgcgctgagtaatgccgtaatgaatctgcttgataacgccgtgcagattgcgcctgcgggcagcctgatcacgctggtttgtgaaacaacaatgaatgaagcgaggctgatcatcagtgacgaaggcccgggaattgatccggtgttacacgaacgggtgtttgagccgttttttactacccggacagaaggaaccggcctggggttggctatcgtgcataacctgattcagtcgatgcagggtgaaatccggattgattcaacgcctggtattggaacccagtttacgatctgcctaccaagagcggcaaaggcacgagccaataaatttgtcccggcaggtgaaatggcaacaactaaaaatgaggacagataaaagatgcaaaatttgcctgtactgattgtagaagatgatccggatttgctggaagcgttgtgtgcaaccctcaaattgaagggttacgccagtcttgccgccagcggaggtgagcgggctcttgatctgttacgcagccatccagtagggttggttatcagtgatgtacaaatgcgtccgatggatggccatacgctgttgcagaatatcaggcgaagtcatccgtggattccggttgtgctgatgaccgctcatggtgaggtagacaaggccgtggctgcaatgcgtgctggagcgagggattatctgcctaagccgtttgatccgcacaacttgttggcgtatgtcgaacgttacttgctgacgatcagcaatgaggatgaaccggaagttgtggcggaagatccccgtaccttgacattgttgtcattggcaaagaaagtagctgcgactgatgcgaccgtaatgctgatgggggaaagtggcagtggcaaggaggtgttggcccggtttgtgcatcgtcattcgtcgcgtgtatctcaaccttttgtcgcaatcaattgtgctgccattcccgaaaatctgctggaagcaaccctgttcggttatgaaaaaggagcgtttactggtgcatttcaggggcaggcaggaaagtttgagcaggccaatggtggcactttgctgctggatgaaatttcggaaatgccacttagccttcaggtaaaactattgcgtgtattgcaagagcgtgaagtggagcgggtgggcagcaataaagctgtcaagctcgatattcgtctgattgccacttccaaccgggatatgcaggcgtatgtgcgggcaagccaatttcgtgaggatttgtactaccggctgaatgtttttccactagagattcctccgttgcgtgaacgcgtgcaggatattgtgccattggcgcagtatattctggataaatccacccaacctggctgtacgttgacaaaatcagccatgctgtctctggaacggtacacctggccgggaaatgttcgtgagctggagaatgtgatgcaacgtgccatgattctagcgacagggccaattgagcctgcgcatctgaacttaccggagtcgccgatgaacaagtcttcccaggagaatgtgcaaggagtagctgaatcctctctgtgtgacatcaaatcacttgagcgagatcatattctgcaaacactggcggctgtgaacggttcacgcaaactggctgtacaaaaactcggtatttccgagcggacattgcgttacaagctgcagcaataccggcttgccgaatgctgatcaattttacaaaagcggagaacaaatatgaatattgcatcagggatggatcagatgctggcgcagctcaaggcaacctcggatctggcagcgggcggcaataagcccgccacggttgcgcctgcagcttcccaggcagattttggccaattacttaagtcggcggttgatcaggttaatacagtgcagcagactgccaatcaactcagtcaggaatttgtgcgcggcaatcaggatgtcgagctgcacgatgtcatgatttccctgcagaaagccaatgtttcctttcaatccatgattcaggtacgcaaccggctggtaacggcttatcaggaaataatgaatatgcaagtgtaagatcctgggctgataaagaacaaagggacagactatggccatactccaaacattttccgagcaggcgatctcgccagcaagagcaagcgatataaaagagccagattacagcgtgaattcccggccggaaatatgtttttttctgaatgggatcatggaggaaaaatctctgatttcactgtaccttgcgcgggacagtcactccgctattctctcatccattctggcgattgatccgcagcagaagctgttgataatggattacggtattaatgaaacactcaatcagatagcgctcaaaaggggatatctgcggtgtattaccagccataaccagatccggatcgaatttgattgcgataatctgcaacgtgtccagtttgaaggtcgtcatgcattcagtgctgatattccggaatcactgaaacgtttgcagcggcgcaatttttaccgggtcactacgcccatcaccaatcctgcagtttgtactattcctttattgcgggcagcagacgaagcgccagttgtctacagcctgctggatatcagctgtggtggcatggcgttgatagatcagccagataccgatacgcttctgaaagctggcgcaacgcttgaacactgccggattgatttaccaggagacggtaacttgttcagttcaattgaagcctccatccagatcgcgtacgtcggtacggttattctgaataacggaaatacttgcccgcgcattggttgtgaatttatcaatctacccgagaaatcaaggctattgatacagcgttacattacaaaactggagcagcaggcaagaaaacttgaaactgaatccggtatttgaaaccagtgccgccggtgtcatcaggtgggtgttgtcaccatgccgttttccagccgatagagccatgccagaagctcggctatggctacgtataactccggggggatgtgttcgtccaggtcaacctgcatcagcaatgctaccagttctgccgattcatgcacgtatactccggcttcctgcgctcggcggataatttcctctgcaattagtccttgtcccttggcaactacctggggggctgtcatgccactgtggtaagtgagtgctaccgctccgggggtgatcgcccgtcccgttgtggtgagtgagtcgatcggctcgctttgattttcttgctgattcaattcaggattcttcatgccgctggatctccattgcgcgaattgttagcccggttacttgcatggcgttggccagtgccatctgttcttttttgagttgctgcgtaatattgtcggaatcagcatctagccggatgcgcatgccttgtggatcaatcataagcgtggcggtaatttttcccagattcggtaagtgcaagtggatacgagtctgccaacggccggatttcccggttatttcgccgtcagcctgctctttttcctgatgattaccggggtactcggtgatgtcccattccatggcctgccccggccagacttctcctcgccattggatggttccagtttccagcgtgtgcaactgttgctgcaccagtgaagctgcctctggcgtaaccagcgctgttgacgttgaagcggtggctattgtggggccaagcaattttccttgtggttcctgctgaagttgctgcaatgatcgcttgccatttagccatctagctaaatgtgcttcataaaataatccactgattgccagtgcctgctgcaattggcctggcagttgtgctttatctgcgctgataacggggggagtcggtagtagaggagcggggttgcctgctgctttagaggtaggcaggctgggttgactcagcaactgtgcgatgagttttccggccgggctaagcgttgccgggttactgttactacctgctggtgtatcagtgtgtaacagaaattttaagcgtggagattgctcgatcagtgtcagttccagaagatctccggtatcgactgcagcgggcatacgcatttgtagccatctgcccgcaacattgaccatggaatgaccatttgccagccgttcccccatttgcgccatatacttctgacccagcgtaaaggctggcgtatcggattgcgttgcatccggcaccggattaacggcactaatcggccggatctgtgaaaccgtatcggtaggtgtggcagaaagaataacagcaggattgaccgggtgagaaatcataatgctgctccgtcgtgactggtttttaaatcggattcaaagagttcgtgctccaatcatatcctgtcagagcaaaaaattgctcaactggttattggcactgccggtggccatgaagattattatcactttgcgggctgcttttattttcacctgccgcatttttgcgaatggtacactttaaccgcgagtgcagcgtggcgggtaaggcaacgcatggctgacggaacaaggtgctctgcaaaaaaattactgaatacggccaatgctcgcgcagatgtgaggcattggctagagcatttttgatttaaatatatgcatgtaatagactattctctatcacaactgatggggaaggttatgcatgcctattcacaagatcttcgagatcgcattctgggtgcgttggatcgtggcgaaggtccaacggcaattgcccggcgctttgaggtgagtcgcatgtgggtgtatcaggtacgcaagcgatggaaagaagaaggccagcgccatagcttgccgatgggaggttatcggcgatcccgcattgcgcacaaggaagcgcagattcggcaatggatagaagccacgccggatctaacgcttgtcgagcttagtgaacgtttggctgcggaaggcattcagatcaaggtgccggcgctatggcatcaactgaacaaatgggggttgagttttaaaaaaaaccctgcacgccagcgagcaatcgcgcacagacgtacgtcaggcacgaactgagtgggcccgcgagcagcagcattatggtggccgacaacctgtcttgtcacaagatttaaggcgttcgcgcagccattgaagcggcaggtgccacgctgctctacttaccgccgtattcatcacctgatctgaatccaatcgagaaaatgttctccaaactcaaagccctattatgcaaagccgccaaacgaaccatggatgccttatgggcgcagatcggcaaagtgttggatctgttcactcccgaggagtgtgccaactacttcgcttcatgtggatatgtaaataagtaaactaaaaatgctctagggtatgaaatagctgagcagtattacgtctactattttggcctgttctcgattctggtgtaccagccctgatagacttcatccggccacagggattttatccagatcaggatgtcatcaatttcctgatctgtaaggatcccttcccaaccaggcatacgaccttctcccggagggccgccgtttagtataaagcgtttcagttcttcggtggaatggtgccaggcgtgtgcagtgccattcagtggtggtggtgggtatctgccattttccagtggtttgcgccaatccggagtgccttccgcattctgaccgtgacacaccgcacagtttttctggaaaagtgtttggccatgcgcaacttgatcggggtcaaaatcgcgtgtgatctgttccggagatatatccctgcccaaaatacgatctaaggcgctgcctgccgagcgagtgtcagtttgctctgagcaggcagcaataagtaacaatgacatgagcgctacggctcttgcaggtatcacgttatttaagtcttagaattgatttggttgtactattttcaggtattttatctgtctgtgatttgcccggaccatatcggttgtagatttctgctgcgctgcgtttgtctccaggttttctgattagcagcacgttataggcatcaacacgtccggtttccatacccggggagccatgtggcattccgggggctgacaggccgactgctctcgggcgttctttcagtaattgtttgatgtcatcaaccggaacatgcccttctatggcatagccattaaccagggcggtatgacacgaccccagttcggtggagatgccagcttctgctctggcattatcgttaccgacatcatggatgttaacggtgaatccgttgtcgcgcatgatatccacccatttggtacaacagccacaagttgggcttttatacacttccatggttgcagccactgccgtgctggcaacgcctgatagtgcgatggttagcagggaacgggtaaagaatttattgagttgttttttcatgtgctctccgatatggttttgccttgtattcgcttgaattggttgggactgaacaattaatgataagcgcgtatcctgggcatttagaaaaatggaattgtttcttgcgcggttggacattgatagcgtgtataacgttctccctgatccctggctggcagtcgttacattgttataattttttgcttgagtggtattgttattcaacaaatatgaaaccttgaagatataactataaccgactttctcatatatccatgatagacagcagaaacaactaattattgtattgttcaagtgttaatttatacaaatgttctttccttaactttgtgtgaaatagttacccggctgattttttttgatagctttcttattttatttttctataaattcatatgattacggatacattttccagaaaatccgaatacaacactaataagttgcgtaaaagactgaggcggcttgttggcacggccattgccgattttaatatgattgagagcggtgaccggattatggtgtgtttgtccggtggaaaggatagctatgcgctgctggatattttgcgcaatttacaagcacatgcgccactggatttcgaactgattgcagttaatctggaccagaagcagccgggttttcctgagcatgtattgcctggttatttgtcagaaataaatatgccctttcgtattgttgaacaggatacctatagtgttgtaaaacgagtgattgctgaggggaaaacgacctgtagcctgtgttcccgtttgcgcagaggggtgctttaccgggtggcaaccgagctgggggcaaccaagattgccctgggacaccatcgcgacgatattctggagactttttttctgaatatgttttatgggggcaaactgaaagcaatgcctcccaaactggtaagtgatgacgggtgtcatgtggtaatccgaccgctggcatattgcaaggaaaaagatctggcggcttatgcccagcttgtccagtttcctattattccttgcaatttatgtggttcgcagccgaacctgcagcggcaggtaattaaggaaatgatgcagcaatgggataagaaataccccggtcggcttgaaacgatgtttacagctttacaaaatattcagctttcacacttggcggataccagccgctatgattttgtcggaatcaaaccacatggtattgcgacggaagaaggggacaaggcatttgatgaggagtcacttcctgacagcccggttggtatgaatcatgatgatgccgcatccgagctggatgaagcatgcagtatcgaggctgtccagggtggcgctatatagcatgtcttcttcagtatatctctgctttactcaatcccggcttcgtgcgcttgttgatcagcatgatagctggagcgtaccattggaccgcaagcagcgtggctgaatccaagattggtggcaatgcgttcgaaggttttaaaatcttcgggtgaaacatagcgcatgaccgggtggtgaccaatgctgggttgcaaatattggccaatggtcagcatattgacttgatgtgcgcgtaaatcctgcataaccccgataatttcttcatcggtttcccccagccccagcatcagaccggatttggtcggaatatgagggaaagctgctttgaaatccttgagcaattgcaatgaatgtacgtagtctgcgcccggccggcattgcttatataagcgcggcacagtttccaggttatggttcatcacatcaggcggacaggcagatagtttctccagtgcgatttccagtcggccacgaaaatccgggaccaggatttcaatccgtgtttgtggagattgagcgcgaattgcgcggatgcaatctgcaaagtgttgtgcccctccgtctctaagatcatcgcgatccacgcttgtgatgacgacataattgagtttcagcactgcgatagatttggccagatgcataggttcatccggatcgggggcatggggccgtccatgcgctacatcacagaacggacaacgcctggtacataagtcaccgagtatcatgaaggttgccgtaccgcgcccgaaacattccccaatattcgggcaggaggcttcctcgcagacggtatgtaatttattctcgcgcagcaggcgttttacttcctggtatctctggctgttgggcgaacgcacgcgaatccaggagggtttgcgcaatagctggccggattgttctagatcaattttaattgggttgcgtgccgttttggcagtgcctctttggtgggtatcagcgaccatggggggtgattatcctatgggttagttgagcaataaaattctgtgccagtttgtcagcaagtacttctttgttatccgatatgccgagctcttttgcctgtgtgacacgcaagccgggataaccgcaaggattgattgcaacaaagggagcaagatccatgtcagcattaaaggcgatgccgtggtagcacgcgccgcgtcttattttcagtcccaacgaggcaattttggcgccgttgacgtacactccgggcgcatcttgactgccgtttgcaacgatatcgtattcatccattaagtttatcacggccccttccatttttctgaccagttgtctgatactaagctgccagcgatgtaagtccagcaatagatacatgattatctgcccggggccgtgataggttatttgcccccctcggtcggttttgatgacggggatgttgttagggaaaagcaggtgctcaggtttcccagcaattccctgagtgtaaactggagggtgttccaatagccagatctcatcaggagtttcacgagtacgctgctgcgtaaaatctttcatggcctgccaggctgtgaggtattccgtaatccccatgttttttactgtgacggtaaacatatagcctgttttcggagcgtgattcagttttttagtttgcatgcccgttgttcagggtgggacatgtgtttttctacagaatgggcttattactcgtggtgagtatgatgatatcgaacactgatcagcctacagaagcatcgttaccattgggtggttatgcagtgtctgatagagagaatccagctgtgtgcgtgaagttgcgcggattgtgcaggtaaggctcaggtaagttccacttttactggtacgaacttcgagagttgtatcgtcaaagtcaggggcatatgttttgacaatggccagcatggattgagtgaatccctgctgtgccttccccataatttttattgggaaatcacaaggatattcaataagcgattcttctgtcatgagattgtattactgggacgaggtgtgtccgcgcatgactgtctgtttatatgcttgatagtgccgattgagttgctgaaatatggggccgggcacaccattgccaactaactgcccatcgagtcgggtaatgggaaggatctctttggtggaagaggtgagcataacttcctgagcggtacgtaattcagtctctgagacatctcttattgcgtgaggaatgtcatgagttacggccagttccagtaccacatcgtaggtggtaccaggcaatatacgatgatctttggggggggtcagcagctggttgcctttcacaataaaaatattgctggctgctccctcggtcagcaatccattgcgcagcaggatggtttccatggcatgctcatccaccgaaagctggcgtaataatatattaggcaagagagaaatggtcttgatatcgcagcgaccccagcgattgtcttgtgcagtgacagccgatgctccggatgcgagcaatccttcgggcggcgtcagtagagggctgctcatcataaagacggttggtgttattccgtgagggaatgcgtgatcacgtttcgctacgccacgagtaatatgcaagtaaagatactggtcatcgtattcgttcagctcaattatgcgtgtaaccagatcaatccattgtttttcagtatgtggattctggaggcgtatcccatcaaggctgtactgcaggcgggaaagatgttcgttcagccggaacggtttgcgcgaatagaccggtataagctcatagaccccatctccaaaaatgaaacctctatccagtaccggaatcgtagcttgttctattggtagaaattttccgttgagataaatcatgcttttattgtccgcgagattagttgaacagcattttcagattatcccatgcgcgcccgaagaaattggctgtatcaacagcttccagcgcaaccagggggtaagtggccacttccaatccatccaggacaaattttacctttcctatttcctggccttgatcaatgggtgcaataagtggctggcgatattccattcgagcctttaccccttcgaccttacctttagggagtgaaaaatagatatcctgattaaagccgacttttattttattttgtgtgcctttccagatttgaacatttgcgaccggctggttctttttgtaagggtgtgccgtatcgaaaaactggaacccataatttagcaggcgttggctttcaatgctgcgtgcattaggtgaagcggtacccatcaccacagagataaggcgccgatgatcacgttttgctgaggtaaccaggcagtatccggcagcttccgtccaccctgttttcatgccgtcaacattaggatccgtccatagaaggcggttacggttttgctgggtaatgccgttgtaggtatattcgcgtaaggagtagagtgggtagtattctggaaaatccctaataatggcgcctgccaataatgccagatcattagctgtgctgtagtgatcaggatgagtcagaccagttgagttggtgaaatgcgtgttgtgcatgcccaagcgttttgcttcttcattcatcatgtgcacaagcagatcctctgaaccggcgatcagctctgctagggcaacgcaggcatcgttccctgattgtacaattaccccatgaattaactcatcaacagttactggtttgtttggctcgataaacatacgtgatcctgccatgcgccaggcttttttggatacgggcacgacctggtccagctttatacgttcctgcttcagcgcggagaagacaacgtaggctgtcatcagcttggtgagcgaagcaggatccagtcgttcatgcgggttggagctggcgagtgtctggccgctgtgaaaatcggtcagagtaaaggatttggcagcaattgacagttccggctgttgtgaccatgccggaaaaacgggcatcaataagaacaggaagaggataaactgtttcatgagggtcagcaaaagcttcattatactctgactttgcagcatgtatttcttgaatccagcttgcctggatgcaaatttgacattcttaatgcgctaactcataattcgcggttatcttgtactacaaaaacaaaggaaattcagtgaaaaccttttctgccaagccacatgaagtaaagcacgagtggtttgtggttgacgcaaccgataaagttctgggtagattggcggcagctattgctcatcgcttgcgtggcaaacataagcctatttatacaccgcacgtagatactggtgattatattgtggttatcaacgtggataaattgagagtcactggtaataaggcggaagataaaatatattatcgtcacagtggctatcctggggggctctatgagaccacctttaaaaagatgcatgcgcgttttcctgccaggccacttgaaaaagctgtgaaaggtatgttacccaagggtccacttgggtatgccatgataaagaaattgaaaatttatgccggggatatacatcctcatgcggctcagcaaccgcagtcactggaaattaacgcttaatcttataaattatggctattcaatataactacggaaccggccgtagaaaaagtgcagttgcacgggtttttattaaatcaggtacaggtgttatcacggtaaatcacaaacctgccgatgagtatttttctcgtgaaacagggcgtatgattatccgtcagccattggagctgactgggaacagtactaatctggatattatggtcaacatacacgggggtggagaatccgggcaggctggtgcggtcaggcatggcattacccgtgcgttgatcgattatgatgaaacgctaaagtcggttctaagtaaagcaggttttgtaacaagagatgcacgtgaagtagagcggaagaaggttggttttcgtaaagcaagacgtcgcaaacagttttctaaacggtgattgttgttgttttctggacaatacgaaaaagccgccctctttgttgggcggctttttcgtattgggttcacaacacaagatactgactgctttttgataaaaaattaattttttagctgttgtttcctagagatgattaatgttggtattgtaggtgggacaggttatacgggtgtcgagttattacgtattctcgcacagcacccgaaagccaagcttaaagttattacctctcgtcaagaggctggaataggagttgacgatcttttttccagtttgcgcggacagattacgcttaaattcagtgatccgctcaaggtagactttggaaaatgtgatgtcgtctttttcgcaacgccaaatggtattgccatgcaacaggcaagtgcattacttggatctggaataaaagttattgatctgtctgctgatttcaggattaaagacgttgcggaatgggaggaatggtatggcatgtcgcacacagctcctgaattggtggctgaagcagtctatggtttacccgaagttaaccgtgaaaaaatcaggaatgcaagattgattgctaatcccggttgctatccaacagcggtgcagctgggttttatcccgctgatcgaagcaggggccgttgatgagaatcatctgatagccgataccaaatcaggtgtttccggagcagggcgcaaggccgaaataaacacactatatgcagaagcatcagacaatttcaagtcttatgccgtagcgggtcaccgtcatttacctgaaatcagacaaggcttatccgaaagatcaggtaagccgattgacctgactttcgtgcctcatctaaccccaatgattcggggcattcatgccacgttgtatgcaagactgacccgagatgttgatttacaagctttatatgaaagccgttacgctaatgaaccctttgttgatgttcttccagcgggcagccatccggaaacacgttctgtacgtggttcaaatttctgccggattgcagttcatcgtccccggaatggcgatactgcagtaatactctcggttactgacaacttggttaaaggggctgccgggcaggctgttcaaaatatgaatattatgtatgggctgccagagaagatgggcattcagcatattccgttgctaccctagcagtttgtgattaaagagtgaagtgactgaaagaacgtcatattgcagataatgtatgcatagtaatacccccgggaatttctaaagaataagggaacgaattgctgcataacaaaaaaaatattaatgcacccagggtggttatacgtcctcatgttccctggtatcgacgtttgctgatagcggctattgggatattactggtagccttgcttgcttatggaatgtacatggtcgggcagggagcggctcaaccagccagtaacgttgtagccgatccggttctcgaacagatactggaatcgaacagttgtctagagaaatatgactctgctctttgctcacagcttgcagagcttgtcaggcagctgcagatcagcaatgcgacccgcgctgatctggtaaagcaggttaagtctctggatgaggaaaatgagcgcctgagagaggacctgagcttatttcagcagatggtttccggtaatgaggaattacctggcgtcgaactggttattcatcgttttacgcttgaacaaggtcagcttcctggtgaatacctgtatacactattacttgcccaaggtagtcagcgttcaaaagaattcaacggcaaactggagtttgtggttgggttgcttcagaatggtgaagaaaaattcatttctcttgtagacgagaatgcatctaaagaatttccaataaattttcgcttctaccacagactggagaaaagcttccaaataccagctgatacggtagtgaaaaatttgcaggtttttatctatgagaatggtttaaatgaagcagtgctgacaaaaacgattcagttatctcaaaaggaatcggggaatgttcggaaaaaaacgtagggtagtcagtgatatcgatacgttaatcggggaaaacaccgtgattaccggtgatatccagtttgctggcggattgcgggttgatggccgtatcagcggtagcatcatggcggcgggcaataagcagcattccttgcttgtgttgagtgaacaaggggtgattgaaggaaaaatcaaggtgccgtatctggtgattaatggaatcgtcaaaggaccgattcactccgatgagagtcttgaactacagcctggtgcaaaaatcaccggggatatttactacaaaactataaaaattcaccaaggtgctgtagttgaaggaaaaatggtttgccatgagaactcgcaaccggagaagctgattacctacgtcgcatcagccgaggagcagaaagaaaaagtggaataaaattctattgcggttgatttgatctgtctaacccagtatttctgttgcgtgctgaagtgtggcagcggtcagattttcaccacccagcatacgagcaatttcctcaactctttctgctgcatcaagttctgcaatatggctagctggcagttggttatcatctgttccggcagttttagatacacgccaatgatgatcgcctttggccgctacctgcggaagatgagtaatactgattacctgccgcgtttctcccagttgatgcagcagtttaccgattatttcggcgatgcgtccacctattccggtgtctatttcgtcaaaaataagagtgggagtggtgccaatcttgcttgtaataacctgaatcgccaggctgatacgcgataactcaccgccagaggctactttattcagtggccgcaatggcagatctttgtgggcggatacctgaaattcaatctgctccaggccatgcagattgcccgatggcactggtatcaatgccacattgaagcgaccaccgtccattgccagcgcctgcatggattctgtgacttgctcggacagctgatttgccgcactctgccttgcctgacttaatctgtctgcaagatttttataatcattgcgagcggatttctctgcttctgccaacatttcgttgtttgaaatgtttcccactacctccagacgctgcctggttgtttccaatagctccggtagcatttccggagagacgcgatatttcctggccgttccatggatagcagcaatacgtgtctcgatttcctgcagcttgcggggatcaatatccagatgttgctgatagtatttcagttcatatactgcttcctgcagttgtatttgtgatgattgtaactggctgcaaattggttcgagtgttttgtcaatattcgacaagctgtgcaagtgggcgatcactgcactgagttgtggcaataccgcagcttcactttccgataatgcttccagactggactgagcagtttccagcaggctggctgtatgcgtcagccggttgtgttctgcttgcagggtttcccattcttcagatgaaaagtgcagagcagtcagttcctgcagttgccatgacagaagttcgtgctctcgtatattttgctcgctttgctgtttccacgcgagtctttgctgacatagatcttgccagtgtcgataggaggaggcgactcgccgagcaagatctgattcaccggcccaggtgtcaagcagttcgcgctgtttgtggccctgcatcagcaactggtgtgcatgttgaccatggatatcaaccagccattcacctgctgttcgcaattgttgcagggtggcagcgtgtccattgatgaaattacgcgaacgtccgctggtttccatgattctgcgcagcagacaaatgccggtttcgtcttccagtgcattctcctgtaaccatgtctgtagcgcaggaatggcgcttacatcaaattgtgcggtgatttcggcacgtttacagccatgcctgatttgacttgtgtcggcgcgtctgcctaatacaagttccagtgcgtcgattagaatggattttcctgcacctgtctcacctgtcagaacggtaaaaccgggtttgaagagcagatcaatgtaatcaactataacgaaattctgaatagatagattttgcaacatggatactaactaacggctgtttttctgaaggatgctgctccaaccgagtttttcccgcagcatacggtagtaactgtgatggacgggatgcagaagttttattgtttccggacagcgccgaaccaatactctgtcatgctcgcccagatcaaaccaggaatggctatctgtatagatctttgtctcagttgtataatgaattttgatttcaatgactgcatctgcaccgattacgatcggacggttgctaagtgtatgcggacagacaggaaccaatatcatcaggttgagtcctgggtgcaggatcggcccaccggaggaaagtgcataggctgttgatccggtaggggttgcaataatgaggccatctgatcttaaagaataaacatattctccattgatatggacctcaagctcgatcatgccactgctgatgccgcgatgaagcactacatcgttgaaagccagttctttaaagacgctttccccatgacgtgtgacttcggtggtgagcagcatcctgttctctacaataaattggcccgctagcatgtcattcagggttgcatacatggtatcgactgtaagatctgtcagaaatcctaatctgccctgattgataccgatcaacggaacactaaatggaacgagtgtacgagcaatattaagcatggtgccatctccccccagcacaattgcaagatcagcctgtctgccgatttcttccagagccactacgggatattggtttttgccaatatgcgcggctgttaaatcatccagtaccacgctggtgccccgatcagtcagatattctgccagattcagcagaggcgtcatgatatcgggatttttgtgtttcccgatcaatgcgattgttttgaataaagtgctgcccatgtatgaaaagggaggtggaacagtaaaaatatccggattcctgctgcaggtgatcaggatgaattcaagtgattgtaagtacttgatattaccgtagcctatcccaaaaaagtaaaaatgagttgaaaaactgtattccacttatatgtaacatttgaaatccccgctttaggctgtctctgctcgtggcaggactgattcgtgtaaaataaataaatgcttaacgaacgcgcgaaaattctgcttaaaaccttggttgaacggtatatccatgaaggccaacctgttggttcgcgttcactcgccaagttttcaggactggatctgagtccggccacgattcgtaatgtaatgactgatctggaggaaatggggtttgtttccagcccgcatacatctgccgggcgtatgccaaccacacttggctaccgtttttttgttgataccttgttggtggtgcaatctctggataatgaacagattactctactggaaaaccggatgcacccaaataacccatcgcatttgattaatgttacctctcgcttgctttcagatttgacccagtttgttggtgtggtggtaacacccaagcgaatgggaggggcggtatttcgccatattgaatttgtgccattatctgaaaaacggattctcctgattctggtaacgccagagggggatgttcagaaccggattatttttactgaaacggtttataaccagtctgacctaattgaggctgggaattttctcaatcagcactatgctggttgtgcgctggaagaaattcgttccgggttacagcacgaattgacacagttgcgccggaatatgacagatcttatgaatgcggcaatagaaataggtaatgctgcgctgcaggaaagcagtgaagcagtggtgattgccggagaacacaaactgtttgatgttcgtgatttatcggaaaatctgtctagtttgaaacaattattcgagctgtttgagcgaaaatcaaagttgttgcagttaatggaattaagtcgccaggcgtgcggcgttaaaatctttattggtggtgagtctgatgaaaccatgctggaagagatcagtgtggtaactgcaccctatgaaatggaaggtaaaattgtaggtactgtgggggtgatcggtccacgacgtatggcttatgagcgcattatccctattgttgatataactgcccgcctgctttcaaataatctgtcgtaatatcccgccctctatttttatgtcacgaataatattaccggagccggcttatcgacacggttcaattgatagagtcggtgttctgctgattaatctgggtacgccagatgctccgaatgccaagtccctgcgaacctatctaagacaatttctgagtgagcctcgtattgtggagttcccgcgctggttgtggtggcttattctgaacggtattattttgaatatccggccaggtaaatcagcaaagaagtatgcgcaaatctggacgccagaaggttctccactgaaaatacataccgagcgtcagacagaacttgtcgcagctttactgaagaaacaactcaattcggttccgatagttgaatatgcaatgattgtcggcaatccatctatcgcagagaggttacggcagatgagagagcagggttgcagccggattttggtgatgtcattatttccccagtatgctgccagtagcgccggttgtgcattggatagtgtttttactgagttgagaaagatgcgtaatatccctgatattcgcaccgtcaagcactaccacgatgatccgggctatattgcagcattggcgcagaatgttcgtgattactgggagaaacacgggagacctgacaagctggttatcagctttcacggtgtgccgcgtaaaacgctggagatgggcgatccttatcattgtgaatgtcaaaaaaccgggcgattactggctgaagcactggaactaacgaatgaccagtatcaagtatgctttcagtcgcgttttggcttttctcagtggttgagtccctatacttcagaagttctaaaagaattaggcaaacaggaaaccgggcgggtggatgttgtctgcccaggattcgtctcggactgtctggaaacactcgaggaaatcgcaatggaaggtaaaacaacctttaccgaggccggagggggggaatttcactacattcccagcctcaatgaacatccggagtggattaaagcgatgagagacatgattcaagcacacttaacaggctgggttgtccggcaaccttccgaagaggatgctgagcagtcgcgtaaacgggcgctggagctgggagcagaagaatgattagtgcatccatttgtattcttgttgattgataatccgcgcaggggatttgctctgaattggagctgaagatatgatcgatttatatctggttatggtcgggagagaagaatgagtacattaatgatgaagctattgttcgccttcctgttgatcaactttctgacagcctgtgcaacttctcctaccggccgaacgcagcttgtatttatgccggatacagaggtaaacagcatgggtctacaggcatttgataccttgaagcgtgaaaagcagatcagtcatgatgcggtgagtaatcggtttgtcagttgtgttgccagcgcaattacccgggaagtggggggtgaatgggaagtggtcgtatttaaagaccagtcactgaatgcatttgcgttgcctggtgggaaaattggtgtgcatactggcttactcaatctggtggataaccaggatcagctggcagttatcattggtcatgaagtcgggcatgtgatggctcgccatagtaatgaacgtttatctcaacaggttggaacaaacctaggaatatcgcttgtccaggcagttgctgcacctcaatctacgttggggcaaactgcaatcggtttgctggggattggggcacagtatgggattatcatgccgtatagcagattacaggaatccgaggcggatatgattggtctggatttgatggccaaggcaggattcaacccgtcggaaagtataaaactatggcaaaagatggagcaggctagccagggtgcaccggtagaattcctttccacccacccctcgcacgcgtcccgtatccagaatctgcaggcatatttaccaaaagcgcaacaattacagaaacaagcgaatattgcagggaaaaatccacattgtactaaatgaagaatatcaaattcattggtaactgcaggctgatgagcagcatcattcgctatgcggtgactgaatagctgtctactaattgctggaaattattttttatatttaggagataaaaacaaatgtcgcagaaacaccctgttatcgctgtaactggatcttccggagccggaacatccactgtcaaggcaagttttgagcatatttttcggcgtgaacgactgaatgttgctgtggtagaaggtgacagcttccatcgttatgaccgtgaatccatgaagcgagtggttgaagaatcggaaaagagtggcgggcggcctatcagccattttggcccggaagccaatgagtttgaaaagttggaaaccttattccggacatatggagaaagtggatctggagaaattcgtctctatctgcataatgaagaggaagccaaaccctacaatcagaaacccggtacatttactccctggaagacaattgcacccggcacaaacctgttgttctatgaaggtctgcatggcggagtgaagagtgatacagcggatgtcggccagtatgtagatctactggtgggtgtggttccaattgttaacttggaatggattcaaaaaatataccgtgatactgctgcgagagggtattcgtgcgaagcggtgacacataccattctgcgtcgcatgcacgattacgttcattacattacccctcagttctcacgtacacacattaatttccagcgtgtgccaacagttgatacttccaatccgttcattgcacgggatattcctgcactggatgaaagtatggtcgttatccgttttcgtgattatcacggtgctgattttttcccttatctgcttagcatgctaagcggatcgtttatgtcccgtcccaatactatcgttgttcctggtggcaaaatgggtatggcaattgaattgattctaacgccgctgattctggatctggtggcaaaaagcaagaaatagtttttctgatatccccccgtctggctctgatagcagacgggaaattcggctgttccctcttatatgactgctctacttactgatctcaacccggaacagctggaagccgtaacctggccacaccagtccgctctgatactggcgggtgccggaagtggcaaaacccgagtgctgactacacggattgcgtatttactgcaatcaggccttactcagccgcagaatcttctggcagttacattcactaataaagcggcacgtgaaatggtcgcgcgtatcagcacgatgctgcctatcaatattcgtggcatgtggattggcacatttcatggtttgtgtcatcgcatgctgcgtgcccattatgaagatgcagggctgccgcaggcattccaaatactggatatggccgatcagctgattgttatcaagcggatactgaaagagcgctcgttggatgaaaaagtgctgccacccagacaactgcaatggtttatcaataacgccaaggaagagggattacgagcctcacaggttgatacgcgtggcggtttcaatcggactctggctgaatgctatcaggcgtacgaagctgtcagtatgcggggaggtactgttgattttgcagaactgttgctgcgttgctatgaattgttgagtcgcaatgaaattctgcgggaccattatcgtggccgtttcgaacatatattggtagatgaatttcaggataccaaccgactgcaatatcaatggatcaaattactggcaggctcgggctcacaacaacatgctgctatttttgctgtcggggatgatgatcaaagcatctatgcattccggggggcgcatgttggaaatatgcgtgatcttgagaaagatttcagcgtacccaaaattatcagactggaacagaattatcgctcacaaggcaatattctggacgcagccaatgcactgatcgagaataacaaagggcgtctaggtaagaatctgtggactgctgcggggaaaggtgagtctgtgcgggtttattacgccgctacggatgtggatgaaaccagctttattgttgatgaaatcaaggctctgcacgctgaaggattgtccctctccgagatagctctgctttatcgttccaatgcgcaatcacgggtgctggaacacggtttgttcaatgcatctatttcttaccgtgtttacggtggtatgcgttttttcgatcggcaggaagtaaagcatgcactggcttatttgcgactggttgcttcgccggatgatgacaatgccctactgcgggttatcaattttcctcccagaggaattggtgcacgcacattggagcaacttcaggaccaggcggaaatacttggaaccagtctttggcaagcggcacttaaggcatgcgagggaaggaaagctgttaccaccaggggtgaccagccaggaagagggatagcaggttttgttaatctggttctatccatgcagcaggcatgtgaaggacagccgttgccggaaataatccggcgtgtagtagatcagagtgggctggtggcacattaccaggctgagcgtgagggtaacaatgagcgcctggaaaatcttaaagagctggtcaatgctgcgaccagttttgtgcatgaagccgaagatgacagtctcacggcttttctggcacatgcctcacttgaaggtggtgagcatcaggcggagggctatcaggatgcagttcaattgatgacagtacatgctgcaaaaggattggaatttcattcagtatttatcagtggtctggaggaggggttgtttcctcatgaaaacagtcgtaatgagccgaatgggctggaagaagaaagacgtctgatgtatgtggcaatgacgcgcgcgcgccaacgcttgtatctgagctatgcagagagccgtatgttacacggccaggtacgggtgaatgtgccttccaggtttgttgatgaaattccggaggagctgctgaaaaggttgcgatcatccggtttttctggagcagggtatcggcaggggctgtcaggaaccggacaaaatactgttagcactgcctattctcgccagggaagagagaagcatacaccagttccagcggcagccagggtggccccgcaaggactgaatacggcggggttgcatattggtcagcaggtatcacacacaaaatttggtacgggcactattgtaaattatgagggcagtggatctgatatgcgggttcaggtgaatttccgcaatacaggtacaaaatggctctcacttacctatgcaaaactggttcctttataaattggattattttggttcatcgttctcaatctggctgatattttccttgtttccacctgtgtcctgatcagatctggtgttttcgtcttgttcgtagtgaaaaatatccttgtagctgacatatgctgaggcgaatgcaaccgggaaccatacgatgaaaccaagtccgtagagcatggctgaaagcatggcaagaataaacaggacaataaagtaaatctggaaagcaaagagatttttcaggcacgcaaaaaaacttttacgtatggcgatgagagggggcattttctcaaagatcaccagcatgggagcaaaccagattgccatcagcagcggaatagttagtagcagggaaaataaagtagcagataatatgtcgttcatgaccccggccagctcggtttcatcaaatcgtttgccatgcagccacatgtcaatggcggcatctcctccacgcagcatgaagaacccagtaatcagaacatcaccgaccaggtaaattccaccgatcgtaataaggggtagggtatatttcttgaatccgtaaaacagatattctagttccagtttaccgtttagatccagctgcctgcatccagccataatgccggccacaaagacaggtacggtcaatatgccgacaagactccccaggtaagggataagccccagcgtagttccgatcagcaaataagtaaaacatagaaagatccagttaaggggtgcctggcggaaaaagtaaaacccactcaaaatccactgcaatccctgttttccgcgtacatatcgtgcttccatcgtatttctccagtaattaaagtacgcccggccagaattttaattgtttatagagcgtatgtgaaaaggataacgataatctgtttggtttcaagcctgaagagagggtagtacactcggattggtcagatggtattccagaatttttctgaagtattctggatcctttttatgtgtcaactcacccgggcgaggcagataatagtcatatagacgtgataaccaaaaacgcagtgcacctgcccgtagcatagcaggccaggcagggtattcttccgctgttaatggtcgggcggcttggtaggccttcacgagggcatgcatgcgcgctttgtccattactccgtccccaagcgtacaccagtcgtttgcagtaatagccaaatcgtatagtaaagcatcattacaggcaaagtagaagtcgataattccgccaatgccggtggatgtaaataaaacgttatcacggaaaagatcggcatggataatgccttgaggaaggttggttgtgcgctgctttatctggaattgcaattcctcaccgagcaggttttgctccgagcgggaaaggaagggcatgactgttccggcagcagtttgccaccaatccagtccgcgcgggtttctgtttttaccattgtagtttagtcctgccaagtgcattttggcgagtatttctccgacctgtgcacattgttcttctctgatttgtgtcatggattgcccgggtagaaaggtcacaatagaggccggtttaccattgagcgtacctagcaaagcgtgatcttgtgattcaataggtttggggcagggaataccctgctcggagagatacgccatcagattgagataaaagggcaattcagtgctggttagcttctcgaacagagtgagaataaatttgccttgtgtcgtggtgacaaaataattggtattttcgattccggatgaaataccctgcaaatcagtcagtgatccaagtgagtaattttgcagccagacggcaagttgctttttggtaaccggggtgaaaacagacatgaatgaagtactgaaaaggcagtttgtaaaggatgagatggcaaataaaccagcaagtttactggagatcgctcaggttccggtgaatcttgctcaaaagcggtaaatctcccacattggaacacttacaccagatcccatatccccggggtgagttatgccggcagcactgcgccggttcaggaggtaataaggttttccgattcgaggggtgattttgatcatgtataactcaccattaacacgatattcctcgattgttctgtcttttccttcgtggattgttatttctggctcaagagatggatccagccccagttcggggggaagggcactctcttcgccgctagaaggaggttctggaatttctggtaatggaatcaggttatccggttgcggtttgttttgtgcgaataccaaagaggatatccagaccagattgctgcagaaaaataaaataattactggcctcatgctgatgtatccggatggttggaatattctggtatttgtctgatgaaataaatctgtcgatgtcaaagattgagttgtatgttacgttcagtagctgaaggctcaaacccggaagtttcgtagtaacggaaaattgcgtctacgacttgagcgggttcatcaacaatttgaatgagatccatatcttctggagagatgaaattatcctggacgagtacctggcgaaaccagtctattattccctgccagaaatctgagcagaccagaatgattggcatcttgcgagtttttccagtttggactagggtcagtgcttccattagttcatctagtgtgccgaatccacctggcatcacgacgtaggcagttgcaaacttgatgaacatatacttgcgagcaaagaaatggcggaaagtctggctgatatcctgataaacgttgcggcgttgttcgtgtggtagctgaatgtttagccctacactgggagatttgccataaaaagcgcctttgttggcagcttccataatgcctggccctccaccggatatgactgagaatccagcatccgacaattgtcttgcaattgcttcggttaatttataatgcggatggtcgggatgagttctggcgctgccaaaaatactgatggcgggctggatacattcgagtcgctccgtgccttcaacaaattctgccacaataccgaaaacccgccatgattctctggctgaccagggtttttccagggtaagggcatcccccaactttgcttgtaaactcataaaggtccttatttgatgaaaacactcgtgctggttgatggctcttcttacctgtatcgtgcctttcatgcgttgcccgatttacgtaatcgcctgaatgaaccgactggtgcaatttatggcgtactgaatatgctgcgtcgcttgtataaggaataccagccagattatagcgcgtgtgtgtttgacgcaaaaggtaaaacgttccgggaagagatttatccgcaatataaagcaaaccgtccgccgatgccggcagatttggctggccagatagatcccttgtatgcctgtatccgggcaatgggctggccgctactggtggaagagcgggtcgaggcggatgatgtcatcggtacgctggccagacgtgcagcaggtgaacggatacaatgtgttatatcgacgggtgacaaggatattgcgcaattggttgcgccaggtatacgactggtaaataccatgaatagtgaatcactggatgaggcgggtgtgctgcaaaaattcggtgtgatgcctgcgcaaatcatcgattttctggcgttggtgggggatagtgtagataacattcccggcgtagaaaaagtaggccccaaaactgcggtgaaatggcttaatcaatatggctcgttgaataatctgatcgcacatgcacatgaaataaagggtgtggtgggtgaaaatttgcgcaaggcactggattggttacaggtttcaagagagttgctaacaatcaagtgcgatgttccgcttgcaatgggttggcaggatctggttgctgctcctcttgatgttgctcggttgatggcgctttatgagcatcttgaattccgaagttggttacgtgaactcaggcaatcagattctgaaacaggcccagcaactatacctatgtatgatccattagtgccgggagaaagaaacagcgatagccgggattatcaaatcatcctgactgattcccaatttgaagaatgggtccagcaatgcgagtctgctgaactggtttcgattgataccgaaacaaccagcctgaatccaatggaggctgaactggtggggctttcgttatgtacggagccggggcacgcagcttatataccgctggcacatcattatcagggtgtgccttcacagctaaatcgtgaacaggtactgcaacggttgaagccctggctggagaatagtgatatacccaaggtagggcagaatctgaaatacgatcggcatgtgtttgctaaccatggggtcatgctgaacggaatcgcgcacgatacgctgttgcaatcgtatgtgctggaatcccatctgtcacacgatctggacagtctggcccgccgacatttggatatccagaccatcagctatgatgatgtaaccgggaagggcgcaaagcgtatcgggtttgaacaggtggaaattcaacaagcggggatttatgctgctgaagatgctgatattcccttgcgtctgcatcattttttgtatccaatcatcagtaaggatgctcatcttggacatatttatcagcagattgaaatgccattgctggaggttctgttccggatagagcgtaatggtgtgttgcttgataccgatcttctacgggagcaaagtggtgaactggcgcggcaactggtcatacttgagcagcaggcccattccctggctggccgtgcttttaatctgaactcaactaaacagatacgagagattttatttgggcagcataagttgccagttattaaaaaaacaccaaaaggtgcgccatccactgatgaagaagttttacaacagctggctctggattatccgttacccaagatcttgctggattaccggagtcttgccaagctcagatcgacttatatcgataagctaccgcaaatggtgaatagacagaccggtcgtgtccatacaaattatgcgcaggcggtggcagttaccggtcgcctggcgagtaacgatcccaatttgcagaatattccggtacgcacaccggaaggcaggcgtatccgtgaggcatttattgctccgagtggctggtatattatttcagcagattattcccagattgagttgcgtatcatggcgcatatttcccaggacgctgggttgatacgggcatttttaggagggcaggacattcatagcgctactgctgccgaggtatttggcatttctgttggtcaggtgaatgcagagcagcgccgctacgctaaagtcatcaattttggtctgatttatggtatgtcggaatttgggctggccacacagctaggtattgatcgtagcgctgcgcgagcgtttattgatcgttattttgcgcgttacccaggagtggcagattacatgcaacgtacaagagagcttgcgagacagaatggatatgttgaaactgtgctgggaagaagactgcagctacctgatattcgcagtagccagcataatcgccggatgggagctgaacgggcggcgattaatgccccaatgcagggtacagctgctgatattattaaattagcaatgatttccgtacatcaatggctggtaaaagcgcagcttcaaagtaaattgatcatgcaggtacatgatgaattggtgttggaggtgattgaggatgaactatttgtagttaaggaaaatctaataatgttgatggaaaatacgtttaagttggatgtgccattaaaggttgaggtcggggttgggaaaaattgggatcaggcgcattaactttctatttgatccaccttcttttcgagaatcttatgaaatttcttgactaataagtagcatctatttagattgagctgttatagaataatttatgattacaaaggagaacatttacagatatggatatcgcatcggtattgttaactggacttattgatctgccgtggtggggatatattattgtgacactggtgtttacccacataacgattgccagtattactatctttttgcatcgtcatcaggcacatcgggcattggatttgcaccccatacctagccattttttccgtttctggctgtggttatcgtctgggatggtaactaaggagtgggcggcaatccatcggaagcatcatgcaaaatgtgaaactgtggatgatcctcacagtccgcaaatttttgggattagaaaggtattgagtgaaggagcagagctctacaagatcgaggccaaaaatcaggaaacacttgatcgctacgggcatggtaccccggatgattggatggagcgtaatgtgtattccaaacatagtgtggcaggtatcgcattaatgctaatcatcaatgtggtattgttcggtccgatcggtttatcgatctgggctgtacaaatgatgtggacaccggtatttgcagcgggtgtcatcaacggcattggccactactggggttatcgcaatttccgtcctggggatgcgagtcgcaatattagcccatgggggatattgattggtggggaagagttgcataataatcaccatgcctacccaacctctgccagattgtccaacaagtggtatgagtttgatatcggttggatgtatatccgcatactggaaatgatgggattggcgaaggtgaaaaaaacagctcccaagctgcaacttaataaagccaaaacccagtgtgatctggagacattgcaggcggttatttcccatcgatatgaggtgttagcgaaatataccaaatcattgaaaattgcattcaagaatgagctgtcatctttacagcaagcagcggttgagcttggtgtagatggctcaactctgaaaaactggatactggctgatgcgaaaaccttgaaggaagaggaacgtaccaagctggatcaggtgttgagccatactcagaagctggatacgctttatcgtatgagagaagaactgtctgcgatatgggaacggtcagcggcaaccaaggatgagttgctcaagcaacttgaagattggtgtcgtcgcgcagaagaaagtggtattgagctgctggagaatttttcacgcagactaagatgctatgcataatactttctttctgcttcggaaggatgtaagttaagcaataaaaaacccgctaaaagcgggttttttattgctggtaataatttattttagttttgtttctttgtacataacatgttttcttgctaccggatcaaactttttgagctccaacttttccgggttggcacgcttgtttttggtcgtggtataaaagtgaccagtacctgctgaggattccagttttattttttcacgcataaatacaccttccttggttcgtcgtcttgccgagtgtcaatcagatacgttctccgcgcgcacgcatgtcggcaattactacatcgatgccgtttttatctatggtacgtaacgcggcattggtaagacgtaaacgtatccagcgattttcactttctaaccaaaagcggcgtgactgaaggttgggcagaaagcggcgtttggttttgttgtttgcatgagagacatgatggccgctcatgggacgctttcccgtgacttgacatacacgcgccatgttactaactcctgtcattaaaatactgaagccttgcattatagcttgtagagatatgttttttcaatttaaatcaagccccgttctgcaaatgatacggtttcattattgccaattacaaagtgatcaagcactttcacatccaccagcgcaagcgcctgtttgagagattgagtcaacatttcatctgccctgctgggttcggcaactccggaagggtgattgtgcgcaaaaatcatggcggctgcgttatgatacagggcgcgcttgactacttcacgtggataaacactggcttgggtgagtgtaccgcgaaatagttcttcgatcattatggttcggtgtctggcatccagaaagataccgacaaaaacttcatgcagctttcctcccaggctaagacggagataactgcgcacagactgtggtgaatccataatgtcgccgcttttgagctcttctgccagtgcacgtcttgccatttccatgactgcctgtaattgtgcaaactttgctggtcccattccgggtaatttgctgaattcgtgtaaattcgctgcacatagttttgttaggctgccaaaatgagttaacagattgcgtgccagctcaaccgcactttttccggtaatcccggtacgcagaaaaatagccagtaattctgcatcggaaagtacggttgcgcctttctgaattaatttttcccgtggacgctcggtttccggccagtctgaaattgccatatttaaatgaatcctgtaaaaatgagtgtgtttaatttggtaatacgaatgaacggttattctgggtaaaaatgaatagttatttgtttttattcaaaaatatatccaatcaactaaatatagatttcttgtcatgatttcagcttgctcgcttgcaggaaagcgcctattgctgggagtaacaggcggtattgctgtctataaggtggcagagctgacgcggttgctgatgcaggaaggagtggaagtacagattgtaatgactgaatctgcttgccagtttgtcggcatagccacgtttcaggggttaacaggcaaaaaagtatttactgagctttgggatactgatgtgccaaacagcatggcgcatatcaatctttcccgggaagcagatgcgattttgattgcaccagcgagtgcggatttcattgccaaaatcacgcatggcttggctgatgatttgctttctacgctttgtttagcacgaaactgtcctttgctgatcgcccccgccatgaacttacaaatgtgggaaaacgctgcaactcgacgtaatctggctaccttgcaacaggatgggatcacagtactcggccctgatagcggttatcaggcttgtggagaaatcgggacaggacgcatgctggagccgaagaatttgctggatgcggtacaaagtttcttccggcccaaatatcttgatggcaggcgggtactgattacagccggccctacttttgaagcgattgatacggtcagggggttaaccaaccggagttccggaaaaatgggattggcaattgcgcaagctgcgcttgcagctggagcgcaagtgacgcttgtatgcggcccaatctgcctgccatttccggctgtccacaaacttattcgtattgttagtactgaagaaatgtttgctgctgtcaaagatgaagtgagcagcagtgatatctttatcagtgtggcagcagttgcggattaccgtccggctgaacagcattctttcaagctgaaaaagacagcggcggatattacgctgacactggttcccaatccagatattttgcaatatgtggccagcctgtccaatcctccattttgtgtcggattcgcggcagaaacggatgccgtccaacaatatgcggaagaaaaaagaaaaaggaaaaaattaccactgattgttgctaacaatgctgtagaagccattggcacaaatgagagtgcactgattctactggatgatgacggatcacattatttgccaagagctgacaagaacgcacaagcaaggctggtgatggcgcacattgccggcctctacgataaacacaaaggatgaattatcacaatgaaacaagttgatatcaaactgttcgatccacgtctgaaagattgctttcccggttatgccacacccggatcggctggcctggatttgcgcgcctgcattgatgaacgcactgagattcacccgggtgagacactcctgattccctccggaatagctattcatctggctaaccccggtttcgccgccgtggttctgccacgttccggcttggggcataaacatggaatcgtgctgggcaatctggtggggctgattgattcggattatcagggacaaatcctggtttcctgctggaatcggggacagactacatttgcactggagccattggagcggattgcgcaactggtcatcgttccggtaatacaagccagctttaatgtggtgaatgattttcagcacagtcagcgcggagagcggggattcggtagtaccggcaaatgctgagagcctgtttcactgtactgttgataatcagtgtattgaatacagccggtgccgaaaatcaacaattgccaatcatgaagctcagtattctggatcacgtaattactgtcgagctggcggatactgcctcggctcgcatgattgggctgatgcatcgacgtaatctgccaaaaaatagtggtatgctttttgtttttccagctcccggtattcattgcatgtggatgaaagataccgttatccctttgagtgtcgctttcttagataaaacgggaaagatcatcaatctcgctgaaatggcatctgaaacactcgctccacactgctcgaccagtgcagcacgatatgcacttgaaatgaattctggttggtttgcagcacgaaagatcaaagtgggtgatcggatgatcggactatagaaaccataaattccggcagcatgtggtggtaggaaatgtgcgagctattgcaagtgtggatgcctctgcttgacagcagatcagtttctgcctttcgtatgtgaaaatttctatctttgtttgtagtatccagaagggtgctgtaagacagaattagtttaaaaattatctaacctcgtgcgagtgaagatgagtagagaggccaatagttaaaacgtggaatagagctggtattgtagattattaatctgggattctgaatacgtttactgataaatagagcgttttatctttgaatggatctttttgcaggatgtacgaaaaagcccaccagatttggtgggctttttggcagtggagcctaacttctaattatagcagcggaataatcagtagtgctacgatattgataattttgatgagtgggttaatagccgggcccgcagtatccttgtaaggatcaccaaccgtatcacccgttacagcagctttgtgggcatcactgcctttgccaccataatttccgtcttcgatatatttctttgcattatcccatgctccgccaccagcagtcatggagatagcaaggaacaagcccgtaatgattgagcccatcaatacacctcccaaagcctgcgggccgaggaaaactccgaccagcactggtatcagtacaggcagcaaggatggaatgatcatttcccgaatcgctgccttggtcagcatatcgaccgcacgggagtaatcaggtttactcgtaccatccataattcccgggatttctttgaattggcgacgtacttcaatcacaacggagcttgctgcacgaccaaccgcttccatcgacattgcaccaaacaagaaagggaccatgccgccaataaataacccaataatcaccaggtgattagataaatcaaaggtaagcagtttgtcagcatgttctagtccgtgagtataatcggcgaacagcaccagtgcagccaggccggccgagccaatcgcgtagcctttggtaacagccttggtggtgttgcctaccgcatccagcgggtcggtaatggcacggacggattcgggcatacccgacatttcagcaataccgccagcgttgtcagtaatcggaccataggcatccagtgctacgatgatcccggtcatggataacatggcggttgcagcgatcgcaattccataaagaccggcgagtgaataggcaatgatgatacttgcacagattgctagcacaggagctgcagtagcacgcatgcccacgccgagcccggcgatgatattggtagcgtgcccggtggtggaagcattggcgatatgctgtactggtggatattcggtagaagtgtagtattcggtgatgataactaatagaccggttagagccaggccaacggctgtactggcaaacagacgcatgatcaactcgccgcctccgacttcgacaccgcccagtgacaaggttgctccccccataaaccatacggttatcggcaaataagcgaagaaagcaattccaccggcaactgccagtccgcgatacagggcgttcatgatcttgccgccttcacgcatcttgacaaaatagcaaccgataattgaagcaacgatggatactgcacccagtgcgagtgggtagactactgcattgccagtttcggtctggaacaataaagcacccagcaacattgttgcaatgattgtgactgcataggtttcaaaaagatcagctgccatcccggcacagtcacctacattgtcgcctacgttgtctgcaatcactgccgggttgcgcggatcatcttcagggattccggcttcgactttaccgaccagatcagcgccaacatccgcgcctttcgtgaaaataccaccacccagccgtgcgaaaattgaaatgagtgagccaccaaaagcaaaaccaatcagtgggtggatgaggttgctgatattgctacttacatctgcgccattgaccagcaacgctgtataaccggctacaccaagcaagccgagccccacaaccagcatcccggttacagcaccgccacggaaggcgatggccaacgcttcgctcaatccgctgcgtgcggcttcagctgtccgaacgttggactgaaccgagacattcatgcccatgaaaccggccaggccggaaagtatagctcccagcgcaaaaccaaaggctgtatcccaggaaagtgtcaagccgataattaggaataaaaccatacctaccataccaatggttagatattgtcgcttgaggtaagccgacgcaccttcctgtatggcggctgcaatttcctgcatgtgcgcattgcccgcgggttgtgcgtagatacgccgaatccacaggccactaaaaatcagggcaagtatcgcgctgcagattgcaatcgttaaaccgtttgccataaagaactccagttaaaatcagaccatcctaaatatgtacggagccaggcctgatagccccgcatcaatctacaatcaaaatcgtgaacagcttgagcatatatagcttaaacacatattttatatgctcttactgctaaaaaacaaaacagattaaattttgaactcagccagctttttagcaactgccgcatttttaagccggatatagtcgggcagtccattcttgtagggtggatagtcttccccctcgattaaagggctgagatattcgcggcatttgtcggtaatgccaaagccatcttcactgataaagtctgctggcatcattttttctacattggcaactttggaaagttcaaccataccgattttccaggtatagggcgaattggagatgcgttcgatagtcggcatcaccgaattgtatccggcaattgcatattccacggcagctttgcctgtggcgtaggcttgctccacgtctgttcgggaagcaatatgccgggcagcacgctgcagataatccgagactccccaatgatattttaatcccaggccatttctgaccatatttgcgattactggcgccacaccacccagctgcgcatgtccaaacgcatcgcgcaatccctgatcggacagaaatttgccgtcagctcctttcactccctctgataccaccaccgtacaataaccgtattccttgacgtaacgatccgttttggccaagaatttctcttcatcgaatgtaacttctggaaacaggatgataattgggacatgacgatccttgctggacgccaacccgcctgcggctgcaatccatccagcatgacgccccatcacttccagaatgaacactttggttgaagtcttggccatactggcgacatcaaaactggcttccagcatggaaacagctacatatttggcaactgaaccaaaccctgggcaacaatccgtgacgggcagatcattgtcaactgtcttgggtatgtgaattgcctggattggatagccgagtgtatcggccagctgtgagacttttaggcaggtatcggccgaatcgccgccaccgttatagaaaaagtagccgatattatgggccttgaatacttctatcagacgttcgtattcccgtcggttatcttcaaggcttttcagtttgtagcgacaggagccaaaagcgccggatggtgtgtggcgcaatgcccggattgcttcgaggggctctgcgccggtatcaattaagtcttcagtgagtgccccgataatgccattgcgaccggcataaacgtttccaattttatccgggtgtgcacgtgctgtttccagtaaacctgccgctgaagcattgattacagccgttacaccgccagattgggcatagaatgcattttttatagtcatactccactcctggttgatcaaaacctgtttctcgtccgcgtatcgtgtaaataaatgtcacgcagcagaagtctttgaaaaaccagctgcctgatcaggtagttacaatctgcccgacgtttacgttagtcatttttcagcaaatgatctggtctggaacagggaacggttcaaagaagcgcttgtcctgtttgtttgagcgctgcgagaatattttcctgtatggtttccacgctgccggttccggcaattttgacgtaacctggtgcatcgggatcgctactgtttgaccattcaaggtagtatccagccaatggctgagtctgctcatggtagacctgcagacgtttgcgcacggtttcttcccggtcatcatcacgcagaaccagcgcttcgccagtcacatcatcccgatcagcaactgctggcgggttaaattcaatatggtaaatccggcccgaggacgggtgtacgcggcggcctgataaacgttttatgatctcagcatcaggcacatcgatttcgatgacatagtctatatgcacattggccgttctaagtgcatcggcctgaggaatggtgcgggggaagccatcaaacaaaaagccgttagtgcaatcaggttcttcaattcggtgtcggaccagatcaataatgatttcatccgaaaccaggccgccagattccatgattttttttgccattatgcctagctcggttcctgcttttacagcattgcggagtatatcgccggtggaaatctgtggaattgaaaaatgttcgcggataaaacctgcctgcgtgcctttgcccgcgcctggtgcgcctagtaagatgatacgaatgattggcctcctttatttttatctggatgttaaccatcctgaagctacgcgtgccatagatgtcctgtgagtaatcggtgttagacaaatcggcattctgctctgtagattttgctgtgaattatatctcaggccagccagtggcttgaagtttttgggggcatttagcgcgtcggcatagcagttgatgctggatggcgttttttacagattgaatatgcgataatttcagctgtctttttcggggatagctatggacgaaaacaaaaataaggcacttacggctgcactagcgcagattgaaaaacagtatggcaagggctcaatcatgcggcttggtgatagcgatgtggctaaagatatccaggtggtatctaccggttcgctgagtttggatattgcactgggtgtgggcggacttccgcgcgggcgtattatcgagatttacggtccggaatcttcaggtaaaactaccctgacgctgcaggtaatagcagaaatgcaaaagcttggtggaacagccgcttttattgatgcagaacatgcactggatccacagtatgctcaaaaaatcggcgttaacgtacaggaattgctgatttcccagccagataacggtgaacaggcgctggagatcacggatatgctggttcgatccggatcagttgatattgttgtaatcgattcggttgcggcactgacgccccgcgctgaaatagaaggagaaatgggcgagccgcagatggggttgcaggcaaggttaatgtcgcaggccttgcgtaagctgaccgccaatatcaagcgcactaacaccacggtaatttttatcaatcagatacgcatgaaaattggtgtgatgtttggtaatccggaaacaaccacgggtggtaatgcgctgaaattttatgcttccgttcgcctggatattcgtcgtaccggatcaattaaacgtggtgaagaaatagttggtaatgagacccgtgtcaaggtcgttaaaaacaaggttgcccctcccttcaaacaggcagatttcgctattttgtacggcgaaggtatctcgcgcgagagcgagattatagaactgggtgtgttgcataaactgatcgagaaagccggcgcttggtattcctataatggtgagaaaatcgggcagggcagagataatgtgcgtgactacctgaaagagcacaaggatcttgcacatgagattgaacagaaaatacgtgcggcagttgaccttgctgaaacaaataaccggactgttccaccttctcctagcgaataaagatgaatttatatacgcgcgcgctgggatatcttgctcgacgggagtattcgcggcaggagctggaaagaaagctatcgcgccatgagtgcacacttgcagaaataaaaaatattcttgacagacttgagcagcaaaaactactgtcagatgaaagggcagctgagcagattctccatacgcgcagtcgtaaatatggaagcaggcgaatacgctatgagttgcaaatgaagggaattaccgatcatctgattgaagctgccatgaaagattttgagcaaacagaattttgctgtgcacgagcgctttggtacaaaaaatttggcggagttccgtctactccggcggaacgagggaagcaaattcgttatttggcgggaaaaggctttccttccgaagtgataagcagggttttgtgtgatgctcgggaaatagagaattgagtcatgaggttttcaggatgaaaagcagtgaaatcaggcagaaatttcttgatttttttgagacacatgggcatgtcgtcgtgccatccagtccgctggtgccagggaatgaccccaccttgctgtttaccaatgcgggtatggtgcaattcaaggacgtgtttcttggtcaggataaacgcccttacgttcgtgccgtcagtgcccagcgttgcgtgcgtgcaggtggcaagcataatgatctggaaaatgtaggctataccgcgcggcatcatactttttttgaaatgctcggtaatttcagctttggagattattttaagcgtaatgctattttgtttgcctgggaatttctgaccggcccgttaaatattcccaaggataagctatgggcaactgtatatgcggaggatgatgaagcagcggatatctggctgaatgaggtgaagattgctccttcccggctggtgcgtattgcaacatcagataatttctggcagatgggggagacagggccttgtggcccctgttccgaaattttttatgatcatggcccggaagtggcgggtggcccacccggatccgaggatgcagatggtgatcgttatgtcgaaatctggaatctggtattcatgcaatataaccgcgataccagtggtgagctgcatcctttacccaaaccatcggtggatactggcatgggtctggagcgtattgcagctgttatgcaacaggttcacagcaattatgaaatcgacctgtttcgctgtttgattgaagcggctgccagagtgaccggtgaacaggatttgtcaaacaactcgctcaaggttattgctgatcatatccgtgcctgtgctttcctgattacggatggtgtgattccaggcaacgaaggacgaggttatgtgttgcggcgtatcctgcgtcgcgccattcggcatggataccggctcggacagaaacagtccttttttcatttgctggtggatgatctggttgatgtcatggggcaggcctatccggaattgatgactgccaagaagcatgtgatcgctgttatcaggcaggaagaagaacgttttgctgaaacactggagaatggcatgggagtgctggaagcagcattggctcgggaaagtaatatgcttccgggcgatgttgttttccgtctgtacgataccttcggttttccggttgatttgactgcggatattgctcgtgaacggggaggtggaattgatctggccggatttgagatgtgtatggcccaacaacgggatcgcgcacgtgccagcggcaaattcactatgcaggcgggtcttgaatatgttggattaccaaccgagtttcacggctatgaaacgttgcagcatgaagcgcatattttggtgttgtataaggaaggcagccatgtggatttcatagaggccggtgatgaagctgtggttgtgctggatcagactcctttttatgcagaatcaggtggccaagccggcgacagcggagaacttctgtcaggtagcggcacttttaccgtaaaagatactcagaaaattcaggccaaggtatttggccatgccggaatgctgagtagtggtcggctggtgacaggtgatcgggtgatcgccagggttaatccgattgctcgaatcaatactgcctacaatcattccgcgacacatttgctgcatgctgcattacgccagatattgggtaatcatgtcacgcaaaaaggatcactggttgatgctgataggttgcgcttcgatttttcccataacagcgctatgcaggcaaacgagattcgccaggttgaaaatctcgtcaatgcgcaaatccgtaagaaccatgaggtggcgacacagttgatggcctatgatgaggccgtcaagcaaggtgccatggcattattcggtgaaaaatacagtgatacggtacgtgttgtatcaatgggcgatttttcaaccgagctatgtggtggtactcatgtgcaacacagtggcgatatcggtttcttccggattgttgctgaatctggcgtggcagcgggtattcgccggattgaagcattgacgggtgaggctgcattggcttacacacagcaacaggagcaacagttgcaacaggtttctgatgtgctcaaggcagcaccacacgaagctgctctgaagttatcccaagtactggatcatgtcagacaagtagagaaggaaatcacagttttgcgatcgaagcttgctggcatgcaaagttcttccctgattgagcaggcgcaggaaatcaagggaatacgagtgttggcggcagtgctggaaaatgtgaacgttagaacattgcgtgaaacactggataatttcaagagtcggttgaaatcgtgtgttgtcgtgctgggtaccatcgaagacgataaagtaatgcttattgccggtgtaaccgatgatctgacagcaaagctcaaagcaggtgacctgatcaactttgttgcgcaacaggtgggcgggaaaggcggcgggcgtgcggatatggcgcaggccggcgggacgctgccagacaagctaccgcaagctctgacaagtgtggcgggctgggtggaacgcaatctttaacctgtaattaaaaattattcaaatacctcttattcaatatgacaacaaccagacattgcaaattactcattctcggatccggcccagccggctatacagcagccatttatgctgcacgggcgaatctcaatccggtgctgattaccgggatggcgcaaggtgggcaactcacgacgacgacggatgtggataactggccggcggatgttgctggggtgcagggtccggagttgatggagcgctttctgaagcatgcggagcgttttcagactgaaatcatatttgatcatatccataccgccaaattgtcaggaaagtcgtttgaactgacaggcgaccaaggaacctacacctgtgatgcactgattattgcgacaggcgcttcggcgaaatatctcgggctgccttcagaggaagcttttatggggaaaggggtttcagcctgtgcaacttgtgatgggtttttctataaaaatcaggatgtggctgtcattgggggagggaataccgcagtagaggaagcgttgtatctctctaatattgctcgtaaggtaactgtggtacatcgtcgtgacaagttccgttcagaaaaaattctgatcgacaaattgatggaaaaggtacaaagcggcaagattgagctagcgcttgatcacgttctggatgaggtgaagggtgatgacagtggcgttaccggggttcgcattcgtcatgtccgggacgatacggcacgtgatcttgatttgcagggtgtgttcatcgctatcgggcatcatcccaacactgatctgttccagggacagctggaaatgagaaatggctacattattacgcaaggtgggaacgagggtaatgcaacagcgaccagtatcccgggtgtattcgcagctggtgacgtgcaggatcatatttatcgccaggcggttaccagtgccggcagtggctgtatggctgctctggatgcggaaagatatcttgaaaaatccagctgagtgccatgaattttctgtccgcatatttacgtatagaggaggacaacccgtcatccagtcaggaaactatccatgatgctgctgccttgttccgcgaggctatgcggggagttaaaccgcttgccgagactgggaaagttacgcctgctcaatcaaaacgccggctgtttattcaacctcatgtaccaatgccttgtgttgaccatgacttgtccggcggtcatcagcaggagataggagagggtgatgaatggtcgtttgcccgtcctggtctgcagcgatataccttgagaaagctgcggcgtggatattggtctattcaggatgaacttgatctgcatgggttaaatcgggatgaggcgtatcgggtattgatgacatttctggaggctgttattttgcagggatatcgctgtgtgcgtgttattcatggcagaggactcagttcaaagaaccgcaaaccggtactaaaaattctgacaggcaactggctgatgcgccatgatgatgtgctcgctttttgccagacgctgcctgaatatgggggaagtggcgctgtactggttcttttgagaaatgcggataagtcaccctgaaaattgcagttgatcgtttatctgtttctggaaacctggaaataactctgccgcttcgtcgccctttgcccgacatgcatccaacatacagaaattttttacctgtttttataaagtattgaaccctccccgagccttgtatcgaacgattcacaagtggctatcatcgtttttctacatgcaggagtgatattgagaagcaggtgaattccaaatgtggtgcagtcaagggcgcgtgccacggtatcaaactgggcaatctgactactttgctggataacaaggaaattgctttggaaggtggaatgtacgatgtggatacagggatagttacgttttatgacaagtaatcatctttaagacgtaactatcccccattagtcagaaactgcttttgtaataatgattttagaatcccaattttgccagcagatcattaacctgtgcctggttgacgtaaacatcttcttatttttttggttaatttccgggccgtttaatagattgttactcggtttggttgctatttctttgctggccggagtatctcccaacaattgttgagtttcccctctcaattgtttcaattgtttgcaagattctctggataaactggcctgtcagatcatgaaagttttgtgctgccaggatttctgtcagatagatttgtgtggcagccgtttgatccggaacttcattcagaaaatcaagagtctgcttgagtgcacgatgtataacaggttcgtttgcaatggtggttacggtttcttcaggtatctgctttcataatttatgtaaactttcggcgtttgcagacagattctcaaggatgggcttggcattctctaccgcgaacggagtagattcggcagattgagttgttttgctaataatgtaatttgttgcaaacgctgatcatgtccaagctcggccgatcaactgtgtatcactctcgtaacccatttcagatgatctacaattttttcattagagcatttttgatttaaatatatgcatgtaatagactattctctatcacaactgatggggaaggttatgcatgcctattcacaagatcttcgagatcgtattctgggtgcgttggatcgtggcgaaggtccaacggcaattgcccggcgctttgaggtgagtcgcgtgcaggtgttatcaggtacgcaagcgatggaaagaagagggccagcgccatagcttgccgatgggaggttatcggcgatcccgcattgcgcacaaggaaccgcagattcggcaatggatagaagccacgccggatctaacgcttgtcgagcttagtgaacgtttggctgcggaaggcattcagatcaaggtgccggcgctatggcatcaactgaacaaatggggttgagttttaaaaaaaaccctgcacgccagcgggcaatcgcgcacagacgtacgtcaggcacgaactgagtgggcccgcgagcagcagcattgggattgccgtcacctagtctttctggatgagacggcaacggccaccaacatgacgcgacagcggggtcgcgcgccgcgcggccagcgctgtgtggcttcggtgccccacggccactggaagagcaccaccttcattgcgggactgcgtcacgatgcgatcaccgctccgttagtgctcgacggcccaatgaacggggccgcgtttctcgcctatattcaaacctgcctgtgccccacgctgcagccaggtgacattgtggtggctgacaacctgtcttgtcacaaggttcaaggcgtccgcgcagccattgaagcggcaggtgccaccctgctctacttaccaccgtattcacctgatctgaatccaatcgataaaatgttctccaaactcaaagcctttttacacaaagccgccaaacgaaccttggtgccttatgggcgcagatcggcaaagtgttggatctgttcactccggaggagtgtgccaactacttcgcttcatgtggatatgtaaacaaataagccaaaaatgctctagtatccaagctgctgtttattttttggcaatacctattgactaatcaataaaaactccgggtttacgcatgtaccgccatattctgaagaattttgttcagtttctcgtcgagtgtggctgcagtaaaaggtttggcgatatatctgcttgcgccggcttgagccgcgacaataatgttttctttcttggcttcggcggtgaccatcagcacggggatgtctttcaatgcatcatccgcacggatattttgtaacatggctaatccatccatattgggtatattccagtcggaaacaacaaaatcaaaaccaccatcgcgaagtttttagatagtgtagtcatgagattaaaaatttgagattcttttaaaaaacaaaaggatttcatatgacacaatcacatcgcagacatgatatttcggataaggtatgggcattgcttgagggtcatttaccggggcgcgaaggagtatagggagaggtggctgcagataatcgtcgattttcaatgctgttttctggatataagaacaggcactccatggagggatttaccgccggactacggaggctggagcaacacccatcgcagctttattcgctggcgtgataagggtatctgggaaaagttgctggaaattctgattgatgacccagattatgaatggctgatgattgatgccagccactgcaaggttcacccccatgccagtggagccagaggcggtaatcaggatatgagtcggacaaaaggaggctcaacaccaaaatacatctggccgtggatgcgcatggtatgctgatcagaatccttgtcacgcaagatgtcactgctgattgcacgcaagctggccacctgattgaaggaatcgatgtcgattatctattggctgattacggttatgacagtaatgttcattattgaacaggcgaaaaaacagaagatgaacgttgttattccaccaaaaaaataggaaaatgcaaagatcattatgataatgaattgtataaactgaggtatctctttgaaaatactttccttcatctaaaaagatggcgtggtattgctgagctatgattatttctggtgtatgacaagggagaaggaagcggtgtaacctgttgttgaggatctggcagatcaaccaacaaaacaagggaaacaccgcatgacggatagtaaagtttttaatctgaataaaccagaacaaaatgatccgttacaggaagtgctgcgagaaggcgcacgcaagatgttgtcggcagcgattgaagcggaagtaaccagctttatccatcatcatggcggtttgaaaaccgctgagggtagaacggcagttgtcagaaatggttatctaccggggcgctcgattcaaaccgggcttggtgatattgaagtcaaagtgccgaaagtacgtgatcgcagcggttctggcatcaaatttaacagcagcctgatccctccctacttgaaacgaacacgaagcattgaagaatttctgccttggttgtatctgagaggggtttcaacaggagatttcacagagaccttaaaacacctgttgggagcagatgcacctggattatcgcctgcaacgatcagccgcttgaagcaggactgggaacaggattatcaaaactggactcgccgcgatctgagtggcaaacggtatgtttatgtctgggctgatggtatctacagcactgtgcgaatggatgaccggttatgtcttctggtgattatcggttctgacgaaacggggcgtaaggaactgctggcattgtctgatggttatcgtgagtctgaagcgagctggatggaagtattgacggatttgaaacaacgtggcctcaaaggtgctcccaaattagctgtcggtgacggtgcgctggggttctggaaggctgttacccagtgctggccggatacggatcaacagcgttgctgggtgcataaaatcgccaatgtaatggaaaagctgcccaaggccatgcaacccaaggtcaaggaagcgctgcacaatatctggcaggcggaaacacgggaaaaggcttataaagcatttgataactgtattgaacgttttagtcctaaatatccaaaagcgatggagtgtctggcaaaggataaagactccatgctggctttctatgattatcctgcagaaaactggcaacacattagaacaactaatccagtcgaatcagtctttgcaactgtccggctgagaacagccaaaaccaaaaactgtggaagccggatgactactttgacaatggcgttcaaactgatggaagtggcacagaagaaatggttccgactaaggggctataaattgttagcggatgttgtgcagggcgtcaaattcgttaacggcgttaaacaaaatggagatcgaaaacaggtagccgcttgattctctatacaccagatttgacaatagctcggtattgctacacgatatgctaaaaatacctctccctttcttactgccgtgcaaatcaggtgtatcgctcttggggcaaatatcttgtgactacactgcccgggtaaagcataattttttcttatgttctaaataagaatttcaaattttcattatcctttgactgcctttaggatggcattgccgatgcgaatggatggatagggttcgcctcggttcagaaacgggcgtccagtgcaatccggaagagcgggtccacatcttgacgcatttctctttccctttatcgaggacatatctgtcgtgaacgattgggtcgcgttttgtctagtggctttgccggccctgccggttctttctgccgtcgtcgcaccgttgctgtctcgctccaccaagcatctggcggcgcggatcagcacaggtttcatgggattgactctgctgctggcgctggccctcttgattgcggtactgcaaatgccggctgaacaggtcctggtgttgcgcgccgggccgctggccttaatccttgaccacttagccgtagtcatggcgatactggtctcgggcattagtttgatcgtgcatatgtatgcggtgcggtatatggctgacgagcccagctatgcgcggttcttcgcgttgctggacctgatgacggcgaacattttgctgctggtgtgcgcatccgacttgcttacgctggtcatgtcctggttcctggtgggggtgctactgtacttcctgctgggacacgacaccacgcgcgcggccagcggacgctatgcgttctggactttcatcacctatcgcgccggcgacctgcctttgctcggtgcggctcttgtgcttggacacgcttacggcacgatgcagttgtccgaactgttcgcgcgcatcgcggccaatcccgacgtgacagtcgccggctggccggcgacaagcactgcagcgatgctggtggcgttggctgcgtttgcgcgttccgcgcagtttccgctgcattcctggttgccgtacacaatggaggggccaaccccggtgtcggcactgatgcatgccggtatcgtcaacgccggcggctttttgctcaaccgttttgcccccttgttcgtacacacgtcggacgtgctgcacgtggtgttcacggttggattgttgaccgcgctgattggatcggcactgatgctcacgcaaaacgacatcaagaaatcgctgggttactcgacgatgggtcagatgggtttcatggtgatggagtgcgggctcggagcgttttcgctcgcggtgtaccatcttgttgctcacggtctgttcaaggctacgctgtttctcgggtcgggtggtgtgatcagcgatgcgcgccgcaacgatggcgtgcctcctgacgatatctacacctcggtagtcgaacgtaagccgctgcgcttggtgcgcctgccttggttggtcgcattggcagtgacagtgctagttccggccttcgtgctcggcttttcgcatctgctggtggcagctgatttcgtgcacaagcaaggggcagtcattctgctgttttttggctggatcacgggtgcccaggtctttttctcgattcaccgtttgtccaccgagaatccatggcggttgatgggaatgatcttcctatcgtttgtcatcgtcgttgtgggttatacgataatagggcatctgttcgagcagttcctctatcctgacgcaactctggtaaatgcgatatatgccgcagcaggagtcgatctgattgttttcgatatcatcgtggtggtgctgaccttgatcttggtggcagcatggctcgtcattttgtacgccgactccttgaatatgggtggacgttcgaggatcaggaatatcgtttacctcaatctttacgctttgttctcgcgcgagttctacgtggttgatgtgtttgcgcgtctggggcgcatgctacaagatggctccaagcgcgtgaacgtatggctgcgctgggtttgattcatggagacgacaccgatgatgatctcactgatggcattgttggcagttttttttctgccactattcccgtttagcatggttttcaacgccgtattgcgtgcggtgcgcttggtgtggttgcgcgcggccttgctgctgatttggccgcaaatcggcgtgtggctgatttccggagccagcatgcatctttcacaggcatggacatctgccgtgcttgcgtgggcaaccggcacatctcttttctacgcttggcgtatgctgtcgactcgcgatctcgacatctggatcggattttatgcgagctcggcctgggtgctggcttggatcggcgtcattggcggggccggcgcaatagagctgagcgcggtaatggcatgcctatctgtgaccgtgctggcgctagctctggtcagtcattgcttgtgcaaccgctggggtgatgcctacgtcggcctgcggccgggcttggcgcgggcgatgccgcgtctgggtgcggcaaccacgctctcagttctcgccgccctcggcgcgccggtatttcctgtatttttcgcgatgatctatttgttgagcctgagtaatgctgcgaccgttgtcagtgttctcatcgtttggctgctgtggagttgggcgggagcgcagatatggcagggatttctgtttggaacgccgcacgctgaatatgttttcaaatctgcagtgcgcgacatcccggtattctggactgttctgtccgcgctgctggccgtggccgcgattgtggccgcttctctttggagcatgacatggttgatgcattgaatttaggcaagatcttgcgcgtgcatgccacggtctatgtggctgccgagcctgtaccgttgttctggccgatgcgcacatttatttacaacaatcccctgcatgggctggaaggcttgccgttcacagaggcggttcaggctgcacgcgggcttttccatgcccgcgtgtaccttccacgcactacctatcagcattatctgcgcgaaggcaagggcgatgtgcgcatgctcgacgcgattaccgcgcagttcgcgcagaccgcacccagtatcgatggcatcgactggcagcgctggctgagcgcggtgcgcaaagtgccgaccgatgcctcgccctatgtgccgcatgcctcagccgaagacgtcgctgcagtgctggctggccagcctatcccaaatgacggcgccatcgcagccggtctggatgctgcgatgcttgccgatctgcctccttggcggccgctgaccgagtgtatcgattcgctgtggggaaccaatcttgctgctgagcttgacgagctggtggtcaaaagctgtttggatttttttgacgaagatcagtcatcgtggcgtatgcccggtcgggagcaaggtttttacgctgcctgggctgacgttgttcggcgcaacggccgcatgtttttgcgtgggttggcgatcaagcgtatcctcgatcaggcgccacgcgcagatgccgcgattgttcacgtcatgcaatcgttaggcattgccgaagagcattggcaagcgtatttctcgcgcgaactgttacggctgcatggttgggccggctttatccgctggcgctcgggagccgagcattattattggggacgcaagcacccggccgatctggtcgatttccttgccgtgcgcttggtattcgcgctggcgctgatcgaggaaggcgcgcggcatcgcaaaacacccgcgaaccgacctgcgttcgacgcctttttgcgcgagcaacgcgactgtgccctattgcgctacgcgttgcacgcaggagagcttttacctgggtgggcccaacgtatcgatgatgcgctggagcgatccaacgggaatcgcatagctcgactggccgaggactacgcgaaagaatggcgacgcgtacacgcgcagcggcagggccagatactgcaaaaaatcgcgatggaggctggaacaccggtgcagacgctggccgcgctcggagcgcagggcgccgccaaagtccttgaggtgctgcagcgctttgccgtgcaggaagggtcgatgtggctgcgtgcacttgaagcgcgcgctatcgaccatctgctgagccagatcgtgacctcggacgagccggcggtgccgaagcgcgcttttgcacaggcgctgttttgcatcgatgcgcgttctgagcgactgcggcgcaatctggagaatgtcggagatttcctgacgttcggcattgttgggttctttggcgttcccgtgggctttttgggttacggcaaaggaagtgagacccatttgtgtccggcgatagtcacgccaaaaaatctcgtgctcgagatttccgctgcaatcgacttcgacgaagaggattttgtctcgacccttggtcatgtgctgcacgatctgaagagttcggtgatctctcccttcgtcacggtagaggccattggcgcgctgttcggcttcgatttgattggcaagaccatggcgccgttggcctatcaccgttggcgcagccggctggatgcaccgcatccgttcacccatttgctgctggacaagctcagccgcgaacaagcggactccattgtgcgtgctctgcagagagcgatgatcgtcaatgctttgcgtattgagctgggcatcgagcgggagcgcgtcaacgacgacatgattcgcgagctgcgcgaaacggcgctgggccattgcagcggcaccacgatactggtgcgcgagtttggtctttccttggaacgcgaagcgcgattcatcgagcaagtgcgcgaggtttaccgtgtcaattcgtcatatgcgaattaccagatgctgcgtttggggcggatcggtttttcgctcgacgagcaggtcaactatgtctggactgcgctgacttcgattggcctgacccgcaatttctcgcgtttcgtgttgctcatcggacacggtagccactcggaaaacaatccctacgaatcggcgctcgattgtggcgcctgcggcggcagcaacgggctggtcagcgccagggtgctggcgcaaatggccaataaagccgaagtacgggcgaaacttcggaccattggggtagatattcccgccgacacctggttcgttcccgggctgcacacgactaccaccgataccgttgagttatgcaatctggagcttttgccgccacagttactggtgtatctggagcgtttgcggaacggtctgtatgcagcgtcgcggctttctgcagccgaacgcgttccgacgctgctgccgcaagcaaaaaccttgaaaccggctcaggctcatcgcatagtacgtgtcatgtcgcacgactggtcgcaggtgcgacctgagtggggattgtcgggcaatctgtatttcgtcgtgggacgacgcggtttaacgcagaaggccaacttgcatggacgttcctttctgcaatcctatgactggcagctcgatcccaagggacgcctgctggaaaatattcttgccggcccggtggtagtggggcagtggatcaatatggagcactacttctccaccgtcgacaacactcattttggcagcggcagcaaggtttatcacaacgttgccgggcgcttcggcgtgatgaccggcaatctgtctgatctgcgcaccgggctgccggcgcagactgtgatgcgccatggtcagccttatcacgagcccttgcgcctgatcgtgatgattgaagcgccgctagacttcgcgcgccgcgccatcgaggccgtagccaaggttaagagtctggtgcagggacaatgggtccgtaccattgtcctcgatccgacgcaggatatgcaggcctatgttttcgacaatggcgaatggcaagtacatttcgtatccgcatcccaatcgacatacaccgaggaggtcgtcacagcatgagtacgttcaaactctctcccctgaaaaaactagaaatcatcctcgcaggtgagcatcgcgaattcgctaccagcttgcttgatcgcgctgacgtaaaaggttacaccattgtcggcaatctttcgggcaagggtagccaaggtttttacggaggacacttgatgttcaacgaggacgatgcgctgatcatgatcatcgtcgcggtgtcaccgaatcttgtcgatgcattgctcgaaggctttcagccgtttttcgaggctcattccggagtgattttcgtaagcgatatccaggttggccgcccggtcaagttcacggcctgaattagaatgtgttaagcactttgtccaagagttagttactctattgagatgatcaaacgtaagccctatccgacagatgtatcagatgaagaatggaactttgccgtataatcggaaagtgtgcgacgttgagcacgatttgctgggcctgagtaatgctgcgaccgtcgttcagtgttctcatcgtttggctgctgtggagttgggcgggagcgcagatatggcagggatttctgtttggaacgccgcacgctgaatatgttttcaaatctgcagtgcgcgacatcccggtattctggactgttctgtccgcgctgctggccgtggccgcgattgtggccgcttctctttggagtatgacatagttgatgcattgaacttaggcaagatcttgcgcgtgcatgccacggtctatgtggctgccgagcctgtaccgttgttctggccgatgcgcacatttattcacaacaatcccctgcatgggctggaaggcttgccgttcacagaggcggttcaggctgcacgcgggcttttccatgcccgcgtgtaccttccacgcactacctatcagcattatctgcgcgaaggcaagggcgatgtgcgcatgctcgacgcgattaccgcgcagttcgcgcagaccgcacccagtatcgatggcatcgactggcagcgctggctgagcgcggtgcgcaaagtgccgaccgatgcctcgccctatgtgccgcatgcctcagccgaagacgtcgctgcagtgctggctggccagcctatcccaaatgacggcgccatcgcagccggtctggatgctgcgatgcttgccgatctgcctccttggcggccgctgaccgagtgtatcgattcgctgtggggaaccaatcttgctgctgagcttgacgagctggtggtcaaaagctgtttggatttttttgacgaagatcagtcatcgtggcgtatgcccggtcgggagcaaggtttttacgctgcctgggctgacgttgttcggcgcaacggccgcatgtttttgcgtgggttggcgatcaagcgtatcctcgatcaggcgccacgcgcagatgccgcgattgttcacgtcatgcaatcgttaggcattgccgaagagcattggcaagcgtatttctcgcgcgaactgttacggctgcatggttgggccggctttatccgctggcgctcgggagccgagcattattattggggacgcaagcacccggccgatctggtcgatttccttgccgtgcgcttggtattcgcgctggcgctgatcgaggaaggcgcgcggcatcgcaaaacacccgcgaaccgacctgcgttcgacgcctttttgcgcgagcagcgcgactgtgccctattgcgctacgcgttgcacgcaggagagcttttacctgggtgggcccaacgtatcgatgatgcgctggagcgatccagcgggaatcgcatagctcgactggccgaggactacgcgaaagaatggcgacgcgtacatgcgcagcggcagggccagatactgcaaaaaatcgcgatggaggctggaacaccggtgcagacgctggccgcgctcggagcgcagggcgccgccgaagtccttgaggtgctgcagcgctttgccgtgcaggaagggtcgatgtggctgcgtgcacttgaagcgcgcgccatcgaccatctgctgagccagatcgtgaccccggacgagccggcggtgccgaagcgcgcttttgcacaggcgctgttttgcatcgatgtgcgttctgagcgactgcggcgcaatctggagaatgtcggagatttcctgacgttcggcattgctgggttctttggcgttcccgtgggctttttgggttacggcaaaggaagtgaaacccatttgtgtccggcgatagtcacgccaaaaaatctcgtgctcgagatttccgctgcaatcgacttcgacgaagaggattttgtctcgacccttggccatgtgctgcacgatctgaagagttcagtgatctctccctttgtcacggttgaggccattggcgcgctgttcggcttcgatttgattggcaagaccatggcgccgttggcctatcaccgttggcgcagccggctggatgcaccgcatccgttcacccatttgctgctggacaagctcagccgcgaacaagcggactccattgtgcgtgctctgcagagagcgatgatcgtcaatgctttgcgtattgagctgggcatcgagcgggagcgcgtcaacgacgacatgattcgcgagctgcgcgaaacggcgctgggccattgcagcggcaccacgatactggtgcgcgagtttggtctttccttggaacgcgaagcacgattcatcgagcaagtgcgcgaggtttaccgtgtcaattcgtcatatgcgaattaccagatgctgcgtttggggcggattggtttttcgctcgacgagcaggtcaactatgtctggactgcgctgacttcgattggcctgacccgcaatttctcgcgtttcgtgttgctcatcggacacggcagccattcggaaaacaatccctacgaatcggcgctcgattgcggcgcctgcggcggcagcaacgggctggtcagcgccagggtgctggcgcaaatggccaataaagccgaagtacgggcgaaacttcggaccattggggtagatattcccgccgacacctggttcgttcccgggctgcacacgactaccaccgataccgttgagttatacaatctggattttttgccgccgcggttactggtgtatctggagcgtttgcggaacggtctgtatgcagcgtcgcggctttctgcagccgaacgcgttccgacgctgctgccgcaagcaaaaaccttgaaaccggctcaggctcatcgcatagtacgtgtcatgtcgcacgactggtcgcaggtgcgacctgagtggggattgtcgggcaatctgtatttcgtcgtgggacgacgcggtttaacgcagaaggccaacttgcatggacgttcctttctgcaatcctatgactggcagctcgatcccaagggacgcctgctggaaaatattcttgccggcccggtggtagtggggcagtggatcaatatggagcactacttctccaccgtcgacaacactcattttggcagcggcagcaaggtttatcacaacgttgccgggcgcttcggcgtgatgaccggcaatctgtctgatctgcgcaccgggctgccggcgcagactgtgatgcgccatggtcagccttatcacgagcccttgcgcctgatcgtgatgattgaagcgccgctagacttcgcgcgccgcgccatcgaggccgtagccaaggttaagagtctggtgcagggacaatgggtccgtaccattgtcctcgatccgacgcaggatatgcaggcctatgttttcgacgatggcgagtggcaagtacatttcgtatccgcatcccaatcgacatacaccgaggaggtcgtcacagcatgagcacgttcaaactctctcccctgaaaaaactagaaatcatcctcgcaggcgagcatcgcgaattcgctaccagcttgcttgatcgcgctgacgtaaaaggttacaccattgttggcaatctttcgggcaagggtagccaaggtttttacggaggacacttgatgttcaacgaggacgatgcgctgatcatgatcatcgtcgcggtgtcaccgaatcttgtcgatgcattgctcgaaggctttcagccgtttttcgaggctcattccggagtgattttcgtaagcgatatccaggttggccgcccggtcaagttcacggcctgaattaggtggtagcaggatcctggagcgaagccagatgtcttgcctctcgaatcagaaagtcaagaaaggcttgcgctacggtcgacagccgcttgcctttgcgatgcacgatgaaccactgccgcataatcggaaagcgttcgacgttgagcatggccagtcgctgcatcgccagttcgagttcgagtgtatgcaaggataggatgcccaggcctaattcggcttgcaccgcctgcttgatcgcctcgttgctactcatttccattaccgaatgaaactctactccgtaccgggagaaatgccgctcagccgctttgcgcgttcctgagccaggctcgcgggtgatgaaggtttcgcgctccaggtgtttgagtgcgacccgactcttggcagctagcggatgggtcggtgcggcaattatgaccagtggattgtcaagaaaggcttgagcgactaattctgagttcttcggtggctgtcccatgatcgccagatccatgttcgacgtggtcagcatgtccagaatctgttcctgattcgacactcgcagtcgcacctgcactttagcgtgctgtctgcagaatgcggcaatcaacttgggcgcgaagtaattcgcggtactcgccaccactagatccaattcgcctcggcgcaggccactgaattcttccattgcggcgctgaggtcctgcattttcgccgcaatgataatcgcgtggcggtgcagctcgcgtccggcgtcggtgggttggatttgtttgccgacctggtcgaacaagggtacgccgacttgctcttcgagctgccgcatctgcattgatacggcaggttgcgtcagatgtagcacgtcagccgcgcgcgtgaagctctggcgacgcatgacagcgtcgaaaatttgtagttggcgaaaagtcagatacataatttcacataagtttatctaatgcattctatcagaagattgagttgtattttatgattacattcgatactatgtttgcaagcaaatcgatgaatccatccctaagaccaggattgatgccttggtcgattgtgctgaacaaattttccttcgtcgtttagttctcgcgagcagcgagctttaaggagtcgtcaaaacatggcaatcaaaacctatcaggccggtgtcaaggagtaccgacaaacttactggcaaccggattacgtgccgctagacactgacattctggcgtgttttaaaattaccccacagtctggcgtcgatcgcgaggaagcggcggcggcggtagccgcagagtcgtcctgcggcacttggaccacagtgtggaccgatctgctgaccgatctcgattactacaagggtcgcgcctatcgcatcgaggatgttcccggtgacgatgctcgcttctatgctttcgtcgcgtaccccatcgacttgttcgaagagggttctgtggtcaacgtgttcacctctctggtgggcaatgtattcggtttcaaggcgattcgcgccttgcgtctggaagacgtgcgttttccgatcgcatacgtgaagacctgcggcggccctccgagcggcatccaggtggagcgtgacaagatgaacaagtatggtcggccgctgctgggctgcaccatcaaacctaagctgggcctgtcggccaagaactacggtcgtgcggtgtatgagtgtttgcgcggcagcttggatttcaccaaagacgacgagaacatcaattctcagccgttcatgcgctggcgcgatcgtttcgagttcgtgcaggaggccactctgaaggctgaggccgagaccggcgagcgtaagggtcactatctgaacgtcaccgcgccaacgcctgaagaaatgtacaagcgcgcagaattcgccaaagagatcggtgcgccgatcatcatgcacgattacctcgccggtggcctttgcgctaacgcaggtctggcgaactggtgccgtaacaacgggatgttgctgcacgttcaccgcgccatgcacgccgtgctcgaccgcaacccgcatcacggtatccacttccgcgtgctaaccaagattctgcgcctgtccggcggagatcacttgcataccggtaccgtggtgggcaagctggaaggtgatcgcgcctccactcttggttggatcgatctgctgcgcgaatccttcgtaccggaagaccgttcgcgcggtatcttctttgatcaagattggggttcgatgcccggcgctttcgccgtcgcgtccggcggtatccacgtgtggcacatgcctgcgctggttgccattttcggtgacgattcggtgttgcagttcggcggcggcacgctcggtcatccttggggcaacgctgcaggtgcacacgctaaccgcgttgcgctcgaagcctgcgtacaggcgcgtaatgaaggccgtcagatcgagaaagaaggtcgcgagatccttaccgccgcggctcagcattcgcccgaactgaagatcgccatggaaacgtggaaagagatcaagttcgagtttgacacggttgacaagctcgacattgcccacaagtaatgtttcaaaccaaattcgatcgatctgcgttccagtgggactgcggcgatcggattcgattcctaattttgaaaggatatagctatggccattcaagcctatcacttaacaaaaaaatacgaaaccttttcgtatcttccccagatgacgcccgagcaggtgcgccgtcagatcgcctatgcccttgctcaaggctggaatcctgcggttgagcacgctgtcaaaggaacgtctgccaaggagagtttttggcatatgtggaagctgccgatgttcggcgagcaatcggtcgatgctgtgctggccgagattgaggcctgccatcgcgaatttcctgatcaaatggtacgtttcatcgcttatgataactactcgcaaagtcagggcgtggcttttgttgtttaccgctaaaacgagcggatccatcccaggggcgggttctggttgcatgaaatcaaactactcagtgcgaccagcggccgcctaaaatgaactcaagtgctgaggttcttatgacaatcgctgaatcaagttatgccaatgcgaacatgtccgggcgcgcactggcgctccagcgtcgccaggcgatggcccgtcaaggcaaaaccgccatcaccaaaacgtctgtgctgcgcagcagggcagacgtcgccatgaatgcaggtaaggttgctactgcctggcgcggttcgcaggctcctgttgctgaggcagtatcggctgcgcagatcttgacgcgcgccgagcctttgccggcagcagtcgtatcggctgcgcgagcgcggcgacaagcgcttgccagcgttggcaaggcagcgttgcaaactgcttcgaaaaatcatactcatccgagtgcacatttgcgtccagctgtacagccgttcgccgcaaccaggtgcgattgtgatgcgcagtgcgaatgccggactcggcacagggcagtcaccgaaatgccgatggccggggttgcggtgcaggaaagcgttcagcgtgcgactgccgtcgcagtcgtcgctgagcaggcgaccgggcgcgcgctggccaagatgcgtcgcgcagcgttgacacaagatggcaaggctgggctcaagcgagttgcccaggcgaccaaaattgctgctgcgatgccggggcaggattggcaagctgcgatggtgaaaggcgctaccggaagacagatcgcggagcagcatcgtcgcgtgcagtcacttgcggggcgcgccggtctgtcgaacagcgctgcttctagaccgagcggacgggttaagacgcgcgatgccaagcaagtgccgatgaaggtcgaggaagggcatactttgtccggtcaaaccgtgactggtaccatggtcgagcgcagcatcaaagtcaccggcaacgaatcaggatcctgccgcagtatcaccggcaccgaatatattggcgcggaacagtttcaaaccatctgcggtgtacgcgccgagccaggcgtgtccaaggttgagatgagtcataccttgcgcgagcaaaagatcacaggcatagcgctcggtcgctcgaccaaggccaccggtgacgaagcgggtgtttgtcatcccgtgaccggcaccgaatatctgtccgccgagcgcttccagcagttttgcggcacgcgcccggcgccctcgccggagaaagttgcactggctttcaccaacaaggacatggccgtgtctggctccctggtcgatcggccgcgcaaaatcaccggcgcagagtacggtgctgatcgatcgatcaccggtacctgctacggccgtccgccagaaaacgacaatgcaccggacaaggttgcaattacgcacaccggttcaggcaagactatcacgggcaccctggtaggccgtagcgaacacctcactggcgacgaagccggtagctgccgtgcgatcacaggcaccgaatatctctccgctgaacagtttcgcgacttgtgccataccaatgcgccggcagcgccgcgcaaggtcagcgtgatgtcaacacgcggtgcgcaagccatctcgggtgctgccgtcgaccgttcgtccaaggtaaccggcaacgagacaggttcctgccgagcgatcaccggaagccagtattacactacggccgattttgcggggctttgcgatgcgtccgggccgaacaaagtcagcacgatgcataccctcgctggtcataccattactggttcggaggttgcccccggcccaaagttgacgggtgacgaatcttacgggtgcaaatccgtcaccggcaccgactatatcggcacccaacaacttgcagctgtttgcccgccagggcaatcatctacggtacaacccgtgaataaggttgtcttcgacagtacattgcagggccaaccagtttccggcagctatccaggccgtgctgccaacgtcaccggcaacgaagccggcacctgcgcccccatcagcggcgcgcagtatacgggaatgtcgcaaattcaggaattttgcccggctccgagccttgatgctcaggcggcgcgcgtacgcgacagcgccgtgattccagccagcgtcgtgaccggtgaccgtccaggtgcaggcgggtcgcgcatgaccggcgatgagcgcggcgcttgcgagccgatttcgggcacgccatatcttgggccggataatatgcctgaccaatgcgcaactagcggtcgtttcgttccgcgcggacgcactttcgatgtagcgccgcggccgcctgctccgaaggatttcagcattgtgccgccgtcgcgtcagcgccagatccagagtccggtgcgtgagtaccagggagataatctcaccggcagtgtgctgagcaatttacgcataaccgggacgatcaacaaggccgatggtctgattaccggaacgccggagttccggcatagcgacacgtctcgtagccaggtgcaactggatgaagtcgtcgctgctgcgcagcgactgagcggtgaaggtagtcagcagggagtgcgtatttcgggtgatgcttggaatgcaaacccccgagttaccggtaccgaaggctcgtccagtctggtacgcaacccttcgatgcgcggccaaccgcgtggcgtcggtgtcaacgcagtgaaattccgcgagctcgagcgtcttgaagtgcctgaatcggtcattactggttcgtccggcaataccgatagaggcgcaaccattaccatttcgggcggagcgcgcggctgaggatacgaagatgaatacacgacaacgtatgcaggcattgcgacgcagtagcgttgggccgatcgatgtggccaatgagagcggtatcgcagaggtgctcgaacatcctgcttgcgtgatcagtagcgggcagatctgcgaacactcgcttgtcgaccgcgaccttaatcgcctattgttcgactatgagcggacggtacgctcgcgcttcacccgtatcgtcgaggtgctcaaacgcatctccatgcatcagcacgatgaggatttcaccgagcgcgcgcagcagctcgcccacgaacaactcggttttgatctgccgtcgaagatgtttgaggatgcttgggtgtgcgggctggatttatcggccctgcattcgcactgcatattcagcgtcctgaagtcgtgcgtcgataatgcgcgaaccgagcaggctggctggcgtcagcgcataccgctcgatgaaaacttcttgcgatcctgcggttatcacacagtggatatcagcccctgttcggatggtcggttgcagggtatgagcccttatgtgttgcgcattttacctgggcctaatgtgcaggtgaaggcttatgcgggcgcgctgttcgacattgaagccgatgtatgcgattgggcgcagcgcgaagtcgagcgactgtcaggcgcgatggtcgatggcgagcgtctggactatctcaagatcgccgtctaccacttcagcagctcctcgcataacggtgacggttgcgccgcgcatggcagcaacgatcgccaagccaccgaggcggcactcggccgcctggatgaactacgtgaggcgatcgatcgcagtttcggcatcggcgccgcgcccgacgtgctgttgatcggagtcgataccgatctggatgctttgcgcattcatcttcccgatgcgtacggcgacgtcaattcgcatcgctacatcgaaaccgtgaagatctaccgtgagacgcttgggctatccgccgaggtggcgcgcgcgcgcgtcgccgagataatcgccgacgtcgagaataccggcggttggggccaaggccaagggcggatgaatgatggcatgcgccgtttggtgtctgcgctggccgaagctaatctgtcgcagatcgaatacgtcatcaagcatcataccggtcgctacgcgactatcgggcacgatgaggagtgcatcgtcgctggcaacgcggttcggtcgttaaaattgcgcaacctgttttatttcgcccatctcgacaccatcgaggaaggggcgcccgatatggatgtcgggatcgatatcttcgccaagctcaatgtcgcacacggtctgccggtcccagtgctggtgcatttcgaatatgatgcccggattcccgaatcgcgcgcgcgcgcggttgagcgcggtcggcgggtgcgtgacgcgatcgaggtgcgctatcccgatctggttgccaagggtctacttaattgcgcgatcgcggtgagtgagcgcgctggcgacgagcgctgcgactttgtggctgacgaagttgcagcgaaccattgagtattgaggactaaaacgctatgcgaatcatgcgagtcgaaaaaaccctggtgtcgaccaaccgcatcgacggctttggacatcgtccgttgctggtcgtgcaggacaaacccggtggaacgcgaagcgtagccgtcgatgctgtgggctgcatcccgggtgactgggtgatctgtgtcggttcttcagcagctagagatgcggctggtgccaaggattttccctccgatctaacgatcgttggcatcatcgaccactggaatccggaggcgatctgatggagatctggcgcgtcgtcggtgaactggtttgcactcggcgtgttccgggactcggttcgacatcgctgcgcgtactgaaagggcagaagggtgaaatcatggtggcgtccgacgcggtcggcgccccaccgggaaaatgggtgtttactacgctgggcagcgccgctaggtatgcgatgccagaccagacgacgacgactgatctcacgatctgcggcatcatcgaaggctgggacgaagcgtgaacagacgtgtatacattacgcgtatagagcaaaaggcgcacgcatggcgggcgcttgaatgcagagaagtggcagtttaaccaattttttgactaaaggagtaagaaaatggcagaaataatgggcattgccctgggaatgattgaaacccgcggtttggttcccgcgattgaagcggccgatgcgatgaccaaggctgctgaagtacgtctgatctcgcgtcagttcgtcggcggcggctacgttaccgtgatggtgcgtggcgaaaccggcgcggtcaacgccgcagttcgtgcaggcgctgatgcttgcgagcgtgtgggtgacggcttggtggctgcgcacattattgctcgcgtgcacagtgaagttgagggcatattgcccaggactccgagtgcctaagaaccccctacctttcttgaaacaactacgaggacagtaacatggctaacgtaaacggcattgccctgggaatgattgaaacccgcggtttggttcccgcgatcgaagcggccgatgcgatgaccaaggcagcggaggtgcgtctgattggccggcagttcgtcggcggcggctacgtcactgtgctggtgcgtggcgaaaccggcgcggtcaacgccgcagttcgtgcaggcgctgatgcttgcgagcgtgtgggtgacggcttggtggctgcgcacattattgctcgcgtgcacagtgaagttgaaggcatactgccgaccaagccagacgtcagcggcggtggtggcggcggccgcgatgccgagatcacttccacgcttagttgatcgacggatcgtttcctgccatggctgtcgatccgagaaccttagggtggctggcacgcgctctcaaccacgagatgggagcagtccagcaatacctcgcacaaagcgtgctcgcgcgtctttggggggatgtggaacttgcagcacacctgcgcgccgaagccatggaagagctggaacatgctgaacttttgattgagcgtcagatcctacttggcgtggctccttgtggcggacagttgcccgttgttcgcttgggccgcaatgcacaggaattattcgctcacgaccaacaaatggaagtgcaggccgtccaactttatgtcaatgcgctaatgcatgcacagcgcttgcgtgaccaggactcgatagcactgttccaatcgttgttagcgcaggagcaggagcatctagaacacattgcgcataccaaatccggatgagctttgacatgagtgacgaattgcaaggctgggagcggcgcgacaagccgccgacgttgtataggcgcttttccttcgagcgttatgcccagacgcgcgcatttctcgatgccttgtcggttctgtgcgatgagttcaagcggcatccacagaatattagtttcggtaccacctacgttaacgtcacgctcgaaccggctgacgacaaggtcttcgcgtcgcaggatgaaacttttgccgcacgcatctcagcgctggctgaacaggggaagtgatcgtggttgacatgcgtgtcatcgcgatcaccaaccaaaagggcggtgtcggtaagactacggtggcaatgaaccttgccgctgggctggcgcggcgggcatcagtagtagtggtcgatcttgacccgcagtcctcggccacgcaatgggcgacggccggcactaaggcctttcctgctacggtcaagcagcttcgactaggcgttgtcctgcccgatttgcgcaaggaattccgtgccttcgactatatcgtgcttgactgcccgccatcggtcgacacccgcgccgctatgtttgcgctcctgacttgcgatatcgcgctgatcccggtcctgccttcgcctgtggacctgtgggccagcctgcgtttgccgcaggagatcgacgaggtgcgcaaacgctgttcaaatctgcgagcctttctgctactcaatcagattgaagcgcgcagcgcgctatcagcggcgatgcaagaagcactggctgagttcggactgccggtgctgcaaacctcgatacgtcggcgtagcatctacaaaacggctgcgctcgaaggcgtatctgtgtttcaaatgggtgcgcgcgggcaagccgccgccgcagaaattgaagccatcatccaggagattgttacatcatgaccaacataaaagacaagcttaccagtagtgtgcgccaggcaagatctaccacgccttccaaggctgttgcgccgcgtgtggtagccgaagacaccaagcaaacaaacatacaagccaaaccggttcgccaaaccgctgagccggtttcgagcgctcaggcgctttttcctgaccgcgtatggccggactaagcccggttgaaccgaagaattctggatatcattatgagtaacgaaaacctgacgcgaacctatatgccccggtggaatgcatcctatcgttccacgacttcaacccaggaggcgcaagcgatgtcgctgccggcaacggccgtcgttgcgccgacatcgagttcactcgacagctatcgtgtgacccgcgaaccgtactatcgcgccaccggcgatgaagttgcgctgtatgaggcagcgtactcggtgcgtatgcccatgatgctcaaaggacccaccggctgtggcaagacccgttttgtcgaatacatggcgtggaagctcggcaaaccgttgatcactgtggcatgcaacgaagacatgactgcctccgacttggtcggccgcttcttgctcgacaccagcggtacgcgctggcaggacggaccgctggcgctggcggcgcgttatggtgcgatctgctatctagacgaggtggtcgaggcacggcaagacaccacggttgtgattcatccactgaccgatacgcggcgcattctgccattggagaaaaaaggcgagatcatcgaggcgcaccccgatttccaagtcgttatctcgtacaacccgggttaccagtccctgatgaaagatctcaaacaatcaaccaagcagcgtttcggtgccttagattttaactatccggaacatgaagttgaggccgagatcatcgcgcatgaaagcggcgtgagtatggacgtggcgaaaaacctggtgcatattgctgagcgtgcgcgcaacctgaaaggacacgggctcgacgaaggcatttctacccgcatgctgatctatgccggccgtttgatcgcgcagggcgtggcgccgctggcggcgtgccgcgtcgccctggtgcgaccgatcaccgacgaccctgacatgcgcgatgcgcttgatgcggctgtaaccacctacttctgatgggcgacatgggtctcgcattatggctattcaccttgaagaattccagagtttgctcgacgagctacccggcagtgcgcaggaactgctgcgcgcgtcttggaacgaggcggcgcgcgcactcacgccgcgtggcttagataactacctcaaaggagcggtcgcgttgcatcacctcggccgcggggaggaccttgtggtcggtttcatccaatccatgcccgagttggcgcgcggagtgggtgaggaagtactgcctgacctagtcaacttccttcttggcatggcatccaagacctcgggccatgtgcttgcgctgatcgtcggcactgcgccattagcggcacagcgcttgagcgatgccggcctattcgtcagttatctgaaggtactcgagatcatgctggcccaggcgcctcgcggcctgcgaccgatgctagaaaacttggaccgtctgcttacccagctcactctgggcggcttgcggcgctgggtgcagtggggtgcacaggcgtatcgcagcgatttagacggtcaggtcgcgtacttttctctgcaaagcgccgacgcgctggctgtgctgcagcaggagcgcaagggcacgctgttcgtcgacattcagcgtcgtttgaacatctatcagcgcgcaatgtggggacgtgattttttcctgcgccctacttccggcgattacgaaagccgtgaagagttgaagccctacattgagcattacgtcattcatattgccgatgcctacgacaattacaagccactgggccccgatacgccgcccgagcaatgcgtgccggcactagagatctaccgcgccgcagttaaccattgtgctgcgcatctggtgttcactcaacagccgctgtccatgcagatgttgcatccagcgcaaatggcggtgattgaggtattcgaagatgcgcgggtcgaggagctgtcaatccggcagtttccgaacatgcgcgaagcttggctgatgctgcatccggtgtttgattactctcgtgagctgcagagcatcggcgaattgctcgaccgcctgggccgcgccctgcttgaagagcagagccacgatcctcatccgtgggtgcgtgaggccgtggtggcgtttcgtgcacagaccgatctttcgaccaatcagacaagctggaacctcggcatagacttgtcgcacaagctgttcgagttgccgctacccgagttcaacaaccgtactgaccaccgcttgagcgcgatctaccgagacgacaaccgagcggtatggcagctcgaagagtacgacgaggcacaggcactggaggctacttggcagacgcggcagcaggtacgcaaaaaagtcaacctgatggaaatggtcaacgaggtggataacgagtttgccggtgatgacgcgcaggaagtctgggaactgccgaccgaatatctgttcgatgacggcgtcagcatcaacgaactcgaaggtcgaccaccgatttccgagcctttccattatcccgagtgggactataagattcagctcgaacgcccgaactgggtcaccgtgctcgaacaccatccacccgtgggcgaactcgcaattatcgagaacatcatcatcgaaaataagccagtgatctcacggctgaaattcctgatcgaatcgatggtgccacaaggcatgcagcgcatcaggcacgtcgaggacggcgacgatctcgatatcaacgccgcagtgcgcgcgatgatcgacatccgcatgggccaaccaccggacccgcgcatcatgatgcggtacaagcgcacgctgcgcgagcttgcagtgatggtactgctggatatgtccgaatcgtccaacgataaggtgcgcggacacgactacacgataatggatctcacccgcgcagccacagtgttattcgccgacgcgctcgatcgcatcggcgacccatttgcgatccatggcttttgctccgatggacggcacgacgtgcattatcatcgtttcaaagatttcgaccagccgtatggtgacatcgccaaggctcgcttagccggcatgaagggccatttttctacacgcatgggcgcagcgctgcgtcacgctggatattatctggcgcagcagcccaaatccaagcgggtaatttttgtcatcaccgacggcgaaccggccgacaacgacgtgcacgacccgcaatatctgcgctatgatactaaacatgcagtcgaagaactcgcgcgtaagggcattacggtgtatgcgttatccctcgatccgcatgctgaccaatatgtgtcgcgtatttttggagctaagaacttcaccgtcattgacgaagttgagcgcctgccggagaaattgccgatgctctacatgagcctcacacgttaagggcgccatgcaatgaaaataagcttgcgtaccttcgtatttctcgacgcactgcaaccgcagctcgcatcttatctcgccacctcgtcgcaaggctttctgccggtgtcgggcgacgcctgcatgtggatcgaagttgctcccggcatggcggtccatcacctttcagatatcgcgctgaaaaaaaccaatgtgcgcatgggcgagcaggtggtggagcgcgcgttcggatcgatggaactccattaccgtaatcaaagcgaagtgcttgccgccggagatgcggtcctgcagcaacttggcattacaatggaatcgcggctgcgctgcaaaatcgcctggaacgagatcatccgcgccatcactcctgatcacgctacgctgatcaatcgtcagctgcgcaagggttcgatgctgttaccgggaaagagcatgttcatcctcgaagtagagccagctggatacatcatttatgccgcgaatgaagctgaaaaggctgcgcatgtcacattggtggatgtcaaacccttcggcagcttcggccgactgaccatgatggggtctgaggctgaggccgaggctgcgcagcatgccgcagtagcggcgatagagcaactgaaccagcgcgccgccgcccatccctgagtcggcgcgacgctaccgaaccacctatatagtgtatatgtattatggaaatcgactcaatcgccaagcgtctgctgttttgcacagtgcgcgtggactccgaactcgaagacggcagcgctggctcgggaaccgcgttcattatcacccacagtcatgccaatggcacgacgccgttcatcgttaccaaccggcatctggtcgagggagtgcgccggggtgggctggtgttcacgcaggcgcgtgacggcaaacctgcgttcggcgagcgttttcaactcaacatcgacgactttacagcggcctggtttttccaccccgaccccgaggtcgacctggccatcgtgccgttgcgcccattagagcgcgctgcgcgggagctgggcatagagctgtattaccacgccatcgacagcgccagcattcccgatgccgccgccacacgcggcttcgacgcacttgaggaagtgctattcgtcggctatcctagcggcatgtgggatgtggtcaacctgatgcctattttgcgcagaggtaccactgctacgccgctggaactcaatttcgagggccagaaacaatttttgatcgatgccgcagtgtacccgggatcgagcggcagtccggtatttgtggtgcgcgacgatccgttgcgcccgcgcggagacggcgcacgctcgatttggtttgcaggcgtcgtcgctgcagtgtttttccacgaagaaaccaaccagatcatccccggcccggtgccggcgtacaatacggggcaatcggtagcttccgagatgatcgacttgggcctggtggtcaagtccgagtcagtgcgcgaagtcatcgacgcttttgtgcagcgctggcttagctgattagaactcgtttcaccaatagcagcgtgtgcgaaagatcttattaggatgcagcacaaggtatcgtcgcgccgcacagccgcattactggagcaagtatggaaaagattatctattccggattaaaccggattcgcatggcatcactcagctcgatcccacacaggtcccgatgctgattaatgtaggcgtttctttcttcagttcgtggtcgagcgccgcctgggcgaaaaaagcattggctgtctttagaatatcgttggcacggcgcagctccttgatctcacgctccatggctttgatgcgttcacgttcaccggatgttcaccgtcgcgccacatcactacgcttgacccaatccagcaatgtagatggcacacagccaatcctgggtggaatcgattcaaccgctgcctacagtgaggaatattcctgacgatgctcctgcaccaaccggactgcccgttcttttacttccagggaaagctgattttgtttatccatggctctattctcttaaaggctagagcctcctcaaaacccggagtgattcaggatgataaccagatataccagtatattggtgtagcttgctcatgaaattatggccaagaagataccgttcaatcagaacggatgtgctgacagcttcttatcgtgacgataatcactacttctgggagtttgatgagtttgatttgagcgctctcgattgctgccggatatggcacgccgaagcaggtttgcagacgagtcagtttgatggaatttattaatgaaacagaatgcgaatttgctggcgatgtggcgatgatgccaacgaagtatggatattggattctgaactttttccatatgaagataacggcatttcctataacaccatgtgggtaaggaacggattgcttcgcctcattattattccgagtgggattacaagattcgattggaacgacctgaatggtcaacgattcaggaaaaacgtccaaagccaggagatattcaggttattgacgacattgctactcagtataaaaaggaaattcatcgcatgaaattcttgcttgatgcgatgcagcctcaaggtgtataacgtatttgcaagctggaggatggggatgaaattgatattaatgcagcgatttcttcgttcactgatatacgtatacgtatggggcagcatccagatccgcgcgtcatgatgcgtgccgtgcgtaaagtgcatgatatatcagtattagtattgctagatttgtcggaatccactaacaacaaggtgaatggtcatgaatattccgtactggatttgactagacaggcaactgtgctattggcaggtgccattaaccgggtgggggatcctttcgcaatccatggtttttgttcggatggccgacatgatgttcagtattaccgtttcaaggattttgatcagccatacgattaaattcccaagatgcggattgccccgcatgactggccagctatctacccgtatgggagcggctatacgccacgcgagccatttcttgaaaatgcagcactctgccatgaagttactgttcgttattactgatggtgaactggcggacgtcgatgtgcgtgaccagcaatatctgcggttcgataccaaaaaggcagtagaggaagcagggcgttctgggatattaaccttttgcaagagccttgattcgcatgctgatcaatatgtatccagaatatttgggatgcgcaactatatggtggtggatcatgttatgcggttgccggagagactgcctatgttgtatgcgggattgactcgttaatctgactgaggatagtttatgagagagaaaggttactcgggagtggatcaggatgcagctggaggactgactcccttggggcgtatcgtaattgatgcgtgggtttttggtatattgcccgagagtgagacctgtacgggatggaatatgtctcggatgcagattctttatgaagaagtttacgctgcatgggagccttactcacatcttcccagcctcttgccgccagaattgcagcagcgacattctgttttatatgaacagagaatagctattgcaaggaatagcggatgggatacggatcttagtgatgaatcttgatcgggttattgggtatgttctgcggaagggggtattggggtttttctgaaaccgagcccttttactcgtgatgtttgctagaaatattccaggaatacactgtttttttatctctttgcatctatcaagtattgattttgaacagataccgtgagtgttgtgtaacctttatcgtttggaaacgattcagtaaatggccaaattgtgcaattttttgttcgatttgggcgactgaaatttcagggaaacgatggttgtgataagaaagccgatttggtcccgggcggcgcatatataactgggttaatgttgttttcagattggcaagcgcccaacccaccatgtattttgcaatagagcttgctgctggctgagatcgagcatagccactgtcctccagtacatccacgatacgctcgcatgccaggcgatcttgttgtgctgtcaaataataatcaataagtttcttgcgttcttctccatctgcaacacctaattcaccacgcaaaatccgggataaggtctcttcaagttcgtcgaagttaaacgactgataactaagtttggtaggcaatccctggaaatcatagtcgtagtattcattgaaagcagccagataagaaatggcaggtatacctagggcataagcttctagtccggttgtacagccattgtgtatcattgttttcgaagccagaagccaggggatgacattaccttcatttgcaacctttacccggcgacattgggcagcaatattgtgataaacctgtaaattttcacttgggtgagggcggacaacaatagttacatcaggaaaagcgcgctccaatgctgggataagctgcttgaaactctccagtatggctttcttgtggtgccacaacccttcggcaaattcgtcacttaagccgatcccaccctgtccgcgccgggatgttttttctccatttttacccgaaatgaacattccgatgctggggataaaaggattaacactggaaaaattggtattgatcaggataaagttgccataagtttcacgtaagtgctctacctctgctgaaaaataggcgcgtatttctggtcgcaagatgtcgcctcgcggattccctgttatgtgaatgggtaaattttccggaagttgcggatattgtttgatgagatcagaattctcctgaccccaggcaaagaaatgagaaacatttttcatcgtaacgggagataaccgtagcgagaaataggtatctgccggaggatgaaccagtgcttcctcttcccaagcaacaatttcgtggccaagcatgcgaaggatccggaacatggaattactcaacctgcgcatactttttgcaagatatatgccgcgtggtagcgaagcaacttcaaaatgaatgtaggcacgagaaccgataacaaccgggaatccgcgttcggcagccacgcaagataacaggagttttgcatccagttcacgaacctggttctcaacaggtatgatcagtgtcgacgcggtagtagccatgttccgaagtttctattaaaaaactattatttaataatcatacattagtcgcgcgcctaatgttttatgtcatctgccttttgttcaagcacatgccagggatgatgcagcaaccgctgcggcacatagtaaaatacgcaactgacaagttgtagttttatatgcttgacggcatgaatatatatttcaggaatactttctcactgtaaatattccctgcttttatcactaagcgttatctgtagaaactttgggtcggaacttgattatttttgccgggttgtgaggggtttgttttgccatcattgcatacaaagcaagtggaaattctctttgcaggcggcgcataaccgctgtttgatcttcctgataataaacttcttcatattcaatgggttgatcaagtgattcacgttcatgtgaatggaaattttgccaagcaatatctacccagcatttgcgctggccatcaataaatacaaattcttcacgatcaataatagctaaatattgcatacttcggataggtatgaatagattttttgctccgcagcgagcaaataactggatagccaggttataggtagctgctggtaacgtccttttttcccgcttgatttcaggatcgcgataacaagtgatttccatattccaatatcctcaattaaatagttaatcgtcacctaattaatttagggatggtgacaattcttcagcggatatcgtggaattcctaaatatgccgggcaaaaatccgcgtttactttttgggttttaaccccttatctgtttgttttgcagaagataatcaggtgggagattcttctactaaaaccttaatagtcaatgcctttaacaattatcagatcttcaaaaaattgtatcgcgatttcagattgttttggcagagacttgttttggaaggaatcatttaaacgcaagcgccaaaccttatattgtgcaaatcacgtatgaaagatttggcgtgctgtggcgttgacgacatttttgctgctttcacgacttgcaaggcatatttgatttactcaggaacctgataacgatactgtggatcatgtcaacattgcgtctggtagtaaactgtgattttcgggtcgagttgcaagcttatttggtcggggtgagaggatttgaacctccggctcctgcgtcccgaacgcagtactctaccaggctgagctacaccccgaatgaaatagtttatcgaaaacagcactagcaaggaaatatttaggatttccaatgataattgctgaagctggcaattctggtaaaaattagtaatttctcgaaacagcgaactccgccaattctagcaaacattgtttatagatagaatcacggagcgtagaaattacggaagtggccatgttggcttctttctgcgcgcattgctttgcgtaatccagcgcaccagttttctggatgatttcgagtactggtccaaacccgtcttttccaccagattcaatagcatgacggaccgtatttgcttggtcggtcgtgccagcccgcatggcgaagatcagtggcagagtcggctttccttctgccagatcgtcacccagatttttaccagtgtcatgatcattacccgaataatccagcaaatcatccaccagctggaatgctgtgcccagatgcatgccataagcagccagtgcttcttcttcagccggagtggctccgcccagtatcgctcccagccggccagcagcttcaaaaagcttggcggttttgaaacggataacctgcaggtaattttcctcttcaacgtctgggtcacggcaattaagtaattgcagtacctcaccctcggcaatggtgttggttgcgtcggccagcacctccataactcgcatgttatcgacttccaccatcatctggaaagcacgcgagtacagaaaatcacccaccaacacactggcagcgttgccaaataaagcattggctgtagcctgattgcggcgcagttgggattcatccactacgtcatcgtgtaatagtgttgcggtatggataaattcgacaacagcagcgagattatagtgatgcgtacccttgtaatcgtataaccctgcggcaaggatgactaatgctggccgtaacctttttccgccgctatggatgatgtattcgctgacctgtcgaacaagaacaacttgagaatgaagcttttgctggataacgttatccacctcgcccatatctttggcgataacgtttctgattgactcgattgacacaatgactccctgaagaaaccgctatggtagaaatgtccctgcccgggtgtcaaggattcctgcaggcaaaacagccgagatacatattgtgcggcgtatcgccatggaacttccattgattggggcggtataacttccgttataattagccaattttgaattggcgtcatcaggatatttttcatgcaactttttgcctttggtgttaaccatcatactgcacctttagatatacgcgaacatgtggcttttacggaagagtcgatgcaacatgcgcttcatgatctggtgggtcaccagctggttaaagaagcggctataatctcaacgtgcaatcgtactgaaatatactgcaatactgatacacccgataaagctgtcgggtggctagctgattttcatcatctccattctggagatcttgagccctacctttacaaattgttgcgggagcaggctgtaaagcatgcatttcgcgttgccagcggactggattccatggtgttgggtgaagcacagatactggggcagatgaagaacgcagtgaaatcagctgaacaagcgggaacgctgggattgttattacataaaatgtttcagcatacattttttgtagcgaaggaagtgcgtacctctacagaaataggcgcctgttcagtttcaatggctgctgctgctgcacgtcttgccgaaagaatttttggcaatattagtgaacaaaaagtgctatttatcggtgccggcgaaatgattgagttgtgcgctgctcatttcgttgccaaacgccccgtgcatgtaacggttgcaaatcgcactgtagagcgagcggaagcgctgtcgcgacgttttaatgcgcaccccatctctttgggtgaattgccggatcaactggcattgcatgatattgttgtcacctcgacggcaagcccgctgccgatacttggcaaaggaatgctggaacgagccatcaagttgcgcaagcatcgcccgattttcattgttgatctggctgtgccacgagatgttgagccggaagtagctgagctggatgatgtatttctatattatgtggatgatttggctgatattgtcagggaaggactggatagtcgtcagggggcagtgactcaggcagaaacaattattgattcaaatgttatggactttatgcattgggtcgccacacggcggtctgttccaactattcgcgcactgcgcgaccaggccgagcaatttcgtcagcatgagctgagccgcgcccataaattactggcgaagggggaagatcctgtaaaagtgctggaatcacttagtagtggattgaccaataaatttctccattctccttcttccgctctcaaccaggtatccaatgatgagcgtgagcaacttgttgagcttgtcaatcggttgtatcagttgcgttatccacgatgaataagggaattgtggatcagcttacccggctgagtatacgactggaggaattggacaagctgttgagcaatgaaaagatcacggctgatctggataattatcggaaactttctcgtgaacgatctgaaattgagccggtaaccaggttttatcatacttaccagcaggttgagcaagatttggctaccgctatggaaatgagtgtggatccgcaattccgggattttgctgaagccgagattgatgcagataagcagaagctggcggatattgaaaccgagatactcaagcagctgttgcccagggatccgaatgatgagcgcaacattttcctggaaatacgggccggtacgggaggggatgaatctgctctgtttgcaggtgacttgtttcgcatgtatagccgctatgcggagcgtgagggatggcaagtagaaattgtttcccagaattcttctgaagtgggcggatacaaggagattattgcccggattattggccacggtgcctattctagacttaaatttgaatcgggtgcgcatcgggtgcagcgtgttccggcgactgaaacacaggggcgtgtgcatacttcaacctgtactgttgctgtgctcccggaagcagatgaaatttctggcgtaactctgaatccggctgatttaagaatcgatacattccgcgcttccggcgcgggcgggcagcatattaataaaacggattcggctgtacggattacccatttgccgacaggaattgtggctgagtgtcaggaagggcgttcccagcataagaataaggcacaggcaatgagtgtgttgatttcccgtattctcgacaagcaggtgcgtgcgcaacaggctgaacaggcagctgccaggaaatcgctggttggcagcggtgaacgttcagagcggatccggacctataattttccacaagggagaattactgatcacagaattaacctgacactctataaaatagagcagattatggacggtgagttagatgaattatgctctgctttggcagccgaacatcaggccgcacagctggctgccatgatcgaaagatgataggaaatatgctttcctcggaacagcagcaaggtataaacacgcccgctacaattagtgaactcttgcagaatgcagcaagtgttgtagatcgggttgatgcgcgttggctattgcaaagtgtactgaacgtggatgcggcttttctgattacacatgcagaattgttactcggtatggagcagattgtacatttccagcaattgcttgcgaggcgcatggcgggggaacctgttgcatatctgacgggtgaaagagggttttacgatctggtttttgacgtgacgccagatgttttgattcctcgccccgaaacggaactactggtggaaatggcattgtctaaaattccgtcagatcggtgctgtaacattcttgatttgggaaccggaagcggtgctattgccattacaatcgccagacatcgtcctgatgtttatgtgacagcagttgatctttctcctctggcactggcagtggcgcgcagaaatgctaaaagatgttccgtagaaaatgtggtatttattgaagcagactggttttcgggttttatcagtgaaaagtttgatgtgattgtggctaatccgccttatgtagttgagggagatccgcatcttgaagccgatggcctgcgttttgaaccctctatcgcactggtggctcagaataacggtctggattgtattcgtagaatagttgctcaggctccggattatctggaacacttcggatggttaatgcttgaacatggatacgaccaggctgatgtctgccgcagtttgctggataaaaccggttttttccatatattcaccagatcagatcttgctgggatagatagggtaacggggggacagtatggattggttccggcatagaagtttatatcaccatctggaaattattctggatataaagattcaaatagaatgagtagtattaaccaaggttttgtataaatttgttccagttgaagtgtttgctgttcaggaaacaagtagctgctttataaatttaaagaggaaattaaatatggatatcgctgattctattgagcaacaggtatcaacgcacccggtggttttatatatgaaaggtactccacagcagccacagtgcggtttttccgctaatgctgtacaaatattgagtgcttgtggcgttgaggattttttcgctgtaaatgtattggctgatccggaaatacgacagggtatcaaggattattccagctggcccaccatccctcaactgtatgtcaacggggagtttgttggtggatcggatatcatggctgagatgtttcagaatggtgaactgaaaaaattgctggaaaagtaaattcgattgcttgtgaatttctaactgattgctgcagcgattacccagtagcgtgcaaattttccgatagcaataaaaaatgctgcggaggcccagttgatccgcagccatccggcagccacacataatatgtcgccgatgagtggcaaccaggacaggaatagtatgggtgctccgcggcgacgtgtccactccagcccatgaacatggcggccaagcttttttgacaaagcctgttcatcgggcagaaaacgaccaatcacgtaagaactcagtcctcctaatgtatttcccagcgtggcaacattcagcgctggccagaacagatccgggtaggcgatcaataccccgacaagcacagcctcggatcctccgggtaataatgttgcggcaagaaaactgctggtaaaaagtgctaacaagctggcgctttcatccatatagacagtagtgtggtttcttggtaacagatggttgatctgaaggcattacagtaaatatctgcaagctacatacttactattgcatcagtttaccatcgcggttgccgttattcttcactggtgacaaatactgatgctgttaaaaacgtccttcagtgcggggaaagataagaatgctttagatgtcgtcattaagttaagtggcagttaatttattatgttcttagctgctcttccatgccacgtattctagttgcataattgtatatacttgataataagagttgagggactgcaagccgatgatgccggccaggggaaaatgaaaaattttgatttgatgagatataaatatttgctgataagacattctcccgtgagtaataatgaacaggatgcacacttttacccttgaaattgcagcggcttcaataacggagttgatctatgctgatctatgatgctcacagccctgcgccacgctgtctgcgaatgtttttgttggaaaagcgattacagttaccggcagtaacaattgatgtcatgacaggagaaaatcgtcagtcaacgtatctggctattaatccgacgggccagaccccggctttgcgtttggatgacggcagtatacttacggaggctgttgctattgcagaataccttgaagagcgctacccctcacccagtttggtcggaagctcacccgagcagcgtgcacaaacccgtcaatggtggcggcgagtagagcttaatatcactgaattcatacacaatgcctaccattatgctgaaggattggctcggtttgaatcgcgcattccagtcgtgcctgaagcagctgatggaatgaagcgcgtggcgcaggatcgtttgaactggttggatggtatgttcggaacaggtccatatctatgtggtgaacgctttactgcggctgatatctggctgtatgtgtggctggactttggtcagtcggtcaaccagccgtttgatcgcaacctgccgaatataaacccttggttcgaacgtatcgcggcgcggcccagtgctgagcttagtaaggcattattgaagacatagagcagcgcctctatgtgctgtatttttcaggtttaggggatgcagtgcaggaaatgtgaaacctgacctgaatgggtagctggtcaagtgcaagcaaaatgtcgcggcatattgtaactgcaaaactggttggagtttcggcccgtattacatttgatttatttttgtaatgtaatacaaaccgaactgggttactcgttgtttctcccggagcagtgagtaaaagtgtgtagtaatgtgtgtttgttttttattaaggagacgagtggtatggataagaaaagaatggtatcaatgctggcattggtaggtgcttgtgcaggtttgtccgcttgtgcgacgacgggtgatgttgatgcactcagatcccgtgtggatgcactggaatccaatgtgtctgcagtacagtcagatgcagcggctgccagggcaactgctaacgatgcagtaaatattgcgaatcaggcaatggataaggctaacgaagccaatgcacgctcgattgatactgagacaaaaattgatcgcatgtttaaacgtgcaatgcacaaataaagtaattgttttgtaattacctcggggcttgcttgttcatttgtgatattggctcttacgcttatccatgtgaaacaaagtaaggcccgaggtgattctggtgtctgtttcggttagcagattcttgaaaagattacagtattgctgacgcttgtaagaattcaggagtacttcagaattatctatagctggcagtgataccactcgtgtcaagggtatctatctcacattgtattcgcccaaaatattcggaagcagtttgtggctacttgaaaaatgaatattcaatattaacaatatgctttaccacagaaaggtcaggaaatgagtgggcgggaacaatacgagatgcacaaagactatatccgatcaaatgggctggataaggttataaattttcaagaaaacatcgattacaaagatagcgcgtttgatgctgtctctgggaaattaaaaattccattcccgccaaaaactgatgatttagttcgcttgcacaagttaatcaggcatagaaggccctttacagtccttgaatttgggcttggatattcgactgtaatcatggcggatgctttggagaaaaatcagaaagaatgggaaaatctgcataagaaacctgatatacggaacagatttatgtttcagttatttgtggtggatgcttccagtgaatggattcaaaatgtaaaagaccggtttccagcgcatttgctttcacgtgtgcatttccagcatagcaatgttgaaataggtacatttaatggccagctctgtcattattataagaatctgcctgacgttatcgctgaatttatttaccttgatgggccatcccccaaagatgtacaaggaagtattaatggcttgagcttcaattgcgacgaacgaacagtgatgtctggtgacctgctgctaatggaatcaacttttcttcccggtacattcattcttgttgatgggagaatcaataacgcacggtttctccagagaaattttacaagaaactatgatgtgaagtatgacaaagagggggatatcactacgtttgaattattggaagaaaggctgggcagatacaacttattaggatcggattttttttaatagcccgccggatccgatggtggcctgatatattcactttttaacctgtcccagcagcgtgcaaaggactcaaaaatagcaggattgctggaaatggcagcaatctcatgattcaaccagaacgatggcttggtccagttaaagctcccgaagattgaccaggcacaattaccatcctcaactagtacaaatttgaggtgcatgggcagggagtcggaatgccggatgcgtttaaaacggactccggcgctggttaattgctgctccacctgtggagtgacgcgcctgagcgtcgattctgccaatatttccaggtcaacgccctgccttgccagcttggtcataatatcaactgcgcgacccatccttatatgcgaagccgcaacccgaacacggccgctgttaacattatgcaggaatcgcacgataggatgagtatcgacccggggccagaaataaatatcggtgtctgcgccgtggatactactgcttatgctcttggtaaaacgatagaaaagccctggtggtgactggtgtagctgtcgtgcatgctcggtcagtttctcgaccagtgttggatccctaaatccaactaaaacgttataaccatgatcctgatcaccgatttctagaatgatattgggatcgtcttccgaaccgtttccggacggattgaatgaaccgataaaggcaaccggttcagggtgtgaaaaacagtatagtttctcatgcagctggggtttccatggttttgtcgcaggcgatggcaacccggggatggtaataacgcgtagtgcattgcctattccatctggccctgagagcagggtaattacttcgtcgttagcatagggaatacgcggcctgccttccaggcttagcgtgacacggacaccacgttgatgcgcccgaatgagtgctttcgccagacagatatcacggaaataatacgtcacccaatcaatggttcccccagcagggacggcagcaattcgggcttccagcaaattgcgcagctggccgacaggctggtttgggccaccaaaatggacttcaggagaagaaattgctctggcttgtggtgccagagctttgttcaatgaaatccacataacgctttaatctgaccccatactgagcgggattccttttgtttatctgtttcgccagcttcttctgttttcatccgcctggcctgctcttccagcagagcgacgtaacgcggcaaaacatcggcgtccccaacgtgcagcatttcattaatgaagcgctggcgatgtgcctcgatataaaaattgtcacagccagtggttaagaatctatcaatcagtttgtatacatcatcgcggcatttcagttccgtttcgggcatgaaatgcgcgagcgcagatcggccggcatgcaaataatcagcagccagtacgggttttttggctttgaccgcttcaaataccactgaagtggccaggtcgataatgacatttgcccaattcatcaaggaaatggaatgaacactgtcttccgctatgctgacgtttggaaggtggcgcagggaggtgctaccagtcagtggttgtctccagccgccgcgtgtgtgcggtttgattaccagttctaccccggggaatgcggcaatcatattcacaatgatattaacctcttcccagaatgtggtgaattcacgctttctcaagaacatgacgattctaagccgggtatctgagttggtacttagctggtggggaggtgacagcttggccagtttattcagccattcgtcacaatagcgcggtgaacccagcacggcgattgcctgattgttcagaaatggccggaaacggattgcacataactcattcggaaccacgagtttgtcaaatatttttgcatccgcatacagggtattcggttttatagctcgttcatgatagcgtatcagctggttggcatgagggctgtcgccatgtggtagagataccgcaccgaagccctttgttttcgccattgtaacaatggtttcgatccactcgatggggatgggcgagacgctagtgacccaatcaaacacaatcacaccttcatcggtatcagtaaaagtgcgtttcaatagctgtttagccgtactttgccagatcggatcgcgctttcgggcatcatatttcctggccagcacttctgcgagtttaccaatcaggaaaatacgtcttacgcctctgatcagcaagaatgtctgtagacgccattgcaaaaactccaacggggagagtagttcccggatatgcgccacgcgaacatggtcgaggctgcctaaatatttaatgcggtaatcattcaggaatttttcatgtcccagcagaaccacatctccatgatgacctgattcagaccattttgaaacaactggagtaatatgatctatatcgttgtagtgacgaagaaaaaatagagctttcataatgaattattgctgaacgctggcgggcgtaagcaagtaaaatttcgtcattggtaaatttataatcagagcagagactgatgtttagtcccactttgtgtggtggtatggattaatggttacctcgaaaaatcctgtttttgaaaatacattgttcgtaaaatcaatgtgttatatgcaaatcttttcggaatttataggtttttcgaggtgccctaatgataaattgctctgattcattttgccagcatttaatgatgtgttcataagatgtgaatccttgcaggactaaatagctacgtttggcgatttgtattgtcacaaatacttccaggatttcgcacactcacctgggtggaaggtttacccacatagacgctatcgcacagcaaactttgcacctgctgctgcagcccctgtttgcaacgacgcagcgccagcaaagcccccggcctatcaactcagccgtactatgcgtctgggacaggtcttcttgcgcgcactctccggcaacgacttgctaattgcaaatcgttcacgaccgatgtcgctcggataactttttctcatgccctatgctcctcacatttccagagactttcaacggtttcttagccgttgaggtttacctggattgatattcagcgtttgcggcgacgagagggtgatgatggctgtttagaaaaactgtccagaaaatcatccagcatctgcaactcatcaaactcgtcgggctcgttatccacctgataatgcttgataaaagcagcaagctgtttgccatcctgaaacgcaaccagatcaatatcaacctgccgcaaattcatctccaaacgtgcaacttcagcatctaccgctttatcaacacgatccggcttaagttttggggtcaacggtaccagcgcccgatagggagccaataacgatgccagttccgccttgagcttcgcctgttgttcacgtaacacctggatataatggtcaatctgttcaaccggcaagttggtaagatagtcggtatcaatttgttcaatttcaagttggatattcaatagttcaagcaaatcgcctttatcataagcttgattgacgcgctgcatcaggacggttttctcatctgctgtcagattggcgcttgtgcgatcaggatgcaggctgctggccagtttacgatagacttcacgcactgactggatgatctctttttttgccgcagcacgcttctcttcggcggctgtctgtttggctgattttcgccggtgcgagctttgtttagcttcacttctggtttcttcctcctgctgtttgcgcatggcttttgcaagcatttcttccatgctgccatccgtatcgtcatcatccaggtgcacaccaaacagattttcaactatattttgcgagaatgccttatcaagctcagtctgttcatcataagtgagatcactgtatctatcgtacagtgccacaatgtcttcatcgcgttgttcgagcaataattcatgcgccagatcaagcatgatgtcgcgcaacttggcacgctgctgtctgccgcgaactacatcacgctgatgaaattgcgtatcaaacagatgtaacatggcaatacgtttttcacgcaactgtgcaagcaggggcatcaattcactacctatgcgctgattgtaacgcccgccgtaaatgtgccactctgcaacccgggtacgttgctcgtcaatttgctggatcaatcgctggaaaacggcttgctgtttagtttgcggttttgtgtgcaccacaacatcggtaacagtgagttcgttgctattgacaggatcgagtaatgattcctgacgagggatacagggcatagtaaaaattccggaatatggaagtcaaaaaattcattcaacgctatttccaacaaaatttccagtttttttcagcattagcaaggtgatgaaaagcattggtgacgttgcgaatacctcggcatgaagcaatccagtagttaagaggatgaaggcactggattgcttcgcaccaatgtgctcgcaaagatggtgttttttgtgctcttctccaaatacaagtgccaccatactccaccctgtgtttgcaaggtggctgcaggctgacgtgacaatccagcactattatctctgcactgcaagattattgcctcgcactgctacgttagtaaaaacaggataaagcaaataatatcgccacacaccattcaaaaggagttgttttttgtacgttcaagtgcgctgcggatgctattcagtgcctgcctgatccggtggcggggagctccaatattcatgcgcatgaagccgctgccttccctgccataggaaataccagcgtttagcccgattccagcttcaaatatgaaaaagtgcttgagttcatcatcagtcatacccagctcgcgacaatcaagccacaacaggtaggttccctgtgaaggaatcagccggatttgtggcaaatactcagccagatagtgctgaaccatctcacgcgaagattccagataggccatcagtgcatccagccattcaccgcctgcacgataagctgcttcaaacgccactatgctgaacggattggcggcactgatatgcattatctccagttgatcgcgaatggctgcccggtgttgcggatcaggaataatcagtgcagacaaattgagccccggaatattgaacgttttactaggtgctaccgcagtgataattgcttccgatgaatctgccaggtcagccaatatgtgatgcttgttacccggataaatcagatctgcatggatttcatccgagataacaatcaggttatattgcctggtaatgtccagcagcttttccagttccgatctgctccacacccggccaaccggattatgcggggagcaaaataacagcatgcgcgcagaagccgcctgccgggccagatcagcaaaatccatgccgtagcccccctgtgcctgttgcaaggcattgttcagcagctttctgccagttcttttgactaccgagaaaaacgggtaatacaccggcggctgaacaatgacagcttcacccggtttactcaacgcaagaacagatgcactcagcgagggtactacacccggacagaaaacgatccattcgcgtgctatctgccagccatgacgtaatttcagccaatagattagtgattcatacagactgtcaggaaattgtgtgtagccataaacagggtgagtggcgcgcttgaccagcgcttcggtgacggcaggcggagcggcaaaatccatatcggccacccacagcggtatgacatccgggcgattgaacgttatctcacggccatcatatttggtgctgaatgtcccgtcccggccgatttcacgatcaaaatcgtaactcaagtgagtttctcccagagagtcacttctgacaacgtatgttgaaatttacgtcgtgtttcacgaatgacaaatggtacctgttgtggttctccaagcaaacggaaatggctgccgagcatttctttcagtccatccagcgtggtgaaattttcaccatcgcgcttgaaaccgcccacccagtgctcccgtttggtgtgttcctccagccaggtataaggtgaggccagcaacaacaacccgccctgattcagccgttcatgcaccatggtcaggaatttggcaggttcatacaaacgatcaattaggttggctgccataatcagatcatagccagtcaatatcggcttgagattacaggcatccccctggaagaactcaaccttgtgcctgagctctttcaggccgagcccggcaagggtgcattcccggtaagaaaccagctccccttcatctgtcagggtataacgcaggatgccacgccccgccagcatcacaccctgattaataaagcgtgcagaaaaatcaacgccggtgacatgatcaaaatggtgcgccagctcgaatgttgctcggccggaagcacaccccagatcaagcgccttatgcgcggggcgatttcccattgcagcaatggccagttttgccaatgccgtcgggaaattgggcacatcaaaataagtattgccatagtgaaattctgcatactccgacagcagcttgtccgtttcgtaatgtgagctgtggtgcacagcagatgcagcagaaatcacatagcgaaagccggcatgctgaaaaaaatgtctgcggaacgcatagcgtgatgtgcgaatggattcatttccgcatgcaatccatgacccccccttgatgagattatgctgatcatcaaaagtgggtgtggtgaaatcatcgtacagtgggtggacttcaaagccgggaaatggatgcataggcgtttctgtccattgccagacattgccgatcacatcaaaaaattcaccgtgctggaatttatccaccgggcagctggaggcatggtaatcaagatggatattgccttgtgctcgttcagtacggggtacttcgctcaatccagcaacatcatataaacgataccattcatcttcagtgggtaaacgcaccggctgcccagttgttttcgctttccagttacagaatgccttggcttcatggtaattgacctctaccggccagttccacggcatcggtacctcttccgtcatcaggcgcaataaccattgatccccctgctgcacccagaacgttggatgaatcgcagcgctaaattttcgccatgccagcccttcctcttcccagtgatcatctgttttgtagccttgtgcttcgataaaaccgagaaattcctggttgctgaccagatagcggctagcctggaaatcaggcagctccgcctcatgatggccatattcattatcccacccataaacaagatcggttttgttcttgcccagcaccactttcccggccggaaccgtaaccatcccgttttctggcgcactgccgctctcgtggcaaggctgccaggcagaatgaggctgcacataatcaagtttgtgctggcggatcagtacagaagacgtttccaggtgaatacgctcatgctccacccccatcacaatcgcccaccacgggctttcccatgtaattggtagtgttagtgataatgagctgatgagggcatctatcttctgacgcatggtgcggcgataggtcatcacctcctcaacagttggccagtcataatgcgtggcatccagatcatcccagctcatctcatctacacccacggcaaagatggactccagccttgggttgatacgctccgtcagtacgccagccaaaaccagcttgttaataaagaaagtggcggtatggcccagataaaaaatcagaggatggcgcagagaaattggtttgatgtaataggctgcatcactacgcagagtttcgaacaactgctcataccgatccagcgtcgtatgaaaataggcgcgcacttcttcgcgcttggcttcgacatcatcaccgtccagcacgggtgttctttgaaacaattcaggtttaacaggcataagctattcaggacaatgctccatccttctttagaaatagcagattataacgccacttgtataatgatcgtcgtgaagaacaggatcaggcagcaacaactactccccgtgcggtaatgaagtaataaagtcgagaccagtaagaatggaatgaaaataccggggtagaaaccaaaccaagtaaacatgaaattagaagttgttatcgccggcatttttccggccatgaaaaagtttgttccacaatccagcgcctgggaatgaccgcaaaagtgtgcggctcacttctcctggcgtcaatgcagtaatagcgcctgtgcggccggtaacgttcgcgcttgtcacagcaatggcgtgaggcaatcccaaggtgtcagcagcatatgtcgtttgattctagacactttcttacctgcatctcagttcttttccccggcggtatccgtgttttttacactctgggcatcaacaatcacatgcttgggcatgccttgcggccagcttggatacaggcctctgatacctgattttttaatgcgcgctctaacgcactcatgccatcgacatcagggtttttccatttggagaaaaacgcgtaaaccgtttctcatttcaggtggtcactggatgtccgtctgcagtctcctcgcaaagatgagggagtgggataagaaggtgtggcggaagggtattgggtgagcgcacaaaaaaagcgccggttgtccggcgcttgagttttatttttattaatagttgtttatttttgtaactgttcaagcctgtttacgacggcgattcaggccaagccctaaaagtccgacactaaacagcagcaggctgacgggttcgggtatctcactaccaccgccaccattttgcagatcacgaaccaggatgtcgaaattggaaaggcctggaaattgattaccattatttacaaagttgatctggaaggtgccagcgttagtggcattaattgttctgtcatcaaagaagtaaaaagcatcgttattcccaccgtgcatgtgaatcagaaaatccatcgtaaacggaatagacggcgcggtattcaggtcattatccgtgaccgtcagttcccatgtggcgggggtgggttgaccattctggccgttatctgcggaaagcatgaaggttaaacctccataaacagcagatacggaattagtggtgcctgtgttatctcttaccagaaaatcccatgaactcccaaagttccagcccacattggaggcatttgcgaaatttttaatcgtatcggggttctggtcactaagaccaaccgggccaaagaaaccatttgatgcaacgctattaaatgttacatccgcgttggataaagctgcattcgcagtaccaacgaccatcgtcagcattgcgcaggcgacgcctgccttaagcgtagctgtcagacgagtcacctgtttcttccgggggggggcgatatgttcgccgtaaaaagttttatccagttttgtcattttaattttccttctgaaatcttattattgattaacgaaattctatttatatattaagcacaaaacatgccatattgctaattgattgaaatataatgaatatttgcaggtgatcctcgtcagcaggatatttatgtaaaattttccgacaaaaaacgccctgcgtgagcagggcgctgaatgctgagaatcaaagataagaaaatgatcagggagtttttacaaagccctggcattgtgaggccctcctggccgtgacaatccggatggttgtggcccaagttgctggattgcttcctgcttttctacgctcgcagtcgcaaagacgacagggtagcgccggattgcctcaacgctgagattgcatcatgacaggctgaaggtgatccagtctccctaatttctgacgctgacggtttggctgacaaattcaccatccacgttaccagcttctacggtaacggtaagtgtgctgccgcgcggtgcactatcccaggtgctccagcgataaagcaatatgttgcctttgttggttgcaatggtgctgccattgacttttagattgatttctctagtgttcatgtcggctttcactttcacgttttcaaagcgaccaactttttgcccatccttaagattaaactggttaatttggggtaaaggcgttttctgtggattgttgtcggaattttttacattgactgtaactggcgaggaagtaccctggttaccggcagcatcaaacgcatacgccgtcagagtataattgccatccgccagcgtggtggtattccaggtaaaacggttgcctggttcggtgtctgctatcgcctgcttgccgttaacgtgcagttctgtacgcgccacgccgatgttgtcggagaaatttacacttacggatacgttaccggagactgtgccgccagtgggagaaatgatgctgatggttggcggtgtggtatctgcagccgtattttttacggtaactttaaccggggcagaggtgccctggttaccggcagcatcaaacgcatacgctaccagggtgtagctgccgtctgccagtgtgctggtatcccaggcgaaggcgaaaggcggctgggtatcttcgatcgcttttctgccgttgacgtacagctcgacacgcaccacgcccttgttgtcggaataattgacatctaccagcacatctcccgacaccgtgccaccagtgggggaggtgatgctgatgactggcgcgatgttatccacgttgaattgtgcataagccatattcaccgcaccggcggcatctacacgcccgtggccgtagtagacatcatggccgggatcaccgagatcgacagcggtggttctgagtatctgatcgacatctgccggagcaagatccggattggcggagaacatcagtgcagcggtggcggcgacaatcggactggagaaggaggtgccggaaacggagccatacccgccgccgcgcgtggtggtgtaaatactcgctcccggtgcagcgacatccactgcagggccgtagctggaccagctggtgcgtgtatcgctactgcctgttgccgaggcaacgatcagcgcatcactgggcgcataactgatatatccgccggaattgcccgcggagacgactactacccctcccttgctgcgcatatagttggcagcggattgtacggtcaagctaccggctgcgccttcatagctgatgttggcaacgcgtgcgccgtgatcagctgcccagcgaatgccatcagccatggcgctgaaataggcgtaagcattgggattggcaatacgtattggcatgatgcgtgcattccaggccaccccgacgctaccaataccgttattggccgctgccgaagctgaaccggccactttggtgccgtggccatgtacatcgctggcatcgtcgttgccattgtaaatattccagccgggaaccatgttggcggccagatcagggtggttactgtccaccccggtatcaagaatggcaatggttacgccatcgccggtagcaatatcccaggcggcaggtgcctggattttgggtagcgcccaactgctgttgaaagcgggatcagaaaccatttgtgcggggccaaccagttgatccagctcaaccgccttgaaacggcgatcttttttgagcttgttcattaccttgatttcatccacgccatcgggcaattcgtaaatatgcgcacttagtctgctgagtttacgtttggatttgacgccatgcggtctgatagccttgtcaaattcctttgcagttaacccggcacgtggaatgaccaacagacgacctttcgcccagcgggagggagaaacaatagtttttttaccgtttgatccagatctggcaatttcccggatatccttgcctggattggcgtagccattgccggaaaaggcgaccagcagaagtagaagaattgaaaagctgaagaaatgatggaatctatctgaaaatggcaaatgaactgatcttgcatttgacatgcgtggctccttgaaaagatgggttgtaacgaagccgacccggcagcacgcatacctgtatggaaaagagaatggatgcgaatttcggcagtcccgctttcctgatgcaatcaggatcggaaactttgcgcccctgccttacgacagattagcctttgtcggttctacatgatgcaagactggataacggcagttccagctttgatctttatgcattattgtgctttgtcagtgttgcactgtgttggatcgcttcgcactactgtgctcgcaaagagcggggtggagtatacccataccaataaatacatgccctgcgaattataattttggtagtttcgtaccaggttgcttgctgttgcccgcaaaatagtgtggaatatgccgcatgaaaaatgaccagaaatacaatatcaaggtgcaagtgcgtaccacttatctgcaggatcaatccgatcccgcgttggagcagtatgtgtttgcttacacgattacgatcaataatatcggcagcgtggcttcgcagctggtaagtcgccactggatcatcaccggtggcgatggggagacacgggaggtgcgcggattgggcgtggtgggagagcagccgctactcaaacctggcgaaagctttgaatacaccagcggcactgcgatttcctcgattgcgggttctatgaaaggttcttatcagatggtggccgaggacggttttcatttttcggtggaaatccctgaattcattctgagtgtgccgcgggtactgcactgatttgcgaacatcatgcccgcagatattatgccttacggtacgctatacctgatcccgactccgttgggggaaggcgatctcagctggatactcccggccggagttcagcaacgagtcagtctgctggagcgattcatcgtcgagcatcccaaaacagcgcgccattttcttaaacaggtaaatccagagcgcgttgtacaaatgctcaaactggaagtgctggatgaacacactcccgccactgagctggaagcactgctggcgccattgcttgttggggaggatattggtctgctgtccgaagcaggctgtccggcgattgctgatcccggcgggatgcttgtccgtctggcacatcgcaggcagattcgggtggtgccgtttgtcggtccttctgcaattttgctggcgctgatggcttccgggctgaacggccagcgtttccgctttcatggttatttgccggtgaccccggaggtgcgcaataaaaagattatccagctggagaaggcatccatcgcggcggatgagactcagatttttatcgaaacaccttaccgcaatcagaaattgctggatgctctggtgcagcaatgccgtgtggaaacggatttatgtgtggccagtagcctaacccaggtagatgaagttatcctgacgcaaatgatcagtgaatggcggccaggcaacaactggccagatctgcacaagaaaccggcggtatttctgctgcatgggcggagataaagaaagctctgaagttgctggatcgcttcggcgtgccgcctcgggtgtttagggaatctctgcacggcaattctcgcctgctttttaagcagattttcttttcatccaccgatccataatgacgacagcggtgagatcacccgtgacgttgatggtcgtgcggcacatatcaaggatgcgatcaacgccgaaaacaataccgatgccggcaggaggtacgccgataccggataaaatggtggccagcacgacaataccaacgccaggggtggcgggagtgccgatcgatgcccccacgatgacgcacatcagcagggccatctcggtaaaactcagatccacgtcgaagatctggcacaggaaaatagcagctatggcctgataaagcccggtgccgtccatgttgatggttgcaccaatggggatgacgaagcggctgatatcttcactgacacccaggttattttctgcagtacggatagataccggcataacagctgccgagctggaggttgaaaaagccagcagctgcacttcacgaatcgctcgcaagtaggtggttggtgaataaccgccaaatacggttgctccaaacagatacaaactgaaaataatggtcaaacccgataatacggaggctatataccagccaatggcactaagggcatcaaaacccaggtgaatcatggcgtcggtcatcaggccaaatacagcgtaaggcgccaatgccatagcccagtcaataatttgcatcgcggcgccttgcccgaacagacatagctcctcaaatggtttcacgagctcgcgtggcatggtcagcgcggcaacaccaaaaaagatggcgctaatcacaattttgagcatgtcaacgtgcaaagctgcttcgacaaaatttgaaggaataaggcgggtaatgcgctgtggaacagtcagttcatccagtattggtgcactggcggtcgatattgcatccgttaccattgcatgggcaccggcactcatcatgtgtcctggctggataaaaagagagagtgacaggccgattgtgactgctacaaaagaagttgctatgaaatagggcacgataaatgctcccatcttctttagttgccggggtgagccgctgctcagaatgcccagcacgatggagcagatgatcagcgggattaccaccattttcagtatttccagaaatacggtaccgggcagagcaatccattctgccgtagtgagcgcggtttcattttccagcaatgcaaagccaccaggggataatgcaagcccagtgatcgtgcctaatcccatacccaataagatccttgcccatagctgctgggcaagcaaagagcgcacagatgtgaatatttgctggtatctgaaaaatgtcacggctagcttgcaaagattggaggttggacgtgactcggattgcgagtggccttgatagtttgtaacgaaaccggtcgccaggttgttagaacctgttcaatagcttactgaagggcgcattacggcgttgaaattgaactcaaaatgctcaacatacttcaagtatgctccgctttcttgtttaattttgccttgcactgcatcccttgattgagaccttgaataggttttacaacattggttgaatgattgcttcgatttgctgttttttaattcgtcccaggtgggtatcgacgatcgtgccgttgcgatcaattgtaacggtaaaaggcaaggcaccttgcgggttgcccatggcttccgtcagtgtaaaggcatcaaattctccgaccagtacggggtagttaatgttgaattccttgctgaatgcggctactttttcggcattatctatggcaattccaacgataaccaaatctttctggttgtatgttgcataggtatcaatcaattctggaatttcatcccgacagggcagacaccaggttgcccagaaattgataacaatgatttttccctgccattgcgacatagcttgagggatgccttccggggtggataacgttgtgttgaagaatgtttctgctgcagttttcttggcgttatccgacagagaggttgtaatacccatttctctggatttgtaggcaacaccagcggccagtgaaagaatggcgacaataatgtagaacgagaacttgttgggcttggacataagggattccgggaaaaagtagatatttacgcggtataacagataccggatcaatttggtatttaccgtactggcgcactcaaggcgcagcgtgtactgctatatgtctgcaaaatagtgcaaatgtgaatggttgctgcctggctgtcagagcagtattgcatccagtacggtaacaaagtcttttttgtcgagatagccaataatcttgatgtcaggaatctcaactccctgtttatcaaaaaacagaattccaggtgggccgaagagtttgaaacgtttgagtagttcggcgtcatccggtgttccttcagttacattgatctgaaccagctcgacattttttagacgtgcctggacctgtggatcggtaaaggtgaagcgttccatttccttgcaggaaatacaccagtcggcataaaagtcgatcatgacgtaacgtccccgtgattgccggatgagttcgtccagttctgcagctgtttttatttgcttgaatggcaggggagcgttcatgccagccggcgattcagcaagctgcgcggaagaggtggatgcagtcaggttgaattttgacaagggttgcaggatatcccggcttccggaaagtacgccgatgagtaatgcaacaccggtcagcaatgcaataacaccgatccccttgagaaatttactgaagccagaagcctgatgaggtagcggatcaagcgcatgtagatagatggctgaaataatcagcaacgctgcccagagcagcatgtggacgacttctgtaattacgggagagatcagccagatggccacagccagcagcaggacaccaaaaaattgctgaatggatttcatccacgcaccagctttaggtaatagtgcaccagcagaaacaccgagcaacagtaggggaacacccattcccaatgccatgacaaacagggcggatccacccagcacgacatcgcgagtctggctgatatagatcaatgcaccagcgagcggagcggcaacacaggggctgacgatcagtgcggacagtgcgcccattccaaacacgccagccagttggccacccttgaaatgattggcttcttctatcaacttgttttgtatgaaagcgggcatttgcagttcgtagaaaccaaacatggagagtgccagtgcagtaaagatcagtgcgaatgttcccagtacccaggcattttgtagtgaggcggataacatggccccggataagcctgcggcagcaccggctgcggcataagtgatcgacatccccagcacataggccaatgccagtatgaagccgtgtgtttttgacatttgctgtcctttgctggcgatgatgccggacagaattggcaacatggggaatatgcagggcgtgaaagcgagtagcacgccaatgccaaaaaagccactcagaatcagccagaaattgccactggcgaacaggcgttctattttataggattctgtttcaaataatggggcagtattgccaggtgattgaaacagttcggcagtagagtcagcattggctgcttgcacattgttgctgatagcgccggcggctgtgttcactatggccttcagggcgggcagcagtagttcattttccttgttgatcggcgcatagcacacaccgattggttcgttacaaccctggtaggtagcagagagggatagctgctccggggcagatgattcgcggcgcagtgtgataacagcttccaatggctggtagtacacttcagtgttgccaaagagctggtcattcttcattttccctgatggcagggtgacttgctcaatgtgaatcccttcactctttgattcaaaagcaatcttgtcacgataaagatagtaatccctggctggtgtcaggcgggcaatcagtgtgtgatcatcccgtacttcgagggacagcttgaaggcctcatccggtggcaacaattcctgctcggtctgatcggtactcatccccaatcgttgcagaatactcatcaaccccccggaccggctttcttcggccatggtgtgcgtactgatcaggcatagtgacagtaaaatcaaaatgaattttatccagcgcattggttatcctggttaaacatctgtttcggttgtttcattagcgacccactgcaagtaagcaggcaacccgttatcgagagggacagcaataacttcagggagttcgtaggggtgctgtgatttgatcgtttgttccacagcttggtatcgttgccgggtagttttgatcagaaccggtatttcactggccgtttcaatttgaccctgccagcgataaattgaagtgcatccctgcaggatattgacacatgctgccagttgctggtcaaccagtatttttgccagcttcctggcgcttacctcgtccggaaagttggtcagaatgagtaaaattcgagatgattcggtcatttcatgtggttctgggtattgttgccccggcataatgatctaagtttctatgatattctattgtagtttaaatgcggtttctcgtggcaatgagcaagatagtgtgagacagtacaatgaagaatctgtttttgttactccaatcccttatgatcatttttccgattggtgttttctttacctacatcattatggatgaaggtgatcagtttacctatgaacattatctgatgacgacactgagttccattcccttttttctggttctgctgattaaatattttatatcaggatttgatgacaacaagtagcgttagcgtttccagatcaggtccgcgtaaaaaccggatgttttggtatgtgttaacaatggccgtactattttgtttccggaaccagccactataagtgaaatgagtagacttacccatcttctgattatttctatcgtttgtgtgtgtatattgccactgccggctcgggctgaaaaaggctatgccagcgatcaggtggaagtgttagtacgaacaggccccagtcataaacatgcaattgtgaaggtgttgaaaagtggtgctgagctagaagtgctggagcgcgaccggaagagcgggtatgccagggtcaggacagctggtggtgctgaaggatgggtgttgacacggcacctgatggccgagccggcagcgagagtgttactcgaagcattaagcaaccagttttcaggcgatgacaatcgcccggataatccgcgtgcgcaggctgatcttatcaggcatgagtatgaaacactgatgcaacgggcaacgatgcttgagaagaataacaatcagctggaggcggagctatccaaaataaagcagttggccgccaatgctgtacagcttgataatcagaatcaggaactacggcagcaaacagatgttttaacggcaaaacttggcaaacttgagcaagaaaaccagacgctgggcaagcaggtcgaacgtgagtggttttacgctggaggattggtgctgtttgccggtttatttttggggctagttattccacgtattcaatggcgcaaacggtcacgctatagtgatttttcttaagggtatctcgtctgaaagccaatcttcagaagtgaccttaatgcaggatcaatgcactcgggtgctgaatacgtattgaaaaatggtttttcttgcgtgatacccagccacgtacctccaacggcttgttcagataagtttccagaggtgggaataaggccagatcctggttggcaatagagatgtcgatatttttgccgatgataaggcggctgaatcggcgattgcgtttgagtgccgtgacctttacccggtagcgctgccaaccaaatggtttttcggttagtttgaccagctgacgtggctggtattgcttcattgaccagatccccagtttctttgcttctgcccgttgttgtgccttgatcagggtattggcatgcagcaggtttggagatatcagtgtgacaacagctagccctttttccaccagagacaggttgatatgttctccatctgcaagatatagatgagcaagcattcttttatagtgatcttgcgtttgccgatcatgttccagataaacactgcgtccttgtagttttccttgcagccatttttttgcttcaatcccgcctggttctgccggatgaaaccggttttcgatctcgggtgcattcacacccagcaatcttacccgtttgttattctcaagcacgacggtatcgccgtcgataactctagtgacccgatatttgctccgtactggctgagcagcaagttgcagaggttttgcagttggggtggggatatcagaatagaggattcgaccatggggattgatagagcgatagatggtgtcagccagccccggttgggcatgcagaaaaatcagaaagattgtaaagagacaaaatttcaggaaagagagtgacgggttgagtggtatccggggggctctggtaaaatgcatgaattggattatgttaggggaatgttcgagttggaatgtctatgcggccagtattggaattaggacgcaaccttggagatgttacgcatgtcactgaaattttggaagttaaaagacaaaaactgatggctaccagtccgttgattgaattcaggaacgttaattttgcctacggcacccggccaattctgaaaggtgtcgatatgagcatatcgcgcggacaggtgattgccatcatgggagggagcgggtcaggaaaaacgacgctattgcggttgattggaggtgaaatcaggcctttggttggatctgtcagcgtagcggggcaggttgtacatgagctaggccggaatgagttattcaagttacgacgtaaaatgggtatgctattccagtttggtgcattatttaccgatttgtcagtgttcgataatgttgcttttcagatgcgtgaacacacgaatttgcctgaatcaatgatccgggatctggtgctgatgaaattgcacgcggtcggtttgcgtggtgcccagcatctgatgccggcacagctttctggcggaatggcgcggcgcgtggcactggcgcgttcgattgcgctggatcctatgctgatgatgttcgacgaaccgtttactggtctggatccaatatcattgagcgtgattggcagtttgattcgccgcttgaccgatacactcggcatgacttccattatggtgacacatgacattcaggagtcgctgcggattgttgattacgtttattttctggccgacggggtgattgctgcgcacggaacgcctgatgaggtacgtgcatcaaaagtgccgttcgtacaccagttcgttcatggtgaaatagatggcccggtgccctttcattaccaggcacaggcttattctcaggatttgggaataggcgttggaagcaatgcctgactggatattatcagcatgaatacagggagtgatcagtttggctagacggatcaggatcgttatcgaatccattgggcataggatggttgatagcatctggcgacttggatgtgcaactcattttatgctgctggtattgctgaaatctgttcctggttttctgcgttttcgtttgattatgcgcgagatctattatgccggagtgatgtcgctgattattattctggtatccgggctatttgtcggcatggtgctgggattgcagggttatgaaacgctgcagaaatttggttccgaatcagcggtgggaacattggtggcgttatctctggtgcgcgaactggggccagtgattgctgcattgctgtttgccagccgggcaggttcagccatgactgccgaaattggactgatgaaagcaaccgagcaactggccgccatgggtatgatggcagtggacccgatcgcgcgcatcgttgcgccgcgattctggggcggagttttttcgatgccgttgctggctgccatgttttctgtgatgggtgtgtttggtggctatctggtgacggtgatttttatcggtgtggacgagggctctttttggtcacagatgcaaagctcggttgatttccgttatgacattgtaaatggtgtcatcaaaagctgtttctttggtgtggtggtgacggccattgccgtgtttgaaggatttgatgcaccgccaacggcagagggggtgtcgggcgcaacgacccgtacagtggttacttccgcgctggcaattttgggtctggattttgttttaactgcatttatgttcagaggggtaagctgatgcaacgtaccatgatggatttttgggtgggcctgttcgtcatggcggggattggtgcattgctgattctggggttaaaagtaggtaaccttacggattttcaggcagataaaagctatgtactggtgggtaatttcgagaatatcggtggtttaaaggtacgtgcacccgtaaaaagtgcgggtgtagtggtgggccgtgtcacagatattcagtttgatgtgcagacctatgatgcggtggtaaccatgaaggtggatacgcgctaccggtttcctaaggatacatttgctagcattttgacctcagggttgttgggggagcagtacatcggattattaccaggcggggatgaagagatgctcgcagatggtgaaaagattatgaaaaccaactcggcgattgtgctggaggagatgatcgggcgcttcttgttcgataaggcttcagagaaaaaaaatttggatccggaaatttgaaacaggcgataaaacatgaaattattatttaataagattatttttctggtgttactggttattgtgctccctgcagcagcacaggactcttcacctgatgcactgattagaaatacagttgatgaagtgatcaccatactcaatcaggatgatggtatcagggcgggcaaccaggataaggtattaaatcttatccgggaaaaaatattgccgcattttaacttcacacgcatgacccagctggcgatgggtaaaaattggtcacttgccggtccggaacaaaagaaatcactggttagggaattccgcacgttactggtgcgaacctattccaactcgctgaccagctatcgtgatgagatcatcaaggtcagcccaaccaatgtcaacccgcaggataccagggcaacagtcaagactcaggtgatccaggggagtggtaaacagccggtgccgatcgactattccatggaaaaaagtagcaatggctggaaggtttacgatgtaactgttgccggtgtcagtctggtgaccaattatcggggcacctttaacagtcagatcagaaacggtggtgtggatggtctgatcacagcacttgtggagaaaaacacatcaatgcagagcaagtaaacaggcatggatacggaaaccggtattcgcgtggagaaagatcgtctttttattcatggtccgataatttacgataatgcggttgaagtcactcgagcaggtgtggcggcaatcaagctggacaatcgggtgatagacctggcagaggttacccaggtggattcttcggctgttagtatgctacttgagtgggtacgtgctactcagatacacggccggaaaattgaatttatcaacctgccgggaaatctggttggccttattgagttatatgacgtagatactttaattccatccggctgtacaggtaaatccgattgatcgggcaggtgttaccgttccttgttttgtttaataaattctgattgtttcccgtgatgagatgaccccagctatcgagatacagcggctaggcaagtgctatggtgcgctggttgcgctggataatgtcgatctggttattcagccaggtgaattcttcgcgttgttgggccccaatggtgcaggtaaaaccacgctgatcagtatcctggctggtttaacccgtgcaagtcatgggactgccagcgttatggggtacgatgtcttgtcaggttatcgtgaagcgcgaaaaaggctgggtgtggttccacaggaactggtatacgatccctttttcaccgtgcgtgagacgctggtgatccagtcaggttatttcggtcttaaacgaaatgatgtctggattgatgaaattttgcatcatcttgatctcacagaaaaagcacatgcgaatgtacgcgccttgtcaggtggcatgaagcggcgtttattgatcgcacaggcattagtacataaacctccggtgattattcttgatgaaccgacagcaggcgtagatgtggatttacgtcaaagtttgtggcaattcatccggcaacttaatcttcaggggcatacgattgttctgaccacgcattatctggaagaggccgaagccttgtgtaatcgtgtggcggtgctcaagcagggaaaaattatcgcacttgatagtatgcataaccttgtgcacagcacgcggggttacacactggagtttcgtttgtcttcggagaaattgccatccggtttgcaggcatggccaggtaaacaggatggctgtctgcacagtctgaaaataaaggacagttcagagattgaaacggcgttgtcaatattacgagaatctggaatacaggtgtttgatattaaactgcttcagcctgaccttgagtcggtattcatgaagcttatggaagctgattcggcaggtagcgcatgaccggtttttataccttgttttacaaggaattattgcgtttctggaaagtcagtttgcagacggtactggcgccaatcttgtccagcttgctttatctactgattttttctcatgtacttgctaatcgggtgcaagtttatgatggtgttacttatgccgtatttctgattcccgggctggtaatgatgacggttttgcaaaactcctttgctaattcatcttccagcctgatccagtcgaaaataacggggaatctagtattcgtcctactgtcacccctgtcttacctggaaatctttctggcctatatcagtgcctcaacattgcgcggactaatggttggcatgggtgtgtatgctgctgcccttctattttatccgttgcccctgcagtcgccactctgggttatattatttgcgttgcttggtagcgctctgctgggagtgctaggcgtcattgccgggattatgtcggataagtttgatcaactggctgcttttcagaatttcattattctaccgctgacttttctttccggtgtgttttattccattcattctctgccacctgtatggcagcttctgtcgcatctgaatccattcttttacatgatcgatggtttccgctatggtttttttggtatctctgatatttcgccttatatcagcatgagcgttgtgctgtgctgtctcatcgtgatttcagggtgggcattatggatgctgaaaagcggctacaaaatacgctcgtaagcgaaatggaacagcttttatatttttatggataaggagtagttgtggttacagcagagtcaatcgaacattcaattaaaactgcgttgccttgtacctggatcaaggtagtaggggatgacggccatcattttagtgctgtgatcgtcagcgagcagtttcaggggaagaatatagtcaaacagcatcaactggtttatcaggcgcttggtgaccggatgcgcgaagaaatccatgcgttatccatgaaaacctacacgcccgaacagtgggaaacagcaaaaaaatcagctgattgattgtatggctgttcctgattacgtcagtccgcccaagacgaataacattgtttcctcaatcatcgaacagcgggctggccgggtattccagtgcttccttcatggctgccagtgatagcacggcttcacgcccatcgataatgcggtgatcataggaaagcgcgaggtagttcatgggccgaatgacgatctgaccattttcaactaccgggcgctctttagtggcatggataccaagaatagcactttgtggcggattgatgatcggcgtggagagcattgatccgaagacaccgccgttggtaatagaaaaggtgcctcccgttagctcttctatggtcagttttccatcctgcgctcgtttagccagatcagcaatctgtctttcaatttcagcaaaggtaagtttgtctgcatcgcgaataatgggcacaaccaggccgcgcgggctggctacggctatgccgatgtcgtaatattcgtgatagatgatgtcgtttccatccaccgatgcgttgatgatggggaattttttaagtgctgcgatagctgccttaatgaagaatgaggtaaacccgagtttgatgccgtgttctttctcaaaactgaccctgtaacgggcacgtaaatccagaatggcctgcatgttgacttcattgaatgtcgtcagaatagctgcggtggattgggactgtaccagccgttctgcaatacgcatgcgtagacgggtcatgggcacacgtttttcttgtcttgtggattgttctgtttgagaggctgatgaggctgtgtcaggctgaatttttctgacaggctgattcgatgaggaatctggttgttggctagtggcagagctttctcgattcttgatgtggtttaatacatcttccttggtaattcgttcaccacggccggtgccatgtatggctgttatttcctcggcagtcagaccattctcgtctgcgactctttttgcagccggcataagcgggcggcctggttgtggtgatacgtcgtcggtcttatcagctgctggctgtttgggatcgtcaacagattcagcctgagcggtttgtgcgggttgctgtggatctgttttcaagccttttgctgcagtgtcgatacgagcgatgatttccccgctggtgacgatagccccatcatttttgacgatttcaaccagaacaccggattgcggggcagggagctccagaaccaccttatctgtttcaatatcaatcagattttcaccgcgttcaatatgttctccctgttttttaagccaattgatcagcgtaccttctgtcactgattctgaaaatacggggactttgacttcgatcagcatgatgatttctccataaccttgtcagattgtgtcgcgaaatgccgcttcaattaattctctttgcctgaatctatccattgcgaaatacccgaccgagggggaagcagatgaaggccggagtgcatatcctagtttttgatctggtcgcatgtggcgcagcaggtagtgctgaatacgatgccaggcaccctggttacctggttcttcctggcaccagaggatttcttgcgtgcgtgcgtagtgattgatttccgcctgaaaatcttcgtgcggaaatgggtaaagctgctccagtcgaatgatggccatattggtgatggcatgttcacgtcgataggcgatcagctcatagtatatttttccgctgcagacgatcagacgctttattttctctgttgcaaatgttcctgtttcagaaataataggctgaaattggtcgtttgccagttcttccagagatgagactgcttccttgtgacgcagcatactttttggggtaatgacgatcagcggtttgcgtatcggccggatcatctgtcgccggagtaaatgaaagatctgtgccggcgtggaagggatacatacctggatattgtattcagcacacagctgcaggaatcgttccaggcgcgcggaggaatgttctggtccctgtccttcataaccatgcggcaaaaataaaaccaggccgcacaggcgtccccacttggcttcacctgaagcgataaactgatcgatcacaacctgagcgccgttggcaaaatctccaaactgcgcttcccagatgacgagttcatccggtcgcgccgtggcataaccatattcaaaacccagcactgcttcttctgagaggattgaatcaatcacaacgaaatcagattgtttaggagtgatatagcgcagaggaatatatatgccatcttcccattgatcctgttcacgattctggtcatgcaggacagcatggcggtgaaaaaatgtaccgcgtccactatcctgtccggaaatacgcaccggataaccttctttcagcaaggcggcataggccaggctttcggccatcccccaatcaagcggcaagctgccttcacccatttttcgccgatcttcaatgactttctcaaccctggggtgtaattggaacgtggctggaatagtggtcaggcgctcagacagatgtttcagatcttcaatagatacaccagtttttaccggttgattccatttcgcgggggataagaaaggcgcccagttggctgtattgggtgatttgtagtcgtagcatatcgtggtgttggggttgcggccttcgtccatggcatcctgataggattgcaccatagcttctgcatcggcttccttgatgacaccctgttggatgagtcggtcagcatagagtttacgaaccccggggtgttgatgaataacacgatacatggagggctgggtaaccatgggctcatcttgctcgttatgacccagttttcggaaacaaaccagatcaatcgcgatgtccttgcggaactgcatgcgaaaatcaagcgctatttcagttgccagtatgactgcatcaggatcatctccgttgacatgcaggaccggcgcatcaatcatcttgacgacatctgtgcaatacagtgtggagcggctgtcacgcgggtctgatgtggtgaaaccaatctggttattgatgacgatgtgaaccgttccacctgtaccgtatcctcgtgtttgtgacaggttcagtgtttccataacaacaccctgcccggcgaaagaagcatcgccgtggatcagcaccggaacgatcagatcaccatttttatcgccaattcggtgttggcgtgcgcgtacagagccttccaccaccgggttgacgatttcgaggtgtgatggattgaacgcaagcgccaggcgcataacaccacccggcgtcatgactgcggaagaaaatccctggtgatatttgacatcgccggaagtcagctcctgcggctgtttgccttcaaattcctgaaacagctcggaaggcattttccccagcgtattgaccagtacactcaagcgtccgcgatgagccattcccatgacaatttcctgtacacctgctgttcccgcatgttgcagcagtttatccagcattgggatgagactttcattaccttccccggaaaagcgtttctggccaacgtaacgagtgtgcagatattgctccaggccttcagcagcggtcagccgctcaagaatatggcgtttgtactctggggtgaaattgggctgggagcagacggattcgagtcggttttgtagccaacgtttctgtttcacatccgtgatgtacatgtattctgcaccaatgctgccgcaataggtttgttgcaatctatgcaaaatttcctgcaaggtggcatgttccgggccgacaagagagccggtatgaaataccttgtccatgtctacgtcagtcaacccgtgaaattccgggtcaagttcgggaacatcctgtttttgctgcaaattgagcgggtcaagattagctctgcgcacgcccaggaagcggtaggtgttgatcagctgcagaacagcaatttgtttacgttcctgtacttcaaagtcaatagcttgctgttccgcctgttttgagggagtgtcggaaagggaagattcatgccgtgcagcagatcgaatcagtgactcgataaccggagtatgggaaatgtcccggatggaaatactttctgttggctgcagtgagtcgaaatacaggcgccattgatccggtacgctggtttgatcttccagatactggtcatagagcatttcgatgaatgccgcattggtaccgaacagttttgaatcttctaaaagttgttttatcacgatagccacctgaagcctgtgaaattaccgcaacatattttctgggggcagagaaaaagacaaatggcgaggtacgggtaatctgctgcttgtcttttattcttgccagctgtagccgccaggtttgtaaatttcctgttgatcagatatagccatgattgtcatggtacatctctgcgcgggactccaacatataattggcggggtctacctattttctgttccggatcagagatcatctcgttccactgcgcaacccagccaacggtacgtgcggtagcaaaaatggcagtaaacatggatgttggaatacccagcgcccgttgtacgattcccgagtagaagtcaacgttggggtacagctttctggtaataaaaaagtcatcttccagggcaattctttccagctccagagcaagcttaaacagccggtcattatgtagccccagttcatccagtacttcgtggcaggtgtcgcgcatcagtgtggcgcgtggatcaaagtttttgtagacccggtggccaaagcccatcagccggaaaggatcattcttgtccttggcgcgggtaatgtattcattgatgcgtgaaacatctccgatttcttccagcatattgaggcaggcttcattcgcgccgccatgcgccggaccccataagcaggtaatcccggcagagatgcaggcaaatggattggcaccgcttgagcccgccagacggactgttgatgtggaagcattttgttcgtgatccgcatgcagaatcagaatgcgatccagtgccctgacaatgaccgggttgggaacatatttctcggctggcgtggcaaacatcatgtgcaggaagttttccgtaaagcccagatcattacgaggatagatgaaaggctggccgatattatatttataggcaattgccgtaatggttggcagtttggcaatcagacgaaatatggattgttcacgatgtggcgcatcagaaacgtccatggcgtcatgataaaaagcagacaatgcacccaccacgccgaccatgaccgccatgggatgtgcatcgcggcgaaatccgctgagaaacttgatcatttgctcatgcagcatcgtatggtttttgatgttattgacgaattgctttttttggtctgctgtaggcaattctccattcagcagtagatagctgacttccatgaagtcacagcgggtggccagttgttcgatcgggtagccgcgatacagcaggataccttgatcaccatcgatgaatgtaatggctgatttgcagctggcggtggatacaaacccgggatcgtaggtgaacatattgctttgagcgtataacgagcgaatatcaataacatcaggaccctcattaccggacagaatgggcagttcaatcgttttcttgttttcacccggtgacaaagtggcaacatcttgtgggggcataattttctccatttatcctgcaattcaaattttcctgatagataaccagggttttggttaattttcctgtaaaagtctcaatatgggccgaaatgcttcatcaggtactctcgtattacgggcgatcatattccacagatcatgatctgggtacgttagtagcgcttcaaacagttcatgttgctgctcatccagctgttcataatgagcatccatgaagcgcaacagaacgatatccagttccagcatgccgcgacgacaacgccagcgcatgcgggcctggtggttcataccgttttattcagcatcatgatttttatactttctatcgcggcggtcgggtttaatcccttggggcaggcatcgacacaattcatgatggaatggcaacggaataaacggtaggggtcctccagatcatccagccgttcagaagtggcctgatcccggctgtcggccagaaaacgataggcttgtagcaatccggccggcccgacaaatttgtcgggattccaccagaatgaagggcaggcagaggtgcaacaggcacacagaatgcattcatagagaccatccaggcgagcgcgttctccctgggattgtaaacgctcggtttctggcggcgggtcattattgatcagatagggcttgattgaatgatattgcttgaaaaactggctcatatcaacaatcagatcgcgaataatcggcaatcccggtagaggccggatttccacaggttcacgcaggtcagcaagcggtgtgatgcaggcaagattatttcgaccattgatattcatggcatcggaaccgcacacaccttcccgacaggagcggcgcagactgagactgtcatcaatggccttgatacgtatcagcgcatccagcagcattttatctgtcggtgcgagctcaacgtcataatcctgcatgtacggtttttcatccttgtccggatcatagcgactaatcgagaacagcataatgcactcctttttccgtttattttaatttgatcagaaaaataccttgttccgaaagaatacagatgattttacgataacgttaagaagatgattacaatgtaccaggatcggggtcagttttttcgttatccgtgcatctgatttgatggcccaacctgatgggcaatgaaccgtttaacttgttcggcatctgctgtcatacgttcaaaacgctggggcagtttctccaggttatcgtatccatccggttgttccggtacgaatccgactgcttcctggatactgtccgcaaacttgactggcagtgctgtttccaggcagatgagtggaacatcaggttcgcgcaattccatacccactttcaggccatctgctgtgtgtgtgtcaatcaggatattgaatttatggtgtatctttcgaatagtggtgatgcgttcagcatggttgctggttccagaaataatgccaaaatccctgatttttttccatagatcagtatcggaaagatcgaatgatcctccttgatcaaccaatttccaaagttctttgatgcgtgccgcatcccgaccggttagatcgaagataaaccgctcaaaatttgatgctttggagatatccattgaagggctgctggtttgcttcgtttcagttgttgtgcggggacgatataaaccggtacgaaaaaactcattcagcacatcattttcattagttgccagaatcagttgcttgatgggtaggcccatcatacgggcgacatggccggcaaaaatgttgccgaagttgccggaagggactgaaaaagatactgcttccccgttagagcgggtaactgcaaaataggccttgaagtaatagataatttgcgcggcgatacgcgcccagttgatcgaattgaccacaccgatccggtatttttgcttaaatacctggtcgttactgacagttttgacaatatcctggcaatcatcaaatacaccttcgatagcaatattgaaaatgttgttatcctgtaacgagaacatttgtgcggtctgaaaagcactcatttttccgtaaggtgacaacatgaatacgcgaatgccccgtttgccgcgcatggcatattctgcactggagccggtatcaccagaagtcgcgcctaggatattcaattcatcattattttttgcaagcacatactcgaacaggttgcccaggaactgcatggcgatgtccttgaacgccagggtagggccattagacaggtgcagcaggtgcagattggattccagtgtctggacaggagtgacctcctcgctgccaaaaatttcgtccgtataggtgcgtgtaattaaggtgcgcaaatcgtcggcggggatgtcatccataaaacgcgacagaatttcaaatgcaagcgacgggtagtcaagcgagcgccaggattcaagttctgccgggctgattttaggataagattcaggcatggccagcccgccatccggagccagtccgcctaacagaatttcagtaaatgttttgggcagcatgccgcctcgggtcgagagataacgcatattagtctgtgataaacggggaaagaaacaaccaggtgcttcgcgttggaagctgatcaattccgaaagaaatcaaggactgaattgaatatgaatacagcaaaatttgaaaagctgtgcaattttaactgccaagctcctcaagtcgaatccgaatgattttatcagccatagctggaaggttctgtattttttcaatagctgtattgatgttcttttccctggttttgtgcaaaagcataatgatgttgaccttgtcttccccatctgcatgctctttctggatcattgcactgatggagatttcactgtctgccaggatgcgggtgatatcggccagcacaccaggtttatccgtgacctgcagccgcagataataggcggtttccactgcctccatcggtatgatgggtgtgtcagacagcagctccggcaggaatgccagcacgggcacccggtgttccggactggaggtgagcagacgtgtgacatctaccagatcagcgatcactgcgctggcagtaggttccgcaccggccccggcaccataatacagcgtcggcccgactgcatcccctttcacgatgatcgcattcattacaccttctacattggcaatcagtcgtttgactggaatcagcgccgggtggacacgtaactcaatgccattggtcgtgcgtttggtaatacccagcagtttgatgcgatagcctaattcttcagcataacggatatcgtcattggccagtttggtgattccttcgatgtaagtttgatcgaaccgaaccggaatgccaaaggcaagtgccgccatgatggtgattttgtgagcagcatcgatgccttctatatcataggttgggtcagcctcggcataacccagctgctgtgcgctggcgagaacggtgctgaagtccagtcctttgacacgcatctccgacaggatgaagttactggttccgttaataatgccggcaatccattcaatgcggttggctgccagaccttctcgcagagccttgatgatgggaatgcctcccgccacggccgcctcaaatgcgacgataacattgcgttgttgtgcggcagcaaagatttcattgccatgatttgccagcagtgccttattggcagtaatgacatgtttgccgtgagtaatggcttcaagtatcgcttgtttggcgatagcttgccccccgatcagttcgacgatgatgtcaatgtcgggatgtctggcaatttcaagtgcatcggatgtgacgacgacatcgtcacccgcgaccagagcacgtgccttttcctgatccagatcggcgatcatgcgaatgatgatattgcgaccagttctgcgtgtgatttcctgctggttgcgtttcagaacggtataagtaccgctaccaacggtgccaacgccgagcagtcctacatgaattggcttcataacggaattttttgtgtatcaataaggataaaccgaagattatatacggaataaagtggagtacgttagttacccgcttggttaccgtgctttccaggaggtaggattagcagccgtgacgagcgcgatagcggcctaaaaactgtgcgatacggccgatggcttcggttagatcgtcactgttaggcagaaatacaatccggaaatgatcgggctgagaccagttgaacccggttccctgaacgatgagtaccttttcttccagtagcagatccagtgcaaattgttcatcatctgtaatcggataataggcggagtccaaccgcgggaacaggtacagtgcgctttggggtttaacgcaggtcacgcccggaatgtcggtgagcagtttccaggccaggtcacgctggcgctttagtcgcccggtgggcatggtgagatcgtgaatactttgatagccacccagtgcagtctggatgccgaattgtgctggaacattggcgcacaaacgcatggatgccagcatattgagcccggcaatgtaatcccgcgctcgtgttttgtcgccggagacaactgcccagccggaacgaaagccagcggcgcgataatttttggataagccgttgaatgttacaaacggaacatcattggccaacgaggcaattgaagtatgacgggcagagtcataaaggattttgtcgtagatttcgtcagcaaaaatgatcaggttgttttgtcgggcaatttctatgatatcgcgcaacaaatcatccggatacagtgcgccagtggggttgttggggttgatgatgacgattgcccgggttctgctgttgaccttggcttttatgttttccggatccggcagccagtcagattgttcgtcgcatatataatgtcgcgcgattccgcccgccagagagactgcagccgtccataagggataatccggcgagggaaccagcacttcatcatcattttccagcagcgcctgggtagccagcatgatcagttctgatacgccgttcccgacgtagatgtcatccatccgcacgttggcgatatttttttcctgcgtgtaatgcatgatcgctttacgagcggcgaacagccctttggaatcgcaataaccggatgcggcagaaaggttttggatgacatcctgcaagatttcgtccggcgcttcaaacccgaaggaagcagggttgccgatattgagcttgatgatacgatgcccatcttcctccatctgtctggcacgatcaagaaccggtccccgtatgtcatagcagacatggttgagtttgctggattttttgatgggttgcatggacggatagagaaaattctatttaaaatacggaaaaagcataccatgttacgctgatttttattaaaggacatttctaaaaactcagctgtgcgggatgtggtgcaaggcgtatgggcgcagcaacgagatctgtcaaacaagtaacaagtagataggtgaggcagggagtacctgcacaacgttgccatttgtctggaaaatcaattgttagaagtgtcctgaatgaaaatggttgggctgattatccagccggatcaaagctgaatttttcgttacgaaaggatttatatgaaattacatctttcggataactccggtttgaacattttttccggttacggagatggttatgttgcggtcaatcaggtgcggtatacagatagcatgatcgtgctgccggaacaaattgttgaacactggccagtaagcagtattaaccagttggaaatggagcattttgatccattgctggcagtgcagccggaaattattttgctcggaacaggaatatcattacagtttccaaatgcatcgctgataaaaaaaatactggctcgcggaattggattcgagacaatggatacgcacgcagtatgcagaacctacaatatcctgtcgtctgaaggaaggcatgttgctgccgcaatatttgtccgacccccagacagatagcaatccatggttcgttcaggttatttattttgataaaagaagacgatagtgcacagatgttatcgtatccgttctgtttttcaatgagagtaagttatggctggtcatcctgactatattttgtggctggatcaggtaggtatgaacgatgtggcgagcgtagggggcaagaatgcctcgctgggggagatgatcggcaatctttcccgcgccggggtgaaagtgcctggcggatttgctacgacaacatacgcttatcgtgaatttctcaggatcaatgatttgaatgatcgcatcaatcaattattgaccccactggatgttgacgatgtggaggcgttgaccgttgcgggtaaacagattcgctcttggttgcttgccgccacgctgccggatgatctggtagaagtagtgactcgggcataccagaagctcattgctgattcgggtgagaaagtatcctttgcagtacgttcatcggcaacagctgaggatctagcggatgcctcctttgccggccagcaggagacgctgctgaacgtgcaggggcttgataacctgttcagtgcactcagaagagtgtttgcttcactttatacggaccgggcgatttcctatcggacccatcacgggtttcatcatgatcaggtatttttatctgcgggcgtacaacggatggcgcgcagcgataaaggtgccagtggcgtgatatttacacttgatactgaatctggctttcgggatgtggtgtttattacttctgcttatggtttgggggaaaccgtcgtacagggaacagtcaatccggatgagtttattgtttataaacaaaatcttaaggtgggattgcccgcaattctttcccgccggctgggagccaaggcaaccgagatgatctatagcgatgaacaggcagggcaggcgaccgtggtacagccggtatcgccggaacgaagtcagcgtttcagtttgtccgatgagcaaattgaattattggcccgacaggcggtgatcatcgaacagcactacaaccggccgatggatattgaatgggcactggatggaatagatggacagatttatattgtccaggcccgcccggaaacggtgaaaagccgtgccgagcaatcagtagaacaatttcacctgagcggacgaggcccggtgctggtgcaggggcgcgcgatcggccagaagatcggacagggaacggcgcgggtcattatgagcgcggggcagatggccgagattcagccgggcgacgtgctggtaacggacatgacagatccggattgggagccaatcatgaaacgagccgcagcgattgtgaccaatcgtggcgggcgtacctgtcacgctgctattgttgcgcgcgagctgggcattcctgcggtggtcgggtgtgagctggccacgacaaaaatcagcgatggccaggcggtgaccatatcctgtgcggaaggagatacaggttttgtttatgaaggtctgcttccttttcagcatacttgttcagagatcagtaagctgcctgaattaccagtcaagatcatgttgaatatcggaaatcctgcgcaggcttttgcattttcacaactgcccaatcatggagtggggctggcacgtctggaatttatcgtcgccaacaatattggtattcatccccgggccgtgctggaatttgatgcgcttccggatgatctgaaagcatctgtcattaagcgaacggcaggttaccccgacccggtgtctttctatattgagaaactggtggaaggtattgccacgttggcggcagcttttcacccacatccggtgattgtgcgtctatctgattttaaatctaatgaatacgcgaatctgattgcgggagatcgctttgaaccacatgaggaaaatccgatgattggatttcgtggtacttcacgttatcttgctgattcttttcgtgcctgctttgagctagagtgtcgggctttgcgcaaggtacgtgatgaaatgggttttaccaatgttgaagtgatggttcctttttgtcgaaccctggaagaggcgcagcagattacagaattgctggcggctaatggattaaaacgcggaagcaatggactacgtttgatcatgatgtgtgaaattccttccaatgctgtgttggctgaagaatttctcgaatacttcgatgggttttccatcgggtctaatgatatgacccagctggtacttgggctggatcgtgattcggagctggttgctcatttattcgatgagcgtaatccagctgtgaagcggctgctgaaaatggcaattgatgcttgccacaaacaggggaaatatattggtatttgcggccaggcaccctctgattatccggattttgcacgctggctggttgaacagggtatcagcagcctttctcttaatcaggacacggtagtgagcacctggctgcatctggcggaccgggagcagtagggcgatgttacaacgcagcgttttttttctgtctgatcgtacgggcattacagcggaaacactgggtcatagtctgttgacccagttcgatggaatagagtggaagaagcactatgcttctttcctggacagtgcagctaaggttcaggagatcattgatcgtatcaatacaattgcgaagcaggaaggccagccatcattggtgtttagcacattgctggatccggttatcctcgcttctgtccgtcaggctgattgttatcttattgatttttttgaatcttgtcttggtgtgctggaaacggcactgcaacagtcgcctgtgcgcatacccggacgctcccatattcttggccaggatgcttcctattttcgacgtattgctgcgattcagtatgcgctgaacagtgatgatggtagtaactctaaaattcttgccgatgctgacgtgattttggtaggagtatcacgctctggtaaaaccccagtgtgtgtgtatctggctttgcagtatggagtgcttgctgctaattatccatttacgccagaagatatgggagtcgtgcgtcttcctttgttgttacaaccactgcgtgagaaattgtttggattgacgttgagcacgtcacggcttcaggctgttcgtgtggaacggtatccgggcagtcattatgcttcattcgttgaatgccaacgtgaacttcagtggcaaaatgaactgtaccagcagtttaatatcccgtttatcgatactaccggagtatcaatagaagagatcagtgcatcaattatcaaccggatgcggctagaaagacgtttgtatggaacctgaatcagtacccatgccgaatatgacgggtgatagtatgatttttatatcctgatggatttccagtatctggatttccagtatgtattatccaggctggatatagtgactccttgactggatgaggcatgaagaaatttcttgctatccagatagatccctacatgccaggaacgcccgcctgttttgaagaacaccagatctcccggcataagctcattccgactgattttttcaccaaattctgcctgggaaagcgctgttctgggcaatgtgaagccgaattcttccttgaagatgattctgacaagcgcagagcaatctaccccagtgtgatctgtacctcccaatcgatagcgtgtgccacgccattcctgatattggctgtacagacgtttccgcacgaaagacggatcattttccagaattccctgaggaatcgcaaatccggatttatgggaatatcgtgaaatctcatcacgcgttgaatctttgggaaccgagctgcatccagctatcatacctgcgccgagcaacagaatgacaatgtgttttaaggacatgtttcaattcatgttgttggaataagaggcaagtataacaagaaaataatctggttgtgaaataagaaaggttctttttagcgaatgtcctggtaatttgtcatatatgcaaatgtaattcacacaattgctaattatccaccgtgctccggcttgtccgtgattttcacccaggtattgcgtagtgatacggttcgattgaatatcggctttcccggttttgtatctgccagatcagctacaaagtagccatggcgttcaaactgaaaacgctgttctgcttgaatttcaagtaaagaaggttcaacgtacccaacaataattttcctggaatccggatttaacgaggttttgaaatctttaccttccgtgtcgggatgtgcgtcgctgaacaaacggtcatataatctgatttcaacagccttggcataagtagctgacagccagtgaatattgccacggacttttcgagtttcagccccggcagtaccgcttttggtagcgggatcgtaagtgcagtgaatctccaggatctttccctgatcatctttgacaagatgtgtgcatcttacgatatatgcataacgtaaccgcacttctgccccaggtgccaggcggaagaagcctttgtctggcacctccataaagtcttcacggtcaatataaagccgttttgtcagcggtagttcgcgtgtgccaagttcgagtttttttggatgattgggtgcatagcaggtttccatctgatcatctggaaagttatctatgaccagcagcaccggattaaggacagcgatgcggcgcggtgcgttttcattaaggtcttcgcgtaagcaatcttccagcactgtcatatcaatccaggaatctgccttgctgataccgattcgttccgcaaacaagcggattgattccggcgtatagccccgacggcgcagacctgccaatgtattcatgcgtggatcgtcccagccatctaccagtttgttctctaccagttcgatcagtttacgcttgctcatgacactgtaagtcagattcagtcgcgcaaactcgatctgctgcgggtggcagggaactttttcacttaattgatccagtatccagtcatacagtggccgatgatcttcaaactccagtgtgcaaagggaatgcgtgatccgctccaaagcatcggaaatacaatgggtgtaatcgtacatcgggtagatacaccatttatcacccgtgcgctggtggcggatatggcggatgcgatagataaccggatcacgcatattgatgttgggggatgccatatcaattttggcgcgtagtacgtgcgcgccatccggaaactctcttgcgcgcatgcgccggaacaaatccagactttctgatggcggacgatcacgataagggctgtttgtacctgcttcagtcaaggttccacgtaatcggcggatttcatctgccgataggctgtccacataggccttgtcttgcgtgatcagatattctgcaaattcatatagctgatcaaaataatcggaagcgtagtaaagatgttcctgccagtcaaagcccagccagtggactgattcaataatggcatcgacgtattcctgagcttctttttccgggtttgtgtcgtcgaatcgcagatgacaggcgccgttatattcgagcgcaagcccgaaattcaagcaaatgctttttgcatggccgatatgcagatagccatttggctcgggcgggaagcgtgtctctacgcgcccgttccacttaccggtgcggttgtcttcttcaatgatattacgaatgaaatgagtaggggctgaaggcgtgttcacagatatttttcagttgaattcaataagatgttgattattttcatggaataaatgacagtacatagatcgtaatatgtgcccaggcagcgtgcgatgccgtgtaactgtaagtttcctgccagatggtttttcgtgagcccgttagaatggagcaggtaaagtaactatataatacacgttgattacgcatgcggcagcggctccaggatgtccgtgccgcttggtacgatacagagagattttataccaataaaaattacataaaatttggaatagatatgacccaggaagatacatccggtatttcccaggatgaaaacagccttattgcagagcgttattctaaattgactgcattgcgccagatcggcaatgcttttccgaatgattatcgtcgggatagcctggctcgtgacctgcatgcaaagtatgataatgactcaagagaagaactggaaagtgggcaggttaaagtaaaagttgcaggacgcatgttgtttaagcgtgtaatgggaaaggcaagctttgcaacgatccaagatatgagcgggcggatacagctctatatctccaatgatcataccggagaatccgctcacgaagcattcaggcattatgatctgggggatattctcggcgcggaaggtattttgttcaaaaccaggacggatgaattgtcattacgggttacccgacttcgtcttctgactaaatccttgcgcccgctaccggagaaatttcatggccttatcgatcaggaacagaaataccggcgacgttaccttgatctgattacaaatgaagaaacacgcaaggtattcctggttcgctcaaaaattattcaggcagtacgtgaatttctggttaaccggggctatcttgaagttgaaacgccgatgatgcactctattccaggaggggctactgctcgaccttttattacgcatcataatgcattggatatgtcactgtatctgcgtatcgcaccggaactttacctgaagcggttggtagtgggtggtatggaaaaagtttttgagattaaccgtaatttcaggaatgaaggtatatccactcgccataatccggaattcaccatgctggagttttatgaggcttatcaagatcatcattacctgatggatctgacggaatccatgctgcgtgaagttgcgctgaaggtgttaggaaccactcgcattgtctatcagcagcgcgaaatggatcttgcccggccttttgcccggttgactgtcatgcaggccatcctaaaataccaccctgaaaattccgaagcacaacttaacaacagggatgatttgatcaaaattttgcaggcaaagggaatcggattcaatccggacagtggaatcggcggactgcaattggccttgtttgatgaaacaaccgaacatttgctgtttgaacccgtatttatcgttgattatccggccgaggtatcgcctttggcacgccgcaatgatcaaaatccggagattacggatcgttttgagctttatattgccgggcgggaaattgcgaacggcttttccgagctaaatgatcctgaagatcaggccagtcgtttccttgaacaggccagggctaaagaggcaggtgatatggaagcgatgcactatgacgctgactatatccaggcactggaatacggattgccgccaacggcaggtgagggaatcggtatcgatcggctagtaatgttgctgacagattctccaagcatccgcgatgttattctgtttccgcagttacgcaaggaagactagacgacaggtactgatcccgtggtgcggctcgggattcttcctcaagcacggggtgtgattgccgatattactttgtttgtgccgagtcatggagttcaactatgtttactggttctcttgacaaactgatattcaccgtgctgttcttgatgattggtgcgggattaatgagagttgcgctggcttccggcgcgcgacaagataagattgtgaatagccaggaaataacagaagagtattcaaaaccccgtcaacaggtaaaatctagtgtaacagctactacttcctctcccaacaagattgatgggagtgcgggcgggcagaaacggtcaacctatcgtcgtatatacagcaccgatgcttccagaaccttgattaatcccgcccggcttccggctgattattgcggagtagtggaacacatcgtccccgtcatgcttaaccccgccaatggtggcaatacggatacatttatttcagggatagtcgcagttccattgggcagacactggggaagtttttttactgaagtcgatgtcctgggtaatagcagctacgttccgcccgagaggaacattgccgagccgatttattacagaatcagcttgctggcaaatgatggcaatcgctatgtgataacccagcaagtgccccccgggtttcaaccgggagagacaatcagattcaatgacgatggtttgctggagaaagctggttgtgtgatgcgcgaacccgatccgcatcagccgggccggtaaatttttcttacgaattcagtctcctcgcacaattcgaagcattcttgccttccttgcccctttactcaaataagcccttttttatcagggaagaattctgttctttccgttcctgtgtttctatttagtcacccctgaaaatcacaataacagattgatttttatgagacacgctattatttatgctgatcgaatcgaccgggaatgataagacctgcgttatttttctggtcgaaacggtgattgtcgatgctcactccgagtaaaacttctcatcaacctaatttgtttgcaaccgatcttttatggcaacttgatcctacggatccactgttgcaactggcaagtgttgtcccctggcacaaatttgatgaagcattctcggttcattacaagaaaggaacaggtgcatctggcaattcaccagcgggtattttgatctgggaattaccgcaaccctgcttgtttgagcattatcagcgtatggacaagtgctgcagcaacaatccaaagacagcaacaagctctattcactgcatgagccgcaagtgtactgcgtggctaaagggaaagatcacaaacagtacgaatacggcagcaaagcctccattgccagcgctgcgcaaggcagtttgatcgtagacgttgcgagccatgagcaaaatatgcacgacaaccatacgctcccggctatcttgcatcatgtagaagccttgcgcggcaaagcctgccaggccaggcagcagtgtgtgatcgcgactatcgtagcaagcgtgaagtcaacggaatccatcgtactaccgggcaagaccctcaaacaggataactgttaccagcgagacagaaagcgcaagcaatgtaaaagacgtgcaaccattgaacccatcattggtcatttaaaagcagattaccgaatgacaaaaaatgacctgaaaggcgctattggtgatcacatcaacctcttgatggccgcttgtacctggaatttgaaacaatagctgcctggccatcttttggctgtattttccgtgtgtaaaatacaaaaatcaccccaattttctgataaaaaccttagttcatgcgaattaatctgaatgagcaatagaaaatcagatgtaattccaaaaactgcaatcagtagcaagtgtttttcagtggcgactatttagataaaccctataaagagtcaaggagaggcgaaattgagtatgtggaagaacattgcaaaacagtgggacatcattgcaaaacagtggaacatcatgaccttctatcaacgcttcgaaagcgtgattgccctttttctcacactgctgattacgttaattgttattgtagccaccttccgtttatttaccggagttatcagtggcctcgtgtttggtgccatggacccgctcgaccataaaatgttccaaaacgtcttcggcgagatcatgacggtattgatcgcgctagagttcaaccataccctccaatacacggtcactcggcaacaaagcgtcattcaaacgaaggtcgtcttgctcattgccctgcttgcgatagctcgtaaagttattatcttggatcttaaggaaataactgccgaaagcatgtatggcttggccgctataactctggcaataggtattgtctactggttattgcgtgagcgtgacgatcgtcttcctcaaacgcaggcactacaacgtcccgagaatacatcgacagatgtcgagaggcatacagcctaacatgtcgtttaaacgggacgccacaaaagcgcggcgtaagtgtcagcaatgcgcggaacatgagcaagtcggcgcaccatcaaaacaccggcgctggctcgggcacttcccttgcactactttaatcatctgggactgaacacgtatgcagaagatcgtctgcgtaaccacctgatgaagcggcacaagattcggagtcgtagagaagcgttgcagcgctttccgcgacaaaagttgaatgcagatcatgggttattcaaggtgctggtgacggtgtgctgaaaatcagcgcatgcacggtttgatgagggaggataggtaaatttgatgatggtaaagcaactgagatcccgccagataaaaatggcggaaacggtaatgcaaaaccaaatgcacctgtcctctacacggttttgggctcgcgcggctgtagcaggcgagccgtggcgaaagcgagaaaccgtgatctgtcccctatttgctagaaggcttcgtcattagtaatacgcagggatttgagacgctttgtttttcagcttgaatatagcgacctactgcgggtttactgatgcccagttgcctgacccgttttaatccaactggcaatttgtacagctcgccgcgcttgatggcgcgcggactccagcacttcgtctgaaactgttacgtcgcggctggcggtggcgctggcaccatagggattgccgccggatttatagatacattcgttggtgtaaccaggagcgacgacgatagcaccccagtgatgcataatattgtacaaggtaagcgttgtagactcttgtccaccatgcaaattttgcgcgcttgtcatcacggtcgccaccttgttggcgagctttccagcggaccataagccacctgtggaatcaagaaacattttcatttgtgctgccacgtttccatagcgtgttggtgtgctgaaaataaaaacatctgcccaatccagatcatccaggcttgcttctggaataccttgagcagctttcatataatttttccagccttcgtttgattccaatttttctgtcggaattagttccataacacgcgccaggcgtacttccgcgcccgcttctttcgcagcatcggcagcagctttagccagttgcaggttgtggccagtaaggctgtaataaatgacagcaactttgatggatttcattatagtgaaactccttattaaatagaatgcaataatttttgacaccaagacgaacatccgggatgcgatatttaactaagcggatttactctgtcagcatataaaattgctcagcaaaagacatcttgtcagctccttccatcatcatctgacctttgcgaatcatgtgcatgagttcaatgccagccaagctatttttagcggattgaaaagatttgaatctgagcatcggttttgttattcgcttcactgccagatgggcttgttccacaatattgttgaggtatttgacctgacgaaccatcatgagcatctccctgttggcattgatcttgtcaattgctgctttataggcgccatttttatccatcgtgatcctttctcaggagcgccattggcttgcatggctatgtcaaaaaagcatttggcatcacgcttggccgttaattgaaagtcgatcgtcttaccatcctgtctacagtacgatagaggtatttccaagtgcctttgatcttaatataagctttgtccatccgccagccgggtgcttatgcttcttgaaaatttcccccagtaatggtaaaaaccagattgcccaacggtccactgtagaatgatccacaaatacaccacgttcctctatcatttcttccaggtgccggcaacttaacggatatgccgcgtacaagcgtatacggacccgaatcacctcaatcgaaaatcacattccttttataaccagcatgtaacctcaccatcttttcgatgtcaacagcctactacacagaaggtatctatgatctcgacgaggcgttgagcgacttctctccgtatctgccgggtcatcgcaaaatcggcttgtgatgacccgggggacaatggatggttaccggcgcgccgagcgattgttgatgcgcgggaaggccatgcccacacgttgcacaagcggcgtctcagcggatgacccgccaacgtgcacccggtaggcgccagcgtgcgacacccactctccctcggcccatgctgcaaggttgtccgggtcgtccggcacgaacgaggagaaggggtggttgggggcggaggcgtctatatcaacggtgatgcgagcactctcattgggctcgaggaataccttcttgaatccgacgagacgtttggatggttgattcgcctgccgtggtagttcgaggtaaatctgcgatgcctcagcaccggcgacagaaccggtgttggtaagagtgtactcgaccgtcagtacgggtaccagttcaacgagccgacgatagaagcgctgtggaatgttttccctgccggtgcccggaaccggcacctgttcgaacacacgacgatatttccgtttgagcctcagatcgttgtactcgaaggtcgtgaatgagaggccgtggccgaaggcaaacgctggtttgacaccattggcctcgtaccaacgataacccatctccaagttttcggaatagtggctgacaagttgcgggctgccatcgccgagcggaaatcccgggccgccgggcagaccgttgttctcgcgtgttcccggatactgcatctcggtggcgaaggccgcctcgtgctcgctggtcgggaagcttacgggcagttttccagacggattgatgaccccaaataggatgtcagctaccacgtcgccgtcatcctgacccggaaaccatgcggccacaagggcaggtactaggtcaagccagttcattatcactccccccgcagaatacagcaccacgacgttgttaggattcgccgccgcaacctcgcgcacgagttgatcctgctcgacacaaacctcaccggccgcttttatggtcccgggcaaaccggagtcagaaggatcggacgggtccgggtcggacggatcgccatcaccatcgttagtgcacagcgtaggcagcgtgagcttcaacagatcacgtgtctcgcgcggattggtccccaccatgaggatgacgacatcggaattcattgccagattgacggcggatgcgatatcggtgccgtcattgtaggtcaccgtggcggatccaccgattttggccaaggtattttcgaggccttgcttcggtgtcaccgtgtagggcgccacaaccgtagtgagttcgctcgggctgaggttgcgcggtggcatggtggccgaaccggcaaaccacttgtggccgatcaaggcgatcgattggacgttgggtttcaatggcagggtgccgacgtcgttcttgagcaacgtaatgcccccttccacgagtgcacgcgccttggcggcgttggcgtcgagatccacattgatgatctggttgaaaggattttcgaactggtcgaattcgaacattttgacgtagcgcggcctgagtgccgcgtcgatatgctgttcggtgatatcacccgctgccagcgctgccatgatcttgttttcggtatagaaccgcggttcggagtcgagttcgtaaccaacgcccgccagcaacgcatccacagtgctatgcatcgcgcgccggtcactttccacccatccatcgaaaccccaacgttggcgtaaggtctgtaccagcagtgcatggttgtcgcaagcgtaagcgccgttaatgtgcgggtacgcgcacattatcgatgcgggctgcgcatccttgactaccatctcgaaaggtagcagatagagttcgtgcagcgcacggctgggaatgtgcacagctgcggtccagcgttcaaactgaaactcgtgttcgttgcccgcaaagtgctttggctgagcctgaacaccctgcgactggataccctgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacaactaacctgttctttcattttttctgcctcccttttctgtatgaattaatataattaatcctttatggaatagcattatgaatcagattgcagaatcagcaataagtcacaaaaaggtgttccatgaatagggactgcagaataaccggtatgtgtaaatcggttctgtgcgttaacgcacagaaccgtacatcatctatgtgaacggttcttatattcttgttcttgtgaaaggaagttgtatttattcgtcccttacatgatacatgtatcacaactaccaaagtggagtttttatggctctttcgattcggctcccctatgccctatgctgtagaagtcagactaaaaaacctagtggcaaagactgggcgaaccaaaagttactatattactgaggcgacctgtgagcatctggatgacctcgaagatttatatctcgccgaacaacgtttgcgcgacatccgtgccggtaaaattcacaccatatcaatttgtagtagtctaatttgcccggactgaatcgtcccgggtttcgtggaggctgtttggttaaagtcaagccaccggaatggcttccttggcgaattgcctatagtagtttacctcagcttctgcgggagggatgtaaccgattggttccagcagccgctggttgttgaaccaggctacccattccagcgttgccagctccacggcctccctggttttccagggggcgcgcttgtgaatcaattctgttttgtacagtccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggcatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaacccgatccagtggacacggcagcgccttgtccggaactgtggtgcgcataaccttgccacgcctggcaacctttcagccctaaccgtttcatgagccgttcgaccgtacagcgtgccacctggacatcttcacgcttaagctgacgccagaccttgtcggcaccatagacctgcatgttggtctgccagacccgctgtatctgcggcagcagttcatcatcacgcaggacgcgagcactgcgcaaagccggattacgctgctgcgcgaaatatcgccgataccctgatggggcgacctgcaaaaccttgcagatcggctcgaccccatgggcgtcgcggtactggtcgatgaacgatctcaggatttgagtttgcggtcgagctccgcccgagcgaaaaaagcactggccagcttcagaatctcattcgccttgcgcaattcctttacttcgcgttccagggctttgatgcggtcgcgctcttcgctggtcacaccgtctcgcaagccggtatcggtttcgtgtttgcgcacccattcaagcaatgtgtgggctgaacagccgatcttcggcgcgatggattcaatcgtcgaccacaacgagggatactcactgcggtgttcctgcaccagacggactgcgcgcgctcttacttcgggggaatatttatttgatttgttcatggctccatcttctcagatattggagcctcctcaaaacccggggcggttcaaatcgataacctgcgatttctgccatggccgaggtggagatccaaataccggtggagctacctgtccgcgctgcttaaattccgggaaggaaaagtgtcccgattgtagtggtaccggcaaaggtccttgcccggcgtgctagatcacgagtgatgatctgtgccgccatcataaccagggtgtcaattttgttccggcgctgcgccgtaccacctccagcggatgtacaaacctgcgatccgcacgctgcttacaccggcgttaggctatacgctatgacagctcacgccatgaacagtggataacgagttttatctatatagtcatcctagtcatccaggacctgaaccaataatccacatcgaaattcttgcttggagggggaatcaggtggtcgttcggattgaaaatactgtggaatatccggtactataatttgtgcagcagttctttctctgaataggagaaatgatgaaggttttatggcgcactggattggccaggtactgaccgtaaaaaatcaatacctggaatacatcaatattattttgctcgggcaaaactgcctgggttattagatttactgtctctgagtggacgtctgcgagtatcacgagcaaaaggttggctaaactcgctttttttgtctcctctgaagccttgggcagttgtgcgtgtgctggcgtcatttggccatgaacgtctggttttgtgtgcggcagaagagggtctctttccggacttatcgtcattacggctgaacctcggttttgtgcgaggttccataccaggtacgacttggaattcaaagtgattgccggtaaaccgctctattcttttgaggtgaatgccatctttaccagatgcaaacgagacggcaatgccggaagctcctgctcggccagttcgtccaatacgatgcacgtagtcttctgcaaacttaggcaggtcaaaattgataacgtgagtaatatcagcaatatcaattccgcgcgcggcgacatcagtagcaaccagtattttgagccgcccctgacgcaatccggttaaagtacgcgtgcgttcgcgctgggtcatatctccgtgcatggcggcagctttgtgtccttgagcagaaagattgtctgccagagaatcagcatcacgtttcgttgcagtaaatacgattgcctgtttgatggttgtatcacatagcaaatgatcaagtaaccggtttttatgagtgagatcatccacgtaatgcatacgctgttcaatatgatcgagttttgcgtgctgagatgcgatctggatacgtttaggcattttcagtaaacgtgtagcaattttttcgattgcagtatccagtgttgccgaaaatagcaaggtctgcctgtttgttggtgttgaggaggcaatacgctcgacatcatgaataaatcccatgtccagcatgcggtcagcctcgtccagcaccagcatttccagccgtgagaaatcgatccgcccccgctcaatgtgatcaatcaagcgccctggtgtggcgaccagtacgtcaacaacttgtgatagaagtttattttgcaatgggtagggcatcccgcccagaatactgacaacattgacgcgcggcaggaattttccgtatttgctggcggcttcggaaacttgcagggccagttcgcgcgtgggggtcagaaccagtatgcgtggaccgcgaccctgaatttttgctggagtggcaagacgatgcagtgccggcagcatgaaagcagctgtttttccggttccagtctgtgcgcttgccattacatcgtggccagcaattaattcgggaatagcttgttgctggatgggggtgggagaggtataacccgctgccagtacggcttttacaattgcgggatgtagattcaaattttcaaatgacatgtcggttttcctgatgataaagaaattcaatgcgcaaacaggaacgtaccgcaacaaataattgctggtaccactggcgcatacataaacacatcgctgctaaccagggatactgcacaatttcaagaagaaacagaggaatctggagaggtcaggaacgatgaaactagataaaccctaccttgaggcagggtggcaagtatacagtaactacacaaaagaaaaagttaaatttttgtgtagtgtggttgaaacgagtggtcgattagcgttcgataggcttgaaacggatacgtttgggttttgctccttcttcaccaagacgtcgccgtttatcagcttcgtattcctgatagttgcccgtgaaaaatatgacttgcgaattgccttcaaaagccagcatatgtgttgcgatacgatctaggaaccatcggtcgtgcgagattaccaacacacacccggcaaattccagcagtgcattttccagtgctctcaaggtttcaacgtcaaggtcgttggatggctcatccagtaataatacatttcctccggatatcagtgttttggccagatgtaaccggcctcgctctccgccggaaagtgttcctgcaattttttgctgatcaggacccttgaagttaaagcggccaagataggcgcgtgacgggatctcgtgtttgccaacgataagcagatcatttccatctgagatgacctggaatacagtctgatcactaggtaatgcatcacgtgattgatctacataggcaatttttacggtttcacctatcttaatctcgcctgtatccggttgttcctgttcagtaatcatgcgaaacagagtggattttccggcaccattgggaccgataattccgacaatcgcgccgggtggtatccggaaattcaggttgtcaatcagcaggcgatcgccaaatcctttggaaacattgttaaattcgataacttcatttcccagcctatctgcgacaggaataaaaatttcctgtgtttcgttgcgcttctgatattcctgcgagctgagttcttcaaatcgggctaggcgagctttagattttgcctgcctgcctttaggattttgccgtacccattccaattcttgcttgagtgatttctggcgagcagattctgcgctatcttcttgtttcaggcgtgcttctttttgctccagccagctcgagtagtttcctttccaggggatgccatgaccacgatcaagttccagtatccattccgctacgttgtccagaaaatatcgatcatgagtgacggctactaccgtgcctgagaaacgtgcaaggaattgttcgagccattctacagattctgcgtccagatggttggtaggctcatctagaagtagcatatccggcttggatagaagtaatctgcacagggcaatacggcgtttttcccctcctgagagattctggatcaaaacatcccactccggaaggcgtagtgcatcagcagctatttccatctgttgagtcagattgtctccattttgtgcagttaatattgcttctagccgcgattgctcggctgccagtgtatcgaagtcagcgtccggttcggcataggctgcataaatggcttccagttgttgttgtgcattgagtacttctcctaatccttcctggattgcttcgcgaacggtgagatcgggatcgagttgtggttcttgtggtaggtacccgattttgagatctggcataggggtgcattccccttcaaagtctttatctattccggccatgatctttaatagcgtggatttgccagagccattcaggccaagcagaccaatttttgcgcctgggaaaaaactgagtgaaatatctttaagaataacgcgtttgggaggaacaattttaccaacgcgattcataactaaaacgtattgagccataaatgcttttctaatcctgaatttgaattgatctggacattctagaatctgggaagattccgcagagggttatacatgaaaagaaaggaaggccgttcgtttaatgtcggcattgcagggtaatgatttacatagagctatattaagaggcaaatgtgtaaaaggcaaatattggggtgagttgtttgtctgggcaaatacaggctatcagggaagagtatgaaaattacagtgcactataaatcaggagtttctcaggtttttattgttcctgcagaaatacaggttactgaatttcggaaaatggcggaggaggcaggaggagacgtgctcaaagttgagttttcatcttttaatccaaaatcttaccaatattatgctggcgaagggaaattctaggagatgctctggaaaaacgtataaaatacacttatcttccctgtttcgattggtttgagtattgtggcgcctggtaattatatgcttgttaataaagattaaatttaataattcctgaaatttattaagttaaagataataattggccaatcgatataatctagttcctgtggtttgcctgcgggcctcatttgtgtgcattagaatgctgacgcttttttctgataaaaatgaatgatgttaactatgcttggtttttaaatggtagacacattcagtactcctgtaaaaagataaaattacttttacagtctgggtgaatatttatctatttgataaataaacgttaatgtgacgttctgattatagatacataatgtatgttgtcaccattgttatagtgaaaaagtttgggtgagggcgctctagtctttttattgagggtttcgtgtgaatatttctattaaaacctggataactaatctgtcggttattttttatctgtttttgctcagtagttgtacgacttatccgttacttggtacacaaggggagcaggtcccgcatgattatctgattgggccgggtgacacattaaacattattgtttggcgcaatccagaaatatccatgagtgttccggttcgtccagatggaaaaattacaacgcctctggtagaggatttgccggcaagtggaaagacctcaactgaattggcgcgtgatatcgaagagacgcttgcaaaatatttgcagcagccagtagtgacagttgtcataactgattttgtcgggccattcggtgagcagatcagggtaatcggtgaggcctcgcagccacaggcgctgccgtaccgggaggatatgtcgctgatggatgtcatgattgctgtgggaggtttgactgattttgctgcaggaaacagggcaaggatcattcggagcgttgatggtaaacagcagcaatttcgcgtcaggctggatgatttgatccgggatggtgatatttctgccaacgtaccggtttatcagggagatgtgctggttattcctgaaagttacttttgattaatttgcgtgcaatcgtgataaatggcgaggtgatccgatatgagtgatttgattgctcagatactggtttacatcaaagggatttggaaatacagatgggtttcagttggatctgcatggattattgcggttgcgggttggtttttcgtttataagatgccggataattatcaggcatctgcgcgaatttacgttgatactcagagtattttgcgaccattaatggcagggatgactgtatcacccaatccagatcagcaaatcaccataatgagccggacgcttattagtcggccaaatgtcgagagaattgttcgtatggtagatctggatattaagatcgcagatgatagtgccaaagaaaagctggtgacctcattaatgaatgatatcaagcttaaaacgacaggtagcgataatattttcatgatttcgtatgacgacaaggatcccaaactggccaaagatattgttcaagctctgttgactatttttgttgaaggtgggctggaaggaaaaaagcaggattctgcttctgcattacgttttattgatcagcaaattgctgcttatgaagaaaaattagttgctgctgaggcagccctgactgctttcaagcaaaaaaatcttggttttttacccgggcagggtggagattactatagccagctggttgcggcggctgaagagctggaaaaagccaggctttccttgcttgaagctgagcaagctcgtgatgcggtcaagaaacagataacgggggatgagccgatgctgttactggaggtaggtgaagcatcaccacaaagcattgtcaatccggaaattgatgcacgaattcaatccctgaatacgaatttggataacctgatgctgaattttactgatcagcatccggatgtagttgctactaagcggttgattgctcaacttgaagagcgcaaagtggaagaggccaagctgatgggcccagttggtaaaaattatgacccaatgatgcaacagttgaatattgcattgacagaatctgaagcgctggtggcctccatgaaggcgcgagtgggtgaatacgaagcacgttacgaacgattgaaatcaatgagtaatactgttcctgctgtagaagtggaaatgcaacaactcaatcgggattataacgtgaacaaggctaattacgagaaattgctggaacgcagggcgtctgctgaaatctccggtgaactgacttctacttctggattgatgtctttcaggattgttgatccccctacagttccagagctgccatctggaccagatcggaaaaaatttcttacgctagtcctgattggagctttggctggaggggttggccttgcattcgttatcagccagattcgacctactttccatagccaaactaccttgcgagagctgacaggtttgccaattctgggggtagtgccgatggtatggacagaaaaagaaaaggtgaaagataaaagacaaatttatatatttggcatttctttgataatactagttgcgtgctatgtagtgctgttagtttactacgtaaaaccgcatgttatgcagactacttagattgtttgcatataaatcgttaccgatattattcaagaaaatatgtggatttgccaaaggtacggttcgaaggataatggagtggatatgagtcttattgaaagggctgctgacaagctttcaaaaaatgaaataagcaattctattccgggcaagataccgcagactgtgaaaactggcctggatccattatttctctctgacaatatgtcagatcagaaaattggaaaagaggtgagtgttaataatagccctgtggttgatctggctaatagagcgagcactaacaagaaaacaattaaaaaaattgaaattgatctggaaagccttcaccgtaaaggcattgtcactctggatcactccagatccgagatagccgagcagtttcgattgataaaacgccccttgattgccaatgcatttaatccagatagtggtattaaaaatggcaatctgattatggttaccagttccttatctggtgagggaaaaagtttctgttcaatcaatctggcaatgagtatcgcgatggaaatggatcacagggtgctattggttgatgcagatgttgctcggccttcaatccctgcaagtcttggttttagtccggaggagccgggtttgctggatctcctccgtgaccctcagtggaagatatccgatgtaatgatgaaaaccaatgtgaagaaactcacgttgattccggcagggagacgccatacgcatgctaccgaattattggctagtcagagcatgcattctattttagctgagcttgcccagcgctatcatgacagggtagtcatatttgactctcctcccttgttgttaaccagtgaagcacgcgtacttgcgggccaaatggggcagatcgtgctagtggttgaagcagaaaggacaacccagcagactgtaaaggaagctttgcttcaaattgaagcgtgtgatgtgatcaatctgatttataacaaagccagagcacatagcggcggcgggtattacggctacggctattattgatgaaatcactcggttatgctgacagcagcttctcgcgctggatagcgtgcttgtggggtggctgtattgtaggattgggcagctcggtttttcaggtcaatgcagcggaatggaatatccagccacgattaatggttagtgaaacctatactgataatgtgaggttgggcggtggaatcgggtttgggggaggaggatttggcagccagggggggggggaatttattacgcagattaatcctggaataaatattacgggtgagggacgtcgttttaaggcaaatcttggctatacgatgaacaatctcatctatgcaagaaatgaacggttcctcatacgacatcaattaaatactaatggtactgcagagatagtcaggaatcatttttttgtggatgcccgtgctgtagttactcagcaaaatgtttccctattgggatcgcaggcactggataacgctagcttgacaggtaatcgaagagatgtacgtatttggagtatcagtccctatgtgcgtcagcgtttcaagaatcttgctgcaggagaaattcgatatatccatggtgaggtgagctccaatacacgtagcttttctgatagcacttctgattcagcaatcttttcgctaaatagtggttcagctttcagagtacttggctggggaatgaattttagccatacagagattagcagaaagtattccggacccaggctaggagctttaagaacgatagagatggatcgagcatcaggctcgcttaaatacattgtgacgccgcattttaatctgattggtacagcaggctatgagcacaacagctttgtttcgataaggggaaaaccttccagccccttttggactgtaggtttctcttgggcaccgactgaaaggaccgatatcagtgcatcaggcgggaaaagattttttggagatacttatgcagcttctgttgatcaccgcactcgcagtacagtgtggaacttaagctatattgaggatattactacttttggccaacaatctttatctggtggttcgattttaagtgctgacatgttgagccaactcttgtcaggtactcagaacagtgaagcattattgaatcaggggctttcatcttcattttctgacccaaataattttctgactaaccgtttatttttacttaggcgtttacaggcctcgttagccttgaacggcaagaagaattcgctggtattccgggcctttaattattccagaaaatcatttagtccggatgaagaagatgctgatctaattggtgctactaatgccatgttgactagaaatactactcaaactggcgggaatgtattatggaatcaccggctgtctcccagaagtaatgccaacatcaatttcggatatatcaaaagtcgttatagtgtaactaatcaggaagatgacaatataattatatcagccagcttgaataagcagttttcttccaataccacaggatcaatcaggtattctcacctgcgtcgtgaatctgatcgcagcaacggtaactacaatgctaatgtagtaacggcgacagtaaatataaatttttagaaataagaagcttatgtatcttacttattatggttttaccgagaagccatttcagttaaaacctgatccaagcttttttttccccagtcgggggcacaagcgcgcggcagcgtatcttgaatatggtctgtcgcaggaagatggtttcatcattattacaggagaagtgggcgctggtaaaaccacgctgatgcgctacctctttcaaaagttaaagcgagaacgggttgtcgccgcacagctggttagtactcgactggatccagatgatgctttgagaatggtagctgctgcttttagcctgccttacgaaggtttatccaaggcagcattattacttgatcttgaacgattcatgcgcaagtgtgaacgggaggggacaagagtattgttggtagttgatgaagcacaaaaccttcaaccacagacactggaagaattacggatgttgtctaattttcaatcagataacaggcctttgttgcagacttttttacttggccagccagaattcagaagaacattgcttggcaatcagatgcagcagcttcgtcagcgcgtgattgccacttatcacttgggtccactggatcaggctgaaaccagagcctatatcgagcatcgattgcaaaaagcaggctggaatggaaatcccgtgtttcaagatgagattttcgagataatacataatttttctactggaatcccacgtaaaatcaatatgttttgtgacagattgttgattatgggatgtctggaagagttgcaggctctaagtaaagccgaggcaaacgaggttatgcttgatatacagaaagaatttgatctaaccgtttctcctgaataaatcctatgattcgtaatgcgttgactattgatgtggaggattatttccaggtatcggctttcgcccagtatatccctcgctcatcctgggataatttgccgtgcagagttgaacgcaacattgatcggattcttatgttgctggacgagcataaaatcagggcgaccttttttacactgggctggatagcggaacgttacccagccatggtcaagcgaatcgttgagaatgatcatgagctagccagtcatggatatgcccatcatcgtgttactgagctgagtcgcaagcagttttatgatgatattacccgcagcaaagcgttactggaggatattggcagccaatctgtatggggttatcgtgctccgagtttttctatccgcggagataatctctgggcgctggaatgtcttgaggaggctggatatcgatacagttcgagcgtttatccagtaaaacacgaccattacgggatgccagatgcacctcgttttgcttttaatcccgagaatgccccggggttgcttgaattgccggttaccactgtacgactgtttggacgtaatttcccagcgggggggggcggctattttcgcctttttccctatgcaatttcacgctggtttctgcaaagagtgaacatgattgatctccagccggctatcttttatttccatccctgggaaattgatcctgatcaaccccggcagacggggattaattttaaaacacattttcgtcattaccttaatttaggtcgtatggaaaaacgattgaatgccttgacccagcatttcgaatgggggcgcatggatcaaatttttttacaacggacaatgtgaatctcgatagtagaactgtgcaaaacaccaatgatctgttccttggtaaattaccagatatttctatcttatcgccagataagttccaggcatgggacgagtttgttagagcctgtcctgatgcaacctttttccatcgttccggatggaagtctgtcatagaacaggcctttggacataaaacctggttcttatacatagaagaggatggatgtattcaaggcatacttcctctagcagaaatcaacagcttactatttggacacagcctgagcgccttgccgttttgtgtatatggtggtattgcagccgtgtcagacggcgtacgagccaagctggatcaggcggcgcagatgctggctgcgcatctgcaagtcgattatctggaatatcgccatgtaactccttttcatcaggattggccaaccaaggagctgtatgttacgttccgcaaaacgatagatccggatgtggagcaaaacatgctcgctattccgcgcaagcagcgtgcaatggtgcgtaaagggatcaaatatgcgctgcagagtcatgtggatcaggatatcgaacgtttttttcatgcttattcgaccagtgtgcatcgcttgggtaccccggttttttctcgaaaatatttccgattattaaaaactgtttttgcagaagattgtgagttgctcgtcattaccaaagatgatcaaacggttagtgcggtcatgagtttttatttccgggatgaggtattgccctattatgggggaggggcggatgcagcacgtgatttggctgggaatgattttatgtattgggagttgatgcggcgtgcctgcgagcgaggttacaagatttttgattttggacgtagtaagcaaggtaccggatcgtatagtttcaaaaaaaactggggattggaaccgcagccgttattttatgagtatcagcttcttcgggcgaaggctgtacctgaacataacccactcaacccgaaatatcggctctttatcaaagcctggcagaagttacccttgacgtttgccaacttgattggccctcatattgttaagaatcttggataagaaggatgcaaggactgctttatctgacgcacagaatcccttatccacccaacaagggcgacaaaatacgttccttccacctcctgcagcacctgagtaaacactatcgtgtatatctgggaacatttatcgataatgaagaggattggcaatacgagagggaagttcgaaattattgtcaggatgtatgtgttgtcaggttggatccactaccagccaaaataaaaagtctgcttgcattatctggaaatgatccactgacgctggcttattatcgtaatgcgagactgatgcagtgggttaaagctgtatcacatactgagtccatacagaatattgtgattttctcttctgcgatggcgcagtacgttgaacatttatctgatcgccgtcgcattatcgactttgttgatgtagattcggataaatggcggcagtatgcgctatcaaaaccctggcccttcaactggatttatcaccgagaatcaaaacgtttgctcgattacgaaaagaaggtggcaggagagttcagcagcgcaaccttcgtttcaaagaaagaagctgaattatttagacagcttgcgcctgattcagcgaataaaacaacattttttaataatggtgttgatactgactttttctctcccgcacgcgattatcccaatccttatccggctgggaagagaatattggtttttaccggtgccatggattactgggctaatatcgatgcggtaagctggttcgcaaattcagtatttcccgctatccacacaaaattaccagatgttaatttctatattgtgggtgccaaaccagccagacaagtacagctgctggcagatctgcttggtatccgtgtgactggagcagttgaggatgtccgcccgtatcttatgcatgctgcagtagcaattgcccctttgcggattgcgcgcggtatccagaacaaggtactggaagcaatggccatgcaaaaaccggtggttgtttctatgcaggcgatggagggaattcacgccacaccggggaaagaactgatggtggcaggagatgccagggattttgctgaccagattctttttcttcttgattctaacgatcaaacaactatggggcgggctgcccggaaccgggttttgcaagactacacatggtcagctaatttgtcacggattgatgcgctcttgcagccctctatcccggctaaggtttaaagagagtatgccgttcacatccatcaattaaacgataacagtaaatcattttaactgacagttctactatgggtacacaggtgcagttacgaaatgccgcgctaagcagcaataccataaacgggcgaagagaggcagtattgattacactgctggtgattgctttggtgcttggtatttaccacgagactatcgaatcaatcgtggcgatctggaacagatctgaaacttatgcgcatggttttctgattgcccccttcagtatctatatgatctggaaaaggcgtgcagtactggctacagttaagtaccatcctgattatatgccactgttggtattggccggactggggataggctggttgctcgcctcagcagccggtgttatggtggcggaacaatatgctttggtagcgatgataccgatgatcgtatgggccatgctcggttttcatgcctttaatacgattatttttccgcttgcctatcttctgtttgctgtcccctttggcgaagtattcatcccgccattgattgattttactgccgatttcactgtcagtgcactacaggcaaccggtattccggtgtatcgtgaagggagttttttcagtattcccagtggcaactggtcagtggtggaggcttgcagcggtgtgcgttatttgatcgcttcggtaacactgggaacgctctatgcgtacctgacttaccatagcctcagcagacggctgatattcatcgctttttctatcgtggtgccgattattgccaatgggctgcgagcctacctgattgtcatgacgggtcatctgagtgatatgcggctggcagtcggcgttgaccatctgatatatggctggattttctttggtctggtcatgttgctgctgttctggattggttcgctctggcgggaggatcaccttgatgaaagcatgtcagtcgacaattcttcctcagctgacctgagatttccttccgtttctattaaagcaacgctgggtatggttgggctggttgtggcgattgcctcgatctggccaatgtatatgaattatttgaatgatgaatctaatccgcagcagatgcctgaaatcaacattgtagatccttctggtaaatgggaatctgattccactcgatcccccaactggacgccgaggtatatcggttccccggagcaattcatcggtcatttccaccatgaaaatcagcgtgtcagtctctatgtgacttattatcgcaaccagcagcaggagagtaagttgattagctctagtaataccctggttactgatctgagtagtgggtggcgcaatgtaggcgagaatgagagaaaattaccgttaggtgctactgaactgtctgtcaatcaggatttgctgcatgcggcgacaagccggttactggtatggagatggtactggctgatcgaccaggaaacagccagtccttatctgggcaaggcgatacaagcgatgaactggattctggggaagggggatgacggggcagaaatcattgttgctgctgcttacgagcatgatccggaagaggcagcatcagtgttgcgagagtttatcggtgatatgaagccagtgattaatgagaggctcctggctgtgcacagcacgtaccgcgactaagcgaagtgcagcccaggaagatatttcgccccccattgattgcccatgtaatttttcattttggagtgggcggactggaaaatggtttagtgaatctgatcaaccatattcctgagaaccgttaccgccatgccattatttgcctcaaaggattttcagaatttcacaagcggcttaatcggaatgatgtcgagatcattgcgctgaacaagcgcgagggtaatgattttagtatctatggagaactttaccggatatttaggcgactcaatccggatattgtacatacgcgcaatcttgcagcgatggaggctcaggtggtggcagccgtagcaggtgtgaaggcgcgaatacacggagaacatgggcgcgatatctttgatcttgatggcaagaatcggaaatacaatctgttacgcaagataatccgcccgtttgttcattattttattgctgtcagcaaggatttggagcgttggctaattgatacggtaaatgtgtcgccagcacgagtacaccagatttataacggcgtggaacatttacgtttccatcccgatagcaccaccctaccaattgaagcgtttccttccggtttttttgatggaggaccgtttgttgtgggtagtgttggcaggatggtggaagttaaggatttcccgtctctagtgaaggctttcttattattgcgtgaaaaaatacctgtaacaggcaggccgttgcgccttgtgatcataggagatggcattgcgaaaccacaatgtgaagccatactgcgctcagccggagttgaacagcttgcctggcttccgggcgagcgttcggatatccctcaattgatgcaggcgatggatctgtttgtgctcccttcgctggcagaaggtgtttccaataccatattggaagccatggcaagcggcttgccagtcgtagcgacccgggtaggtggtaatgccgaactggttttggagggagaaactggttgcctggtctcctcaggggatcctgccgctctggctcaagtaattgataaatattatcaggatgatgcgatggcgcacaggcacgggcgacgtgcacgtgagattattgagcagcaattcagtatgcatgccatgacgaatggctatcttgcagtgtatgaccaggtattgggtcataatgctgctcacgattaaagattggaaagatcaaaaagatcaactgactggataggaatatgtgcggcataacgggggtatttgatacgcgcggcgggagtgagattgatcgtaatctgcttcattgtatgaatcagacactgacacaccgtgggccggatgagggggaaatgcatgttgagcctggtgttggattaggacatcgtcgattgtcgatcatggatatatccagtggccaacaacccttattcaatgaagatggcagtgtggtcgtcatattcaatggcgaaatctataattttcagaagctggtcagtgagttgacagctttgggacatcaatttcgtacgcattgcgataccgaggtaatcgtgcacgcctgggaggagtggggtgaacgctgtgttgaacgctttagcgggatgtttgcctttggcgtatgggatcgtaatcagcaaacgctatttatggcacgtgatcggctgggcatcaaaccgttttactataccttactggataacggattgtttctgtttgcctcagagctcaaagcattgctggttcacccggattgtgacaaaacattggatcatcaggcgatagaagattattttgcctacggttatatccccgagccgaaaaccatttttaaaaacacgtttaagctgagtcccggatattcattattattgcgtcaagggcagcagtcagccttgcctcgtgaatactgggatataccgtttgcatcacatggcgcattgagtgagcaagaagcggcagaagagctgattgtccggttacgaaatgcagtagatagtcacctgatgagcgaagtgccgctgggcgcatttctttccggcggagtggattccagtgctgtcgtggcgatgatgggcggcctgatgaaggagcctgttaatacctgttcgatttcttttgctgatcctgcttttgatgaatcagattatgctcggctggttgcggatcgctaccagacccaccattttaccgagcaggtcaaacaggatgattttgatctcattgaccggttggctgcgctgtacgatgaaccgtttgccgatagttccgccatcccgacttatcgtgtgtgtgagctggctagaaaacaggtgacggtagccctttcaggcgatggaggtgatgagaattttgccggttatcgccgctatcgctggcacatgatagaagagcggttgcgttctaaattaccattaggattgcgaaaacccttgtttggtctgttgggtaatatttatcccaaggcagactgggcaccgaagtttttgcgtgccaaaaccacgtttgaatcgcttgctcgcgattctgtggaaggctattttcacagcgtatccattctggataataaactgcgtagacaattgtttactcgggattttcaccatagtctgcggggttatcaggcagttgaggtattgcgtagttatgcggacaaaagcccgacgcaagatcccttgtcgctgattcagtatctggatatgaaaacctatcttgtaggcgatatcctgactaaagtggatcgtgccagtatggcgcattcactggaggtgcgcgtcccgctgctggatcatgaactggtcgaatgggtttcaggattgcctgcctctatgaaattacgccaacaggaaggaaagtacattctgaaaaagtcgctggaaccgtatttgccgcatgaagtgctttatcggaacaagatgggatttgccgtgccgctggccagctggtttcgcggcccattgcgtgaacgtgtgcgtgctgcactgcttggtagtacgctggcgagcacagggatttttgatatggtcttcgtcaaaaagatgttggatcagcatcaatccggcagacgggattatagtgctcctatctggacattgctgatgtttgaggctttcttgcgcaataccctcaatgtgggaaatgtgtcatataccgaacaaggccaaaaggttgcctgatatcgattcaatgcaatacagatttcccggcagggatgcagaatagctcaatgctgaacgtctacctcacagttgataccgagttatggccttattccgagggttggccggtgacggctttatcaccggataaaacaacgtttgatgaagaaattgcagcatgcttttatggtaaaacatctgaaggtgaattcgggctgccttttcaaattgagcagcttaaccggtacggcttaaaagctacttattttctggagccactgtttgctgatcgggctggcagtaatcatcttgctgatgtggttgatttgattcagcgtaatcatcaggaagtccaactacacctgcataccgaatggctcagtgaaattcatgatccgactcttcctgcctgttttaagcaatacatgcatcaattcactttggacgagcaggtggctttaattgcaaagggaatgtgcagtctccaggcagcaggtgtaaaggagctgcatgctttccgagccggaagttatggtgctaatcgggatacgttacgcgctgcagcgcaaaatgggctgttatttgattccagctataacccctgctatttgggtgaagactgcaagattgatctggatgggcagctgttgcagccactcaggcttgagggcgtatgggaactaccaatcacctttttccaggattatcctggacatcaacggcatgctcaactggcagcatgttctgcaaaagaaatggaaacagccctattagatgcctggcggcaaggctggttttcatttgtgattgtcttgcatagttttgagttgatcaaaggcagaggtgctggcagattgagtttgccagacggactgaatatcaagcgctttaatcatttatgtgaatttttatctaaccatactgataagttcagaactgctctattttccgagcttgatccagcgacaattcctgaaataaagttaccaaagatgttgcgctcccgtccgcatcatacgatcagacgttataccgagcagatctattcaaggtttttttgatggagaaatggtccagacaatcaataaattttaccgtgcgattgggggaaatcagacttcttacctggccactgagtgcctgtgtactgaaaaggcactttactgagctgccgactcatccggttgtgctagcagagctcccagagttttttgggaactctattgatgtggtgatgatacgctctcacccaatagaatcacctttacccaggctaaacatattgccgcaagcgattcggtatattccttcaagctatcagcgatactgggttgtgctcaatggtggctttgaaaattatctgaagaaattttctgccaaatccagaaatacgcttttacggaaaataaaaaaattttctgaattctcaggaggggagatcgactggaaagagtattgcaaaccggaagagatgcacgaatttcataagctggcaatggaagtttcactgaaaacttaccaggaacgattgcttgattgtggtttgccttctgatcagcaatttcaggaaagcatgctggggcttgccgcagcagataacgtacgcggctatattcttttttatcagaaaaaaccgattgcctatatttattgtccagtacacgacgagattgcgctctacgaatacgtgggtcacgacccggaatatcaacgctggtcgcctggaactttacttcagtactatgctttgcaatgtctatttgtagcgaatcacgtgaaaatatttgatttcacggagggcgagggtgcacataaggcattttttgcaacgaatgcacaacattgtgcggatatttattattttcgacgtacttggcgtaacctgattaaggtggcattacatgctggcagcgatgaattatcgcgtggtatcgttcaagtattggagaaactgaaattgaaagcctatatcaaaaaaatacttcgatcgaccgcataagatcgtattatttatttaccctgaagatttatgtttctgcaaaatgcaccccttccagcatcacatagcacaccgcgactcgatgatgactgggaatggcaagatctggatcaattcgataccacagcgcgagcccaggctttgttggctgttaaaaattttattcggcatcactccgctgcagttatggatcatgacccggattggctttataccaaatgtagttatgacaaatcagtcaaaatctttttgtgttttgcacaggatggctcgttatccgggtacgctccatttttcgtacatccatcatctttgagttttgaattatttggtatttcgctctgggaataccggattcaccgttacagcatcacagcaggccctttattttctggtgaggtaaaaatagaggatgtttttattaagctctttgattatttgagaaaaactctccggaaacgagaaactttatttgcgttgggcgtagaacttgattcatcgtttggtcggtttctccagaataatattaatctgcaaaaaaaatatcagttgatcccttcaggacaagcctattgcagaagattaataacattaccggaaaattttgagcagtatatccagaatcttgggtacggcactcgtaaagaggttaggcgtgtactgcgacgttttgaacaaaattccgaacttacaatcagctaccgtatatttacaacgtctgaagatatatcagaatttttacccttggctcagcaggtatcagataagacttaccagcataatttacttggtcttggtattcgagacgatattgaaacacgtcgtattcttacaactgctgcggaaaatggctggtttcagagttatcttctaatttgtaatcaggaaccggttgctttccagcatggttacgcttatggcgggacctattatgcggaacagaccggctatgaccctgcttggggagataaatctgtcggtacaattatacaaatctatcggattcgtgatctgattaaccgtggaatcacccagctagattttctatatggagacaatgaaaggaaaagaagcttgtctactatgtatcgggtagaacagaatttccatctgattccgagaaagttcccactggggatacttgcttacgccctacgcggattcaatacactttcccagttagggggagattttattgaaaaatggggattaaaatccaaaattcgccgttttctccgcaagtggtcagttagttgaagttaggtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcgtcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacagttagggtctgttccccgtacttgtttcgtatttttaatatggataggcaaatgttgagcgatatatagcggggatcgcttgcggaactgttatcagacaaattgacgaacggaggtatctgggccgaggacaactgacatttcatgagagacgtactgcagtaccgcttccattggtgagacctgccaaaggtgatgtgtcaacacttttctggacacaaagttaagcagcattttgctgcaactcgaaatcaacaggcgatatatacccattagctgaatgcaatcgctctcggttgtaaaacacttcgatatattcaaacacagcctgtttagcttcttcccgagaatgaaacgtttgatgatggatcaattctatttttaaggtatggaagaagctttccgacacggcgttgtcccagcaattgcccttccggctcatgctttgttggatgccatgctgctttagtaattgccggtgactttctgaggcgtattggctacccagatcggtatgccataacaggcctttgtcgggtttacgtttccaaatagccatctggagcgcatcgttgactaactgtgttttcatatgcgcggccattgaccagcctacgacctgccgggaaaataagtcgatcacgaccgccagatacaaccagccttccagggtatgaatataagtgagatcgcccacatatacctgatttatctgatctatggaaaactgacgatccaaataattaggcgcaataggcaattcatgctttgaatgagtggtagctttaaatcgacgtttggttttacaggccagtccggcttccttcattagccggcttattcgccgccgacctacggatcggccttggtgagacatagctattttgagacggcgggtgccgtatgtattccggctttttttaaatactttttttacaatactgctgagttgctcgtcttctcgttccctgaatgaaggaattcgatgcagccaatcatagtaagcactctgtgagacctgtaaaaatcggcacatcgataacacggtgaattcaccttgatgctgtttgatccaggcgtacttcaccgttgctccttggcaaagtacgcggcagccttttttaataggtcgcgctcctcggtcagtcgggcaacctctttttttagccgctttaactcttcatagagatgttcgtcagtgcgcactgcctttatgttatcaaccggtcgactgtatttactgatccaggtatgcaaggtgttttcattcacgccaatttctctggcggtttgggctacaggtttatccgattcaatggccaactttaccgatgactccctaaattcagctgtatagactttgggtttttcttggatcatttaaatacattccttctttcagttattttaaggaatgtgtccggtttagtgtagccacatcaagtttggatggtgttctaaaccagagggggcaaatttagattgccgatgaagcagtaaaaggggtcaaaattacattgccgttgacaattactgtatcattactagtattatgacatgcaggtagagattatgtttgacggcaggtacggtatcccgatacattttttgaacgaatgaaaaaatacgtctgcatttctgcatttctgcatttctgcatttctgcatttctgcatttctgcatttctgcatttctgcattgctccaatgcgattctaccaactaaggatcgcggtatattctattgcttgatatgagtaacgtccccaagcgtattcatccacttatctctatcgttacgccattctataattcgattggtaaagcaaatcgtcttttgtctacatttgctacgatgagcgaccccgatgttgagcttatatgggtggacgacggatcaactgacgagacttggtcatatctgcaaaaatacaaagataagatgtgctgtaggtgcattgtcgtccagcaagagaacaaaggaccagggggcgcgcgtaaccacggtctgtcattggcatccggacgctacatatggttcgttgactccgatgacgacatcaatccctccgcaatcggtactgtgagacgcttgggtacctgcgattatgactttatcgactttgaggtgaaacatttttccgatgacgaagggcggatcaagccgtcagcgggtctacgagcgggcgccttagaacttcttgagggtgaatattacaccaagaaggtgactcgctactctctgttacacactgtcggctggctctggaccaaggtatttaggcgagaattcctcgtaaatcatggagttttctatccagaatattgtgtttacgaagacacgccgctattcttctggcttccttttattgtaaagcgattctacaaatctaacgatgtcgcgtacttccatcatcaggaacaggaatctgttaccagatctgtgggtcacaaaggtcctcgcttctatgatcgcctacctactgcttcatacggcctcatgctgaccagtaggtttacttgtagtcgcagtgagcgcttgctcagtgaggaaaagttcaaactcatttttcttcttcataccctcaagattctctacatctccggtgattggctaatgatccctcgcgtgatgaggttttaccgagaagaggcacgtcgacttggcgttagtataagcccactgcggatgatttctaaaagccgactggttttattcattgctccttggttattatcgtacttatacccatcccagcgtaactactttgataagcttcatctacacgcgtggggggtacccatacaatatcccacatctgagaatgtgttataaatggtccatcctgaaaacgcgcactgcgctgttttaatggactaattcctttatttatcgagcgtatattttctggggcgactacttattacaaatggcgtgctaaaaatacggtggtatggatactgagatgatgaagcgtttaagagagcttgaagacgaaaatcatcgatattagaaatatgtatgctgaagaatgattaaaatctcaactgcgccaggaagcacttgagggaaagtggtaaagttatctttacaaaaaagagatacacaggatgtggttgagcagcaaggcatcacaattacattgatctgtgaggcatttggtataagtcaaacgtgctacctctggcaacagaatggctctggacaatataataggatacctcgaaaaacctgtaaattctgaaaagatttatatgtagcacattgattttaaaatcaatttttttcaaaaatagggtttttcgaggtggccaataacgaacggtataactcagctgaaatgtcggttgtcctcggcatcgatacctttacctggtagtagctctgcgatctgcaaccactgtgtatcgctcaactattatttttttgcctataacagagtgattacggattacagcgagtccgtattatttaacaaccgagacagtaattccggctttgcgcaggcagcgcagcagaagatgattgctggtactgacgactatccagccaattttgaaccagccacatttcttgaaagtattcagtgaagcgacattcgttgagcgtatatgtgtcacgatcctggaatagccatgcttcttaatatcctcgcacatcatttccagtagtaatgctgcagcacctaatccacggtaatgggggtgggtgaataagtagccaaggaagacatctccagatgccagaccaatatctaaatccgttggtgaatcgactcgaataacagtgctgtggctgatatttgtttgtgatacaacttgtgttccatcaatcaatgcatagatactggcatcgtcttgaataagttgtgtaacgcctcggccactttgtgaactgatttgttcgatcagttcatgcggatgcatggcaatatcctgagtggagtttagagaaataaagtggaatgtctctgttccggattttttgacaagaggctgtggcaacgacgcctgttgccgagtcaaatcagttgcgtagaaaaaataaatctctactctacatagtattttaatcagccagaatgctgccgccttgaaccctcccttatatctcaagagtgccagtctttctcgccaggcattcatgatattgatttgctaaataaagtaaaagtaatcattaccaaccccaatcaccccgccaggataaagtaagccatcacatgcggtggctgctattcgtttagataaaaatatcaatcttacgcatcaggttagccaattttttttggggccagctcaattgttcccagtagcgcggataagattggcgccgtaccaattcgatttcttctgaccaaaatcctttgcgattcgcgtgttgatgcagatctagatcagcaatttcattgttttcgatgatgacaggaccccgttcagtcaaagcgatatcccaatggtggagattcatccccatgagatagttttctgcttgttcacaaatttctgttaattttggccagtctggcaatatgtatcgatcgaatggtgcgccggtatcaggatgaatagtaactgcctcgatctttccgttaatcttgccaacgactcgagtgatctggccgttagttatgtttacaccccccagtaaatttccggaagcaccatgctgaaagttatccaccatgttcgatccgacaggaatacgccatactgcactgacaatggcatttttgctattaatgcgggcagaagtgacacgtatgctgctgacgcgagggccacagacacgctcaatttccgggtgtggtttgagctgttcttgaaacagaatgccgtgtgaagattttgggttgagtgacttgatccattcaatcacgttatgttgctcgccgttcaaaaaaacgatgctgtctgattccggtgaatacttttgtaagcccagagccccccagccataagcactatgactaggtttgacaaataatgggtaatgctggggggtgcggagataagcagcagtttcatcgatattgtttaatgtaatggcacccggcaaatttctaccatcgagatcatatactgcatgaattctgggcatggggaggtccgttgccatcatgaaaagtgtcatcggtaacttttcgcccagcatgaaccagcgagtgtcattacacacatagttgagccggtatttacggccatttcccagaaatttattgcgttcttcagcgctcaggtcatccagttcatgcaagcgataatcaatatactcttgaaacaacaagcgctgcgaaccaaagcgcatgcgcagcacttcagataatgttgcgaaaggtgtcttgcgagcacgtttgccaaacaggatattgagaatattcatgcggtgccttaaagtgattgaaagaacatcaatgaaattgagtgatgaaatcttcccagattgcatcttccggtcgcatggagccctcaacccaaacgggctgcgaagcctgatcagataatttccagtgtcccgggcatttcgcaatcgcccacccttcgtagtaataactaatttctgcgatgacaggctcgccgtttcgtcgcagaacatcgacagcgagtgactgggtttgcagtatttttgccgtttgaaaagcaaggagaagtgaatccaatggaatttgagtgggatcccaatctatgcggccgctaccgcttgcccgaaaatctcctggtcgattatatcgtttgaatgcaaaggcacgattaccgatgatggttatacggatatcaaagtcatttccaggcaggaactcttggagcagcaaatatcctttatgaaattctatatctgttttctgtgatagaaatatccgtgctgcttctcttgcacgcctggcgaaccaacggaagggcagattggctggtggcagtgcgtacataccggaatcaaacagtgcataagcgtggtggcttgcctcacggctgttatgtacaagttcaacattcgttgaaacgataccggaagataattttagtaccaatggataattagccgaattaataaatttatccgcctgtgattttgaccaaaatacccaagtttcgggagtagggatgcctgccagttgcagaagataagattgcgctaccttatcgtcaaaatgccatatcgtattatgattgggaaatgttgggattttattgatatgtgccaaggctgcgattaatctgcggccggggcggctaaccgagagtggttggccaaaccaccacatgaacccatcacaatctttgagttgatccagccagttagtcgaatcagagaaaatatcgatatcttgggttgtgatgtcccgctgtgcagccagctcatgccaatgtgtcgaaaaggactgccaacggttacttgaaagatgttggtgatcgtgttgaatggcgataattagtttatgcattatcgtaaagaatcaaattttttcaggaagggggtaatttttctggtgatccacgagagttcacttaagtaagatcgataagagtaagcaagtacttcttcgagtttcggtgaacgaaacccttgtcggtttgcatattgatggacatccatgtcaccgaatacgttaatttccgtaatgatggggccttggtcagtcagtgcaacatcccagttttgtaagttaagtccaatcatggttctgcccgccagcatcaatgtttcaacgatacgttcccagttcgggattatgaacccttcgaacaggtaacctgaatccggatggcaggttacaaggctaattttactgtccttccggccataaacctgagttactctgccagtttctatatcgataccaccgagtaaattgccggatactccatggcaaaaattatccgtcatatttttcccaaccgggattcgccagcatgcactaataatttcaattccttttgcggtgcggcctgtcgttacacgcaagctggagatggcttgaccacagatactggcgaggatctttcctggtcttaacagcgcctggaataggatggtttttggctgctgatcaattttatgagcaaaactatctagcggctccctatctccgttgatataaatcagctctctggattgtttatcatagccctgaactccggatgcaccctccccaagcattccgtcatccggttttatgaataatgggtaaactgcctggttggtgagatattcaataacagtaatttcattacttaatgccgctacgccaggtaagtaataagtggaatttttgtcgtaaatcgcgtgaattttaggtatttggaatccaccacccatcatgaattgtgtgaatggaattttgtaatgcagcatgaaccattgttttttattgcagcggatatgcaggcgccattttctgtcttccccgatgaaacgtttgcgttcctctgtggttagcgtctgatccgtatgtagttgataacttatatactctctgagtgataatctgtgcccgccagccctcatgagtagagcttcatataatcgaccaaacggttccgggctttcacgtaagatagtcagtagttcatgcatggcaattagattcctaaagatcttaatgaaaacatcatcggcgaactagatcaataacctcatggtagctgcgtttgttgaaaaacaatgtaagacttccatataccagtattccagtgacaatcaaaatcaatagttttgcccattgatcaacatgatctgctagcagtatggctgttgcctgtactgccagatacattccaatggtggtgcccatggctggcatcatggcataaaaaaaatcagacaatcgtagctctattacccggagcatacgctggatattgataaaaaatactaatggataagcaataacccagcttaatgcaacgccctccaacccccagttgcagccaatcaggaaagcgatcggcataacgattgaggccaggagtacatttctcatggtgacatcaggcctgcccagcgcatcaacagcagaaggcaggaaatttgcaatcatacgtaaaggcatcattagtgctagcagttgcagcggcaatattgcgttatgccatttttctccaaggaacagctggactatttcatcagcaatactggaaattccccatagtatggggaaagccaccaggctaagcattcgggctgctttaagtataaaactaccaaattgttcacgattatcctggattctggaaaagacaggaaatgcaacctgattaatgattgcggaaattcgctgtacaggtaatgaagcaagctgcatcgcaatagaataaaccccgagcgtttccttgcccaacaatttgccgataatggcaatgtctgcctgggtataaaaaaaccaaagtaaacgcgataaggtgacatttccaccaaaagacagaagattacgtatactgactatagaaaattttgggagaaaatgcaatggagctacaacgttcattgcgattacgctgagtatgccggcgaacagattccccagaacaagcgcccatacaccaaattgtgcgaatgccagtatcagtgtcagtatgctcccaacgatcgtcgttaaaaagctaatcagtgacaaacttctaaatttcagctggcgatacagctgaacgctgggaagcgtaccgaagatagtcaataaaaattgaagtgacaaaacatgcaaaatcagtattaatctttcctcatcaaaaaaagctgcaatgaaaggagtcaacagattgagcaatagcagcagactaatatttgcgatgatgacgatggcaaatacactgcgtaaagcagtttcgtcaagatcctgtttctgaatcagtgcagggccaagcccagcctcggacaacatcaacatgaaagcaacaaataccgatgccatggccagcaggccgtagtcttctggtgtcagcaaacgcatcacaacaagcgtgattgcccatgtaatgacctgtgctcctagctttccacccgccgtccatttgagccctgtcaatacctgctcgcgcactgtcgtcatatgatggttatttcccattgatccgatgaagttaaatccaatttaaaatctgcggataaacattcatcaagatttttaagttcggtacctattggtaaaagagatgaagtgcggtggtgacgagtacaagaatctctcttttcttgtttggcgctattaaatttgattcttatttggtgcaactttagaccagtatcgatataaaattcctggggtttggagcagatatgagcgatcactttgtctgaaccgcatcagaattgtccatagacgtaggtaaaaaaggttcaaatactggtgtgagaacaccgaatctcgactaagctcttttgcatatttcaatgcatgcagtttgttctgtctggttgcttcagtacttgaattccattgatatgtaaggccctctggttggggcagtgggcaaggcatgtgacctggatatgcttgccatggcacttccagcactgctttaggaaaatagctcaaccattccatatagaaaacatggcgtagaaagggatctatcgggagtttaatgatttctgcaataaagttggaatcaaaaaatgggagctcaaattccacccgtcccaaatctatgttctcaaaatgattaaacatatgtcgacgctgatcattcagcatcagaaataagtaaaaaatccgtccaggatcacctgaatggattgaatccagctcagatcggattccatcattgaggaaattaattagggttgaggctatcttcggtttcaaaagcttagtgcttatcccgcaattattataggtaaaaaattctttctttgccctccccatatccttttttcgtgaggcttggataatttctggatttagatatacatgcccaaggcctacgctacctccatcaccagaccagataacacggggcttaggtagcttcttgtccgtgtaagtcgttgaatttatccatttgtttacggataacttgtgatatgaatctcgctcatcttgtttgcctatctgcagatgggtatgatgagttcccagcttttcagcggcaagttgcccaaatacctgatcctgactaccaagtggggcaaaattggaggtgactatcgctacatcaagacttctcagtgcgccaacgatggcgcgagaatcgaggccgccgcttaaaaatgccgcgacagttttttgttcctgcagccgtattttgaccgaatcaatgaatattgtatgaaggtgtttagcagaagtacctatgtcactatcactagttttttcgatgggtaacttatcccattcccagtacttttgccggttgattgtttcgtttgagaaactgattgtttcgccggcatagagcgtaaatatattttcataaggggaacgatcggatagcggataaccaaaacacgcaatttctgccactccctgaagattcaacgattttttctggaaggataaagcttccagaattcgtaatgcagtcgagaaaatgatgaaatcgggcaatacccaatagtaaacaggccggacaccaagcttgtctgttactaagtgaagtctactgtttgcatattcgtagatgaccgcgcagtaggttccgcgacaagcataaagagcatccagttttccggctgccagatcaaatgccagattttgcagactttccgcacgcggccctggcatcatactagggttagcttgatataaggggtcacccgccgcaaacgcagtcagctccttgttagaaaaacttcctggctgtttcaatacatcgatatcaacttttgcgagataaatcccgttatcagtaaattctattacagcatttttatcatcaggatgacgtgatattgccgttcgaagctcacttataagcgaattaggtataattttatctttatgacgggcgagaatccctgcaaaaattgtcattgggaagtagtaaaaagtgaacaagtaaaaatagaaaatatacccatcaattattttttaattgtagagagctcttgctgtaaagatggttgcagctaaggtgtggcaatcgtgccatttcaataaatttaaagatattgatatataccctatcttatacaacttacacttaaatcattttaataaagactagcatctttctgcggatattatcgttctaaaattaatacagtttcttgttaaatagcctgttatagcctgtttagatgaggactttattctatcctgtttgattttaactaggaattccgggagcagtcagtcaagttttttagagcaagtggatttgacgataaatcttgatttggcgagagatagcaagtaattgtctagaatggatcgctcgatgcaaattagatttgaacttgtatttgtgcttgataccatggctgatgagtagtaagaatttaagtttttttctaaatagtaaagcacaagctaatgattgaatggagtttgaatgttatataaagcgaaaataacagcagtattgtttgtttttttttctagcattgtagggacatatattttttttgactggcattctgacaataaaaaattattagattttgctagaacgatcgtacatggtaatagtgtcactggctatgatatcgagcaattgaacgatcttatctaccatactggtggttttgctaaaaataatgactattttcttttgccgtcacttggcccgactcctatccagatattacagaaaggaggagattgttccgataaatccagattattagcagcgatcttggacgagatgaaaatttccgcaacattggtaatgctggccccgtgtgatggttgcccatttggacacaccgttgtggaagctcaagctgctgatggtgctatagccgttgatcctgtttataacatttcttttccttcatcaaacgggcattactatggaattaaagatttacgcgataattccaacattcttcaggcaagacttgatgagcttattttgaaacgtggttctagggataaggtagcattctatcgaggaggggctgatggtatacattattcctatccagttaccataaattgggagaagaattttttgacgcgatctattggcaaatttttgatgcagtatacggatgatgcttctttagtttatcgtccaagatggcttgaagatccgaaacttttgatgtctggtgtccttggagttatttccatttttagctttcttgtttttctggtgaccattcttcttccctaccctaaggttataactaaccgataacagcagatttctaccttgtctttgcgagatattgtcttaggtatcattatccttgttgcaggtttgtatgcactgcgccgagcatggattggagtgttgttgtggacttggatcagtaccatgaatcctcatcgttttgcttggggattccttgcctctgctcctgttgcagcattttctgcaggggtggcgttactcggcctggcgtttactaaagaacgacgatcgccttttataggtttgcctgtcaccattttagctctctttgtcgtgtggatgactatatcctggcttatgagtcgtgatatttcagaggagtattggacttggaatcgatctgcaaagatctatctgatgatatttgtcaccctggccgtgctccaaaccaaggagcacatcatggcgtttgcctgggttctgattggttcactggcagtattaggtgctaagggagggttctttacacttataacattagggaattaccgtgtatggggtcctcctgattcttttattgcgggtaataatgagtttgctttagctttgatcatgattattcctttggtatattttttgcagcttcaggttacgcaaaaaatgtggcgtcatacgcttagtgtggtgatgttactgtgtgctgttgctgctttgggatcgtattctaggggcgctttagtggctattgttgccatgggatgtgtgttttggtggcgcagcccaaaaaaaggagaagttgcggtatttatcttcctcattgcgattgtaatgattccaatgctcccggaagaatggtggggacggatggatactatctcagaatatcagacagatgcatcagctatggggcggataaatgcatggggagtagcatgggaagtagctaaacatcatttttttggcgctggaatgagctatcagtatccggattattttttactttatggaaaatatgaagcgattgtacgagctgcgcatagcatatattttgagattttaggtaatcatggttttatagggctattcctctttcttcttttgtggataaccacctatcgcgatgctggatggttaagaaaaaatgcacgtaatgaaccgcatactttgtgggctgctcaactgggagctatggcgcaagtcagtctagttgggtatgtagtggggggggcttttttaagcctgggctattttgacctgccttataatcttatggtattggtagtaatgactaaaaaatgggtaacttctaagacatggcagtgtgaagaggtaagtcataaaccttgattttactttcttcctaaattttgaatagcctgtttcgcttgtcttatgtactcgcctccggaaaatctattatccccgatgaaatggataagttttgcgtgagcaatattgatccctggcttccagtagggatagtgttcgaaaggtagcataagagcttgatcggagttagcgatcagaaaattcgatgcaacttgttcacttccccactgtttccatgtatccagtccgccaagtagttgctccattgactttgagaattgtttcaaatcctcaatcattactgaatttcttccgaatccggcaaaaccagagcatccccggacatagcgtaaactctcggcatttgggagctttctcatggcacgctccgccaagatttgcacatggctgctatcaatgttatcggcaaaagttgctgtctcttgtacaggtgccaccgtacgtccttgaagagtggagagcgtaaagcatctattttctctgacacaaaccgcaacttcatcaggataatcgcgggttacagtatctgaatcgagttgaacgatataatcatcagtgcagcggtttataatgctcactaacctttcccatgtccctcctgttggacaaccctcagttggaatattatgagtcgatatgaactcagctgcacccaaatgattagatatgatttctttatctgatcttgtaaacccatcgtcaatcactataaaacttttcggccgtacaaaatgagcgaacgattttgctgcgattaaaaacataaagagatcacggtggtaactttgactcagtataactaagttgctggttgggtcacaatttacaggcggcgttttaagaatatcttttacagtaaaatcgaaaatctgttttttgatcctttttagagaaatcatttttgcattatcctaatttaggttatagcaattaccggggaaaagtgttatttggtgagttctttttcaaaaatatgccttaagagcccctgactcgcattttccaccaggtccagcactctttcgaatccatgactgcccccgtagtaagggtcaggcacttcctggtgagtactccattgattgccgtattgtaagaacagccctaaccggtcaatatattgtgacggacaatcttgctgcagttcttccaggttgtgatgatccattgctaggatatattggaagcgtgaaaaatcttctggtgcgactcttctggcgcgcaaaccttgcatgccatagccgcgttttagggcagcctgttgtgagcgccgatccggtggttcgccaatgtggtaagcgtgtgtcccagcagaatcaacatgaatgaggtgttccaacccggcagatctgacatggtgcttgaaaactgcatccgccgtaggcgatcgacaaatatttcccatgcagacaaacaacacgctgattttttctaccttcagatgctccatttatcttgctgttataattaattaagggttctgcaattatacctttgatcataaaaaatcataatttccatttctgacttctttatctgcacgatctgagatttaccaccaggatttattcacgatgagcaatcgttggcaggctgttttgaaaactgctgctttccttaagccctataaatcatcgatgggtttcagtctgctggcattatttctgactgccgggattacactttcgatcgggcaaggcatacggctactggtggatcgggggtttgccacgcaatctcctgaattgctggctcagtatgttttaatcttcctgatgctcgtagtgctgctcgcaataggtacgtttactcgttactactgggtgacttggctgggtgaacgggtaatcgcggatatacgacgtaaagtgttcgcgcatctaattgatttacatccggggttttttgaaactaatcgcagccttgaaattcagtctcgtctgactgcagatatgactttgttgcaatctgtagtgggttcttctatttcagttgcattacgtaacctgattatgttgattggcggtgtgatcttgctatttattactaatgtcaaactgaccataatcgttatgctcagtattccgctggtcatcatacctattttgctatttggtcgccgtgtgcgtttactgtcgcgccagagccaggacaaggtggcgactgttggtgcttatgttggagaaatgctcgggcaaattaagacggtacaggcgtacaaccatcaagcagtggataagatgcattttaatcaatatgtggaggatgcatttcttattgctcgtcaacggacattacagcgcgcctggttgatcgcagtggtgattgttctggtattcggtgcaatcggtgtgatgctttggatcggtggtatggatgtaatcgaagacagaatcagcggcggggagctggcagcattcattttttacagtattatcgttggctcggcagtaggatcggtttcggaggtgctgggtgatttacagcgtgctgcgggagccgcagagcgcaccatggagttgctggaggagccctgccaaatctattcacccgctaatccttgtcagttgccagtggtgacaggcaatattgtgttccagcagatatgttttgcttatccgtcacgaccggaaatacaggtcatcaatgatttttcactgactgtgcggccaggtgaaacgttggcactggttggcctctcaggtgcgggtaagtcaactttgtttgacttgctactgcgtttttacgatatacagtcgggtagtatcaaattagaaggcatagatatccgtgatctggatttgtctgatctcagacgcagctttgcattagtgtcccagaatccagcattgtttcacggcagcatcgaacagaatttacgttacgcacatccaaatgctacaaatgccgagattgaagcagctaccaaggcagccttcatacatgattttattctgtcattaccacagggttaccaaaccaatctgggcgatactggcttggggttgtctggtggtcagaaacagcgattggccattgcgcgggctattctggtggatgctccaattttattactagacgaagcaaccagcgcattggatagtcagagtgagagctgggtgcagcaggcgattaccagattaagtgcagatcggaccactcttgttattgcacatcgtctaagtacagttgttactgctgatcgcatcgctcttattcatcatggtcatctggaagcgttggggacgcatgcggaattgatgaagtccagtgatctctatgcgcgccttgccatgtcacggttccaaacatctggttgatattatttattaaatattagctattttttcgctgaagctgagctacatgcaggacattgtggatcttttttcagtttgaatgagcgcaagcgcatggctaacccgtccaagagaagtaggcggccatggagtgtttcaccgatttccagtaaaaccttgatagcttcggcagcctgaatacagccgataatgcctgttagtggggaaaatacgcccattacggcgcatccgggatcatcactatctcccgagtcaggaaataggcaatggtaacaggggctatcactctgacgcagatcgaatgcggcaacttgcccggtgaaccggacagctgcgcctgatatcaagggtttacgatgatccaggcaggcttggttgagtatgtggcgtgccgagaaattatcgctggcatcaattacgacatcgacaccactaatttctctgtttaataaatcaacagtggcatgtcgtgccaaggggataatttctatttctggattgatgcgctgcagtgtatttctagcggaatcagttttaagctcaccaaccgaagccgtgtcgtgcaggatctggcgttgcagattagtcagatcaacccgatcatggtcacaaataacaagtcttccaatcccgctggcggcaagatagagagcagaaggagagcctaatccaccagccccaagaatgaaaacactggattgtattagttttgtttgaccggaaaaatcaatttccggtaacaaaatgtggcggctgtaacgtaacagttgttgatcatccacgttgctccgccaccttgttcggaatgaattagcctttcgttgccttggctgttttgtgtttggatttttgagacatggatttcaggtgattaattgctttggtcaacagctggtcatcactggatccgaattccataggctcatgatttattggtttcttgtttgtcttattccttgattctttggaagattcagtaccttttttcttgagggttgatttcttaccggtactttcttcttgattattgtttaaatggcggttgagatcaacttctcttaacagacgagagttgttatcagtatcttcatccaatatatccggcgtgatacctttagcctgtatcgactgaccattaggcgtgtaatagcgcgctgttgttagcttaatggcagtgttattgctaagaggcaagatggtttgtaccgatcccttgccaaaggtttgggagcccatgatgatggagcgtttataatcctgcaacgcacctgcaacgatttccgatgcggaagcagagccgccattaaccaacgttatcattggtatggtcttgatactctgcggcaaacctgctagaaaatcgcgaccagtactgcggagataatattcggggtttgcacgaagttgcattttggcgtcattggtacgtccctctgtataaactaccagtgcattacttggcaggaaagcagctgagactgctaccgcactattcagtaaaccacctgggtcatttcttaaatccagcaccaggcctttcatgggaaccttgctttcactgtaaagcttggtaatggcttcagccagattttctcccgtacgttcctggaactgggtaatgcgtacataggcgtaacccggttcaatgagtttggatttgacactctcaattttgatcacatctcgaacaagcgtgaatatgaggggttcagcttccccttcacgaataatggtgagtgcaatcgaagtatctggtttcccgcgcatccgtttaatggcgtcgttgagtgtcatgcctttaacagctgtatcatcaatttttatgatgagatcaccggttttgatgcccgcacggtatgcaggtgtatcttcaatcggggaaataactttgaccagcccatcttccattgttacctgtatgcctaatccgccaaattccccttgcgtcccgatttgcagttctttgtactcttcactgtccaggaaagccgagtgcggatccagtccgaccagcatcccattaatcgcctcggtgatcagtttcttgtcttcaacaggctcaacgtagtcactcttgatacgcccgaagacttgtgaaaatgtgcgcaactcctcaatcgggagtgtttgcaattcttgcttgatttccttatcagcaatggcggagaagttcaaactgaccatgaccccggcaatgatgccgacaaagactaaactgattttattcataaaattacgcatgtggtgtatttgctctgccctttatcttttcggaagaatttatatgtacttattaaaatatttactatcagctttttgaagctattctatttttacccagcccagtggatcaaaaggcttgccttgatatctgagttcgaaatacaagcctgattcagcatttccaccactgttgccgactattgctatcgtatcaccacttttaactttattgcccacccgtttgtaaatcgcttcgttgttgccgtataggctcatgtaatggttgccatgatccaaaatcattaaatttccaaaccctcgtaaccagtcggaaaatataacttccccacttgcaatggccttgacttcattgcctcctgaagaacgaataaacaatccttgccattttataccaccattttcgcgcgggctgccgaagcggttagttagctccccccggacgggtagtcgcaattttccttttagtgcagcaaaagaacccttttgttcaatggcatcaggtaatttattattacgcaatgcagatttattgtttttgttgtttgattttgtgggattgctttttttacgagcaagctgtttattgagtttctcaatcagcttggaaagacgctgttcatcttgtttcagttcgtcaatttttttttgctgacgagaaacctctttggagagtgatgcgaggatttctgatcgtcggtttttctccagttcgagttgttgcttttgatggagctgctcgttccggatttgttcaagagattgattttgaatgcggcttgcatgagccagtgtatccagatcagccaactggttacgtaaattatcgatatttttggagcgagcctgtgctatgtatctatagtagtaaaagttacgagtagctttgcctggatcttgttgcttgaataataattgtaaatattccctatgctttgtcaggtgctgataataaattagctttccaagctgcgtttgtccagcgctggctttatcccggagctgtgctgattttttttgtaagcgggtaagcttgtcttgtgcatttttttgctggcgcgtaagctgggaaagtttgttgtgcagatcgcttattgatcgttcggaatcacgaagtgcatcagctgctctgatcttggaagattttttatcagtcaggtctttttgcaggacgtcgatacgagtgcgcagatcatgcagctgtttttgattatccaaattggtttgaggaatcgcatacagcagaggagatgaaaatatatttactaaaagcagaagataaacagtcctaggtaatatcttccctatccccgggaagtaatgtggcgctgatgtgaaatctgcaatgaaaccagcaaacattaagctccggctttatcctgattcgcgacagctgatattgcttccccaattacgctgtcattacccaagtagtagttcgttagtggtttcaggttgttatccaactcataaaccagaggaattcctgtcggtatattgcagttcaaaatatcttgatctgagatattgtcgagatgtttaatcagagcgcgtagcgaattcccgtgagcggtgataatcacttttttttctgccttaatttgcggggcgattgactgattccaatagggaagaaatcttgccacggtatccttgagactttcagtaaccggaatatcaccggagggaaggccgcgataacgcatgtcaaaaccagggtagcgcttatcatcggttgtgatggaaggagggcgagtgtcataactgcgtcgccatatgagtacctgttcatcaccatactccttggctgtttctgctttgttcaagccttgcaatgcgccataatgacgttcattgagccgccagttaagttcgatcggagtccacatctgatccatttcatccagtgcgatccacagcgtgcggatggctcgtttgagtagcgatgtatgcgcaatgtcgaaggtaaaaccattttcgcgaagtagtcttccggcatttctagcttctttgaaccctttgggtgtcaaatcaacatcggtccatcctgtaaagcgattttcctgattccaggtgctttctccatgacgtaggagaacaagttttttcatgtcggccttagagttgagcggggagaaaattacatataagtaacttttgtagtttaatatattttaccttaaggtgcagcaaatcaggactgatccgatcttaataatcccccatttagttgagaaactcgggcattgacgcgatccggtttcgcaggtagcatccttgggtttatggatttaaagctgagggacaggatggcgcgtgcggggtttgtggcgggaaactggaaaatgcatggtaatttggttcagaatcaagaattgcttgccgcaattgttttgggtattccgtcattgcagaatgcgtcttgcgcggtatgtgtgccttatccctacttggcgcaagcgcaatcagtgttgaagggtacgcatgtagcatggggggggcagaatatcagtcagcatcatcaaggtgcttataccggagaggtatcggcaggtatgctggccgattttggttgtcgttatgtaattgtgggccactcggagcggcggacgctatacggtgaagataatcaggtggttgcggagaaatttctctccgcccaggagcaatcgctagtaccaatactctgtgtcggagaaacgctggcgcagcgtgaggcaaatgagaccgagcaagtgatagctaggcagtttgatgcggtgattagtctggtaggtgttaatgcgataaagcaatcagttattgcatatgagccggtatgggcaattggtacaggagaaactgctactccccagcaggcacaggatgttcatgcatttgtaaggaatcgaatagctgcacataacagcgaaattgcagcagatatccagataatttatggcggaagtgtgaaagcaaataatgcgtctgaattatttgcgatgcctgatattgacggagggttgattgggggagcttcgttggttgctgcagagtttatttcaatttgtttcgcagcgcaaagttgaacggggataaagtatattgtggaaacacttatttggtcagtacatatcattgcagcagtagttgttgttgttttggttctgttgcaacagggaaagggcgcagatatgggggcggcgtttggaggcggttcttccgggagtttatttggtgctagtggatctgctaattttttaagcaggatgactgcattggcagctacagttttttttgttaccagcctgacgctaacttattactcaaatggtgataaagacgaaggaagtatcatgcaaaaactggagatgaagtcggataaggcggctgattcgaccggaaatgttgaaagttcaggtgcggaaaacgaaagtggttctacatcaagagctggtgaaattccggagtaaccttgtatttccagtatagaagcattggaaataatagataagtttattcgccgacgtggtggaattggtagacacgccgtcttgagggggcggtggcgaaagctgtgcgagttcgattctcgccgtcggcaccaggcgagtatatttacaagtagaaattaagcaaaaatcaattttatttccgtggtttagtaaggatattgggtatgctggataccatgcttgggaattatttccctattttgttgtttattttggtgggtctgctagttggcacattatgtttagtggcgggttggtttcttgcgccgaacaagccggatgctgaaaaattgtcaacctatgaatgtgggtttggtgcatttgaggatgcgcgtatgaaatttgatgtgcgctactatttaattgcaatcctgtttattttatttgatttagaaatagcttttttatttccttgggcagtagcgctgaaagaagtgggattgtttggttttattgcgatgctagtatttcttgggttgctcgtcgtcggctttatttacgagtgggctaagggtgctttggaatgggattaaataatgggtattgagggtgcattagacaaaggatttgttaccacaaaccttgattccttgattaattggggacgcacaggctcaatgtggcctatgacatttgggctggcttgttgcgcagttgagatgatgcaaactggtgcatctcgctatgacttggatcggtttggaattgtttttcgtccgagtcctcgtcagtcagatgtcatgatcgttgcgggtacgctatgtaataaaatggcaccagctttgcgcaaggtttacgatcaaatggccgaacctcgttgggtaatttccatgggatcctgtgcaaatggtggtgggtattatcattattcctattcggttgtccgagggtgcgatcggatagtgcctgtcgatatttatgtgccgggttgtcctcctactgcagaagctttgctttacggaattattcagctgcagaataaaatctggcgtactaacacaatcgcgcgttagagaataaaaatgacagatagtcgcgtagacaaacttgcaacaaatttacagcaagtactgagtgatcagcaggttgatatgagtcatgcgttaggtgagctaactattttaattcattcccgagatttgctgggcattgctgaaacattaagaaaccatactgatttggcgtttgatacgttagttgatttatgtggcgtagattacagcgaatatacgacaaatacgcatgctggatataagcggggtgacaagcgctttgccgtggtgtatcacttgctttccgttaaacataatcacagactgcggatacgtgtatttgtagacgataatgaatttcccatgcttgattcagtgatacatatatggccttcagctaattggtatgaacgagaggcatttgatctgttcgggatcgtttttaataatcatccagatttaagaagaattcttacagattatggttttataggaaatccatttcgtaaggattttccattgtcggggcatatggaaatgcaatatgatccagagcaaaaacgcgtgatatatcagcctattactattgagcctcgtgaaattacgccatatatcattcgcgaagaacaatacggtaaggaagaaacatgacacgctctatgattaatcagcgatactcacgaagtttttgggaagggtgtttgtgaaatggctgatattcgtaattacactatgaattttgggccgcaacatcccgcagcgcatggggttttgcgcttggtgatggagctggatggtgaggttattcggcgtgctgatccgcatatcggattacttcatagggcgacggagaagctcgcggagaataagacctatatacaatccgtgccctatatggatcggctggattatgtgtccatgatggtcaatgagcatgcgtatgtaatggcgattgaaaagctattgcagatagatgtgcccataagagcgcaatatattcgtgttatgtttgatgaaataacgcgtattctcaatcacttgctatggttaggcgcccatgcactggatgttggggcaatgactgtttttctatacacctttcgagaaagagaagatttgatggactgctatgaggcagtatcaggcgctcggttacatgctgcctattatcggccaggaggggtttatcgggatctgccggatagtatgccgcagtatcgatcatcagcaatacacgatgagaagacaacgacagcgcgtaatgagaatcggcagggctctttgttggattttattgaggactttactcatcgatttccgggttacgtggatgattacgagacattgctgacagataatagaatctggaaacaacgcttagttgatattggcgtggtttcacctgatcgcgctaaagctttgggatttagtgggccgatgttgcgtggatctggagtggcgtgggacttacgcaaaaagcaaccttatgaagtttatgaccaggtggattttgatataccggttggtgtcaatggtgattgctatgatcgttatttggtacgcattgaagaaatgcgccaatctaattacataattaagcagtgtattgattggatgagaaaaaatcccggtcctgttattaccagtaacttcaaagttgcaccgcctccacggctgtccatgaaacaaaatatggaagaaatgattcatcatttcaaattatttacagaaggtatgcatgttccgagaggggaggcctacgctgctgtggagcatccaaaaggtgagttcggtatttatattatttcggatggcgctaatatgccttatcgactgaaaatacgtgcacccgggttcgcacatttagctgcaatggatgagatggctcgagggcatatgattgctgatcttgtggcaattattggcacccaggatatagtgtttggtgaaatagatagatgagttcgctgatgttaagcatggaatctctaaaaaagattgatcgggaaattgccaaatatcccacagataaaaagcagtcggctgtcatgtctgcgctggccattgctcaagatgaaaaaggctggttagcaactgaaacaatggattttattgcaaactatttagagatgcctgcaattgccgtctatgaagttgctactttctacaatatgtataacctgaagccgattggaaaatacaaattgactgtttgtaccaatttgccttgtgcgttatcaggtagtaatcagactgtagattatcttaagaagaaacttggcatagggttcaatgaaacaactgtggatggattgtttaccctcaaggaaggcgagtgtatgggagcttgtggagatgcgccagtacttctggttaataacaagcgtatgtgcagctttatgactgaggatcaaatagacaaattgcttgaggaattaaagagatgactcaacctactcaagtcatcatggcgggtgtcgattctgcagatttaaataattggcggttaaaaagttatttaaaacgtgacggatatgttgcgttaaaaaaaattctttcgcaaaaaattcctccggaagttgtgattgaggaagtgaagaaatctgcactacgtgggcgtggtggtgctggttttcctactggcttgaagtggagttttatgccaaaacagtatacaggtgagaaatatcttgtctgtaactctgatgaaggagagccgggcactttcaaggatcgcgatatcatgcgttacaatccacatgtccttattgaaggtatgttgattgctgcctatgcgatgggtatccgcaccggatataactatgtgcacggcgaaatctgggatgtttacgaacgaatggaggaggctgtcgaggaagccaatgcggcaggatttctcggggagaatattctgggttctgggttcgtttttcagctctacaatcatcatggatatggcgcctatatatgtggagaagaaaccgcgctattagaatcgatagaaggtaaaaagggacagccacgctttaaacctccgtttccggctaattttggcttatacggcaagccaactacgatcaacaatacagaaacgtttgcttcagttccttggattatgcgtaacgggggcgaaagttacttgcagctgggaaaaccgaataatggaggtaccaagatattttcggtttccggtcatgtaaataaaccgggtaactatgaagtgcctatgggcactccgttttcaaagttgctggaacttgccggcggaatgcgcggggggcggaaattgaaaggatgtatccccggtggttcatccatgccagttttacctggcagcatcatgatggaaacagacatggattatgattcaatagcaaaagcaggctccatgttgggttcgggggcggtcattattatggacgatacgacttgcatggtgcgtgcactagaacgcctttcctatttctattatgaggaatcttgtggccaatgtactccatgccgagaaggaacagggtggctttacaggatcatcaatcggattgagcatggtaaaggaaggattgaagatctggatgtactcaacaatcttgcagataatatccagggaagaactatctgcgcgttaggtgatgctgctgcgatgccagtacgagctatgttgcatcacttctgggatgaatttgtttttcatattgagcataaaaagtgcatggtctaggtgaaccatggttttagtgctgtatttatccaactcccgataatcttgggaattattgctgatgattaatattgaaattgatggcaagcaagtagccgttgtacaaggtagtaccgtaatggatgctgccaagcaggttgggatatacatcccacatttttgttatcacaaaaaactgtcaatagctgccaattgtcggatgtgcttggttgaggtcgagaaagcacctaaacctttgcctgcttgtgcgacaccagttgctgaaggtatgaaagtttcaacgcactctcagcaagctgtcacggcacaaaaaggggtaatggagtttctgcttattaatcatccgctagactgccccatctgtgatcaaggaggtgaatgtcagttacaggatttggctgttggatatggttcaagtggttcgcgttatcaggaggccaagcgagcagtaaccaacaaaaatcttggtccactcatatcaacagatatgactcgttgtatccattgcacgcgatgtgttcgttttgggcaggaaatagccgggatcatggaacttgggatggccggccgtggagaacactctgagattttgacgtttgttggtaaaactgttgattcagagctatcgggcaatgtaattgatttgtgtccggtgggagctctggtcagtaagccttttcgttactcggcaagaacttgggagttatcacgcaggaaatcaatcagtccacattgcggattgggaagtaatctggttgtacaagtgaagaataatcgggttatgcgggtgttgccacgtgaaaatgaagcgatcaacgaatgttggctctcggataaggatcgtttttcttatgagggattgaattctgaagatcgtttgactgtcccgatgatcaaaaaatcgggagaatggcaagcttgtggctggcaagaagcattggcttttactgcggaaggtatcaaaaatgtaattaataagtatggtgcgcagggtgtcggtgccttggggtctgctcatagcacgctggaagagctctatttattgcaaaaattgatgcggagattgggtagccataatattgatcatcgggtacgccaatctgatttccgtgtagataccatgtcgcagggagttccatggctggggatgcaaattgctgaggtttcacaactgaaatcaatattggttattggcagtacattacgcaaagatcatccgctgcttgctcagcggatgcgtcaagcagtaaaacaaggtgcgcagctgagtgtcattaatccaattggagatgatctgtttaccaagctcgcttatcaaactattgttgcaccatcagcaatgttgaatgcggtattacaggttcttaaagcagttgcagaaattaaaaatatgcccatatctgagcagattgcatctgcagtaaatcaggttaatgtttcagaaagcgcacgaggaatggcaagtagtcttatagagcattctccagctgctatttttttgggtaatctcgctcaacatcatccccattatgctgatttattcagtgcagtacaggcaatttcagagatgacgggagcaagatttggtgttttgggagaggctgcaaatagtgtgggtgcctattctgtcggagttgtaccgtgggatgtcggagcggaatctgctaataaaactgaatcaaggaaatctggtctgaacgcggggcagatgttaggactgggtgcgtcagaggaagaatctgtctgtagcgcctatatactattgaatcttgagccggagttagatagttatgatacgcgccgagcatcgcaggtaataaatcgtgccgagtttgtggtttccttgagtagttataaaggtaatgttcccgattatgcggatgttattctgcctgtctctccttttacggagacatctggtacttttgttaactccgaaggaagaatacagagttttcaaggtgtggtatctcctcttggcgaaacgcgtcctgcttggaaagtattgcgtgtactaggaaatttgctgcaactggagggatttgattacgactcatcagaacaggttcgtgcagaaatcatttctgataaagaggaatttgtgcaaaatttgaataattcactggatgtactttctatcaaagatttcagtcagaaaggtagtgagatagaaaggattggtgaggtaccaatttatcaggctgatccaatcgtaaggcgtgcagtatctttgcaaaagacacatgatgctgctccacctactgcatttgcttcttctgccctactcaataaagctggaattctggcgggtgaaacagtcagaatagatcaacaaaatgaggaaattcagttggtgatttctgtggatgataatttgcctgatgattgtattcgtttggcatgcgctcacccgcaaatatccagactgggaacgatgtttggtgaaatcaaactggaaaaattataagaacctggatttggaatctgatcaatggatagttttcaaccattatttgaacaattatttggcagcgagtggggtgtttccctctttctattggcaaagaatctgctgttgattctggcaatcattattccattattgctggcagtcgcatatcttacttttgcagagagaaagattattgcattcatgcaagtcagagtagggccaaaccgggtaacattttttggtattccttggttgggtggatgggggcagcctattgccgatgcggttaaggctatcatgaaggaaatcattattccgaccggtgccaataaatttctatttctccttgcgccaatacttgctataacgcctgcattagcggcatgggctgtcgttcccttctcaccagaactagtattggctgatatcaatgctgcactgctatatattctggctatgacatctctgggtgtctatggtgtcattattgctggatgggcatctaattcaaaatatgctttcttgggtgccatgcgttctgctgcacaggttatttcatatgaattagctatgggatttgccttggtttgtgtgttgatgatgtcctctagtctcaacttgggagatatcgtagcggggcaacagggagggagttttcttaattggtacatgattccattatttccgatgtttctagtttattttatctctggagtagccgaaactaatcgattaccttttgatgtggctgaaggagaatcggaaatcgtggctggtttccatgtggattattcgggaatggcttttaccatattttttcttgccgagtatgcaaacatgattctggttgcaaccttagccagtatcatgttccttggagggtggttgcccccggtagatatcattcccttcaatctgatcccgggtgtagtttggttgttgttaaagatagccatcatgttgtttttctttctttggttccgtgctacttttcctcgttatcgctatgatcaaattatgcggttggggtggaaggtatttattccaattacgttaatctggattgttttattgggcgcagtaatgcaattgcctgaagctgcattgcaaagctttccattgaatctttggttctagtcaagaggaatttcaaaatggaacgcattaaacggtttttaaaatcctttttgctatttgagttgttaaagggaatgaaagtaactggacgctatttgtttgcgcctaaggttactgtacattatccggaagagaagacgccgcaatcacctcgttttagagggttacatgctttgcgtcgttatcctaatggtgaggagcgctgtatagcgtgtaagttatgtgaagcagtttgtccggcgttggcgatcactattgagtcagaacaacgtgatgatggtacacggcgtaccacacgttacgatattgatctgattaagtgtattttttgtggtttttgtgaagaagcttgtccagtagatgcaattgtcgagacacgtgtgcttgagtatcacggcgaagttcgtggcgatctgacttataccaaagaaatgctgctggctgtgggtgaccgttatgaagagcagatagccaaagacagagcagcagatgctccttatcgttaaacatttagatataaatttatgattttccaggattttgttttttacagtctggctagtgtggtgataatttctgcactaggagtaattacattacgtaaccccgtttactcggtgctgctattggtacttgcttttgtgacatcttccggattatggattttactcgaagcggaatttttagcgatagctctagtagtggtatatgtaggcgccgtcatggtgctgtttctgtttgtggttatgatgctagatattaatttagatcagatgcgggaaggattctggaagtggtttccatttggtgcaatattggcttttattatgaccgttgagatgagtatggtactgatgagcaaacaatttagttctgaaatcatacaaactccggaatataaatcagttgattacagtaatactaaagaattgggtcgattgatttacactgaatatgtgtatgttttcgaattagctgcagtcattttgttagtggcaatggttgctgctatagctataaccttgcgccatcgcaccgataaaaaatcttctaatgcctccaggcagatagctgttagccgtaacgagcggttaaaagtaatatctatgcctgcagaaaaaaaagaatgatttttccccagggatttcaactatctcaaatattttcatttgaagggtaatcatcttggtatcactatcacattatcttgtgctgggcgctgttctgtttgccattggggttgtaggtatttttctcaaccgtaaaaatgtcattattttgttaatgtccattgagctgatgctactggcagttaatataaattttgtcgctttctcatattatttacaggatatagctgggcagatttttgtattttttattctgactgtggctgcagccgaggctgctattggtttagcgattttggtcgctttattcagaaacatacgtactatcaacgtagatgatttggatagacttaagggttgaacggcaggcagttttatatccagtcagtttgttaaacagtattgttaattgataccttagatggaaaatctttatttactagtaccagcggcacccttgttaggagcaatcgttgccgggctgtttgggcgacagattggtctgatagggagccatcgtgcgacgattgcgttagtggcactgtcatttattgcatctgttgtaatttttatcgatgtattacaaggaaatctttataacggtagtgtctatacctggatgacatcaggcgagactgtaattgagataggatttttgattgatacgttgtcagccacgatgatgatggtagtaacaggtgtatcgttaatggtacatatttatactatcggctatatgcagggagatccagggtatcagcgattttttagctatatatcgctatttacgttttcgatgctgatgctggtgatgtcaaacaatttcctgcaattgttttttggctgggaagcagtcggactggtctcttatttgctaatcggtttttggtacactcgcccgacggcaatttatgccaatctcaaagcatttctggttaatcggatcgctgatataggcttcctgctgggtatcgctttaatactggcaaatgtcggcactttggattacgagcttgtatttacccatgcggaataccttgcatcccgtactattgaaatcatgcctggtgaatcctggatgttgatgacagtaatatgtttgctgcttttcataggtgcgatgggtaaatctgctcaatttcccctgcatgtctggttaccggattcaatggaggggccaacacccatttcggctctgattcatgctgcaaccatggtaacagctggtatcttcatggtagctcgcatgtctcctctgtttgagttatctgttacagtgcactcggttatttttgtgattggtggaattactaccttgtttatggcgctggtagcggtagtacagaatgatatcaagcgagtcgttgcgtattcaacgctatcccagctcggatacatgacggtagcactgggcgcatctgcttattcagcggctatctttcatcttatgacgcatgcctttttcaaggcattgctgtttctgggtgcagggtccgtcattatcgccatgcatcacgagcaggatatgcgcaagatgggtggacttaaacgatatatgccgattacatttggcaccatgtttgttgctgcattggccagtgcaggagtgccaggtttttcaggttttttctctaaggatgcgattattgaaggagttctcctctcggaaattcctggggcaggattcgcctatttctgcgcgttaagtacagtattcgttactgcgctgtataccttccggctaatattcatgactttctatggcgaaccaggtatggatagccatacacgtgatcatttgcgtgaatccccttgggtagtgacggtaccactagttttattggcaattcctactgtggcggctggctggctgattgatccaatgctttttggaggtttcttcactgaggctatttatatagatgcgcagcatgatgtcatggccaagatgggcgagagctatacaggaatattcggcatgatgatacatgctttgactgcccctccgttctggctggcgatgtcaggaatttttactgcctggtttttgtatcgttatcaaactgcattacccggtaaaattaaaaaactggctaatccggtttatgttctgcttgatcgaaaatattttattgatgagctgtacagctggttatttgcgggcggtttacgtacgctaagtaccgtgctgtggaaatatgtagatatgaaagtcatagatggtttgatggttaatggcacggcaagagcgatgggttggtttgcgatggtgggacgtcgctttcagtccgggtatatctaccattatgcatttagtatgattgtgggtgtatttgttctgatgagtatatggctgtttcctttttaggcttcagggaattgaaaacggactgaacttctttctgttctctgggataactaatacgcattgaaatgcgatttaagacgaaaaaaacatgttatttggatttccgctgttaagtctaattatctggttaccaattgtttctggtttaatcgtatttttgatgagtgaccggaatactcaagcggtacgctgggttgctctggctggatctgtggccggtttcctcgtaacacttccgctttatagtggatttgatacatccatgggttcgatgcagtttatcgagcggaatgtatggtttgaacgcctcaatgtctattattatttgggggttgatggcatatcaatgccattaattttattgaacagttttacgaccccgctggtcgtgattgccggatgggaggtgattcgtgaaaaggtttcccaatatatgggagcttttttgatcatgtccggtgttctcaatggggtgttcgcgtcactggatgccatattgttctattctttctgggaagcatcactggttccaatgtttatcattattggaatctggggagggcctaaccggatttatgcagctctaaagttttttctttatacatttctgggatctctattgatgctggtggcgctgatttatttatatcaggcttctggtggtagcttctcaattctcgattatcatcatcttcctataccgatggccgcacaaatccttatttttataggatttatggtcgccttcgcggttaaggtgccgatgtggccagtgcatacttggttgccggatgcgcacgttgaagcacctacaggtggttcggtagtactggcagctatcctgcttaaactgggtggatacggttttctcagattttctttaccaattacgccagatgcgagtcatgagttgtcatggatattgatcgctttatcgctgattgccattgtatatattggcatcgttgcgttaatgcagcgtgatatgaagaagctgattgcctattcttcagtttctcatatgggatttgttacgttgggctttttcctgttcaatcctattggaatagaaggagccatggtgcagatgatttcgcatggattcatttctggcgctctgtttctatgtgttggtgttttatatgatcgcttgcatactaggatgatcgcagattatggtggggtagttaataaaatgccagtttttgctgctctttttatgttgtttgcaatggctaactccgggcttccaggcaccagtggtttcgtaggtgaatttatggtgattatggggtccatggaagtaaatttctggtatgcattttttgctgcgctgacattgattttgggggcgtcttacagtctgtggctatataaaaaagttgtgtttggtgccgtggcaaatcccaatgtcgagggaatgaaagatatttccgcacgtgaatttttggttttggctatcctggcggttgcagttctagctctgggtatttatccgctgccacttaccgaagttatgcatgttacggttgataatctgctggagcatgttgcacgtaccaagctttaagatatttagctaaatttttggataataaaaatactttcctgatcggaaattaaggatttttcatggattttttgttacctgacttcacaccagcttaccctgaaattttcctgctgttcatgatttgcgtgatcatgcttgctgacttgtttgtaggagaaaaaaatcggcttctgtcattttatttgtcattattgacactggccggatgttcattcattacgtatgacatatatagcacagaagttcgttatactttctcaggcatgtttgtcggtgacgcaatgtcagatacgctaaaactgatgatttatcctactgttgcggctgtgttgatctattcccgcgcatacatcagtctccggggtctattgaaaggggagttcttcagtctcacattgttcgccacactgggtatgatggttatggtttctgcaagccaccttattaccctttatctgggaattgaactgttatccctgtcgctttatgccatggtagcgttgcaacgtgaatcggctgttgctaccgaagctgccatcaaattttttgttctgggcgcactggcttccgggtttttgctttatggcatgtcaatgctatatggcgcaactggaacattgcatatttcggaattaacgaagagcatccaacaaggtacggcagatcatgacatctttatcatcggtctggttttcgttgttgccggtatcagctttaaactcagcgcagtaccatttcatatgtgggctccagatgtttatgaaggagcgcctactgcagtaacattatttatcgggtcagcacctaagctggcggcttttggttttgttatgagattgctggtggagggcctgggagagctggctactgattggcagggaatgctgatcttgctgtcagtggcctcgatggcggttggtaattttgtagcgatagctcagctaaatattaagcggatgctggcttattcaacaatttcgcacataggatttgttttgcttggttttattgcgataggagaaaacggctacagctcagccatgttctatgtgattgcttacgtattaatgacgctgggtgcatttggaattattatgttgctctcccgggaaggatttgaggcggacaagatcagtgattttaaaggtcttaatcaacgcagcccgtggcttgcatttatgatgttgttaataatgttttctatggcgggagttccccccatgattggattctatgcaaaattagctgttttccaggctgtcctggaggcagggtatgtctggttagtggttgttgcagttatactggcgctaattggtgccttttattatttacgtatcgtcaagtttatatattttgacgcaccggaagatactcgaccgattttattcaaaccggatgtcaggatactcatcagcacaaacggattggccataatacttctgggcatgttccctcaggcacttatgggtttgagcctgtctgccattcaaaactccatgtaaaaatcatggcaggtgggagagttatggctgattatagctgatacgataaatcacacctgccatatcatccgtgatcagcatcgctccatccgctgttattagtatgtcaaccggtctgccccaggcttcgttatcctgcagccagccttccgcaaaagattcttttttagtaaccttatttgcctcaagctgtacccgttcaatacgatagcctgtttttgtactgcggttccacgaaccatgctctgcaataaagatgttgccatggtattcaacggggaacatggtgccggtataaaatcgcattcccattggcgtgacgtgaggatcaagttcagcggcaggaggagtaaacttattgcagtcatgttttgccccaagtttgggatcagctacttcttgaccatggcagtaagggaaaccgaaatgcattcctttctctggagcatgattcaactcatctggcggaagattatctcccatccacgcccgactgatatcggtgaaccacaattcctttgtgatgggatgccagtcaaatccttccgtgttacgtacccctttcgcgaatacttcatagtttgtaccatccggttttatgcgtgaaattagagcaaaacgatccagatccgtttcgcagatattgcaaggcgagccaacagaaacgtacagccaatcatccggaccaaacgctatgtttctccaaccgtgataggtttctttagggtaatcagtcgttataatgtgcggtggtgctgggtgatcgagcgtattttcaatgtcatcaaaacgcaggattctgttaaccgatgatacgtataaagcaccgtcatgaaacgctactccggagggcattttgagcttgctggcaataatgcggacttggcgttttccctcgttttctgtgatggcatagatattacctgccgatttggaacctacgaatactgttcctttatcgcctaatgtcatggcttgtgcatccggtacatgtgcccaaatactgattgaaaacccggagggtagcttgattttatcaagtggaagctctaattcttgagcattaacttggaaggtgactgcacatagcgatgccgaaaaaacaaaagataagaatttcatacaatcgaacaagtaaaaattaagaaatagaggtttcgagattgaagtaacttgaaatcgggaaacctgatcccacaatgttagcgcattttttaaggaggaaagtatgcaaactgcagaaaacgtcgaacacttgaattttcaggctgaagcgaaacagcttttgaggctgatgattcattccctttacagtaataaggaaatttttctacgggagttgatttcgaatgcttcggatgccgcagataaactgaggtttgaaggattatccgatacggcattatatgaatccgatccggatcttaaaatccgtattgcttacgataaagaggcgcgtactatcacgatcagcgataatggtatcggtatgtccagacaggaagtgattgataatattggtactattgccaaatctggtacacgggaatttattgattcgctgacaggtgaccaagctagggatgccaacctaattggacagtttggcgtaggtttttattcggcatttattgttgcggacaaagtaacgttgactactcgccgtgcaggcctgactactgagcatggagtgcgctgggaatccagtggtgagggtgaatacacgctggaaaccgtggaaaaaagggatcggggtacagaggttgttttgcatctgcgtgaagacgaggatgagctgttaagcagctttcagcttcgttctatcatccgcaagtattcagatcacatcacgcttcctatcattatgaagaaggaggtatgggatgacgagagcaaggcatacaaaataagtgatgaagaagaaacagtcaatcaggccagtgcaatctgggcacggcctaaaaatgagattacgcaagaacagtacgatgaattttataaacatgtagcgcatgatttcgagccgccgcttgctcatgtacatgccagagttgaaggtaagcaggagtatattcagttgttatatattcccgcccatgcgccgtttgacctgtttgatcgcgagcatcgtcatggcctcaaactttatatcaaacgtgtgtttatcatggatgatgcggagaaattgttgccagggtacttgcgtttcgttcgcggcattattgattcaaacgatttaccattgaatgtttcccgtgaaatcctgcaagaatcgaaagatattgacagcattcgtgccggctcggtgaaaaaagtactggggttgattgaagatcttgcaacgagtgataagagcgaggatcaggaaaaatttaaaatcttctggcgtgaatttggccaggtactgaaagaaggagttgcggaagattacagcaaccgtgaacgtatcgctaaattgctgagatttacttcaacacatgatgaacaagaagagcagacggtctcgctggatgattacatcgcccggatgaaaccagaacaggaaaaaatttactacattactgcagatggtctgaaggcagcccaaagcagcccacatctggaaatattccgtaaaaaagggatcgaggttctgttgttgcatgatcgtattgatgaatggctgacagccaatctaaatgagtatgcgggtaaatctttacaatctattgccaaaggtgatctggatctaggcaagctggaagatgaagtagaaaagcaagagcatgaaaaggaagcaggagattttcaggaattaacagcaaaaatgaaggaagtgctgggtgagctagtcaaggatgtccgcattacctaccgtttgacggaatcgccagcctgtttggtagctgatacacacgatatgagtggtaatctcggacgactgctgaaatctgctggtcagaaagttccggatagtaaaccgtttctggaaatcaacccgcatcatcccatggttcagcgcctgaaatatgaagaagccaaatttgctgactggagccatattttgtttgatcaggcattgctggccgaaggggggcagctcgaagatccagctagtttcgtcagacgattgaatgatttgctgctgcaaaatattttaagcggaaaataagatatcgaggattggttgtgcgcacactataaatttgtctaacagtgtttttaaaatccggttgtatagagtgaaagcacaaggtgcgcgaagttcagcaacgagatgttactcaaggcagtgcttaccgtgcactgccttgttttgcctaaaaaaaccaactttagaagtattctcaaataatattggcaagtttagcgtgttaatctgaagaggagaaatagagcgaacagcggttctatttctttatcttgacactccagtaattcatcatataccctcctaatctcaaaaagagaacgattggtttacttttgtccggagaggagaagcagaatgagagataactctgttataaaactttgttccacactaccgattctaatgctggccagcaatctggcttatgctatgcctggtatgcatggagcagaaggtgtagctgagccaccagccgcatcaaaaagtatgggggctcctattaactcgcccggtactgaaatagagataacctacagtgcggatggcaaaacagctattttcgtttcaacgcgcgaaggtagtatcaaatcaccgggcagtgcctataactttgatatatggatgtctcataatatagatggtatatggcaggaacctgttcatcttggccccgatattgatccgactgtaggccctaatatcaatactacagcctgggagttagagccaagtctttcagatgacggaaatgttatttattttacgagatatgagccggacaacctgttgtcgggggatctttatgttgttcagagagtgaacggcgtatggcaagcacccaaaaactggaatgatgtgccggagcttcccagtatcaatacatcaactggcgaagaacactgcccgattattgcctctgatagtctaatttattttaactacagccagcctggggtaactcaggagagtgatatctggaaagttgagaaaaaagatggtgtatggcaaaagccggtaagcttgggatcgaaaataaattctccgcagcgcgaccacatgcactggactggcttgtcaaaagatggcaaaagtctggttcttaccagtatgcggacaaatctgggttcgcggggcgggcatgatatgtggattgctcatcaggatgaaaagggtgagtggcaagagccggtcaatcttggtgatgttatcaatacctcgggagaagaaatgtgctggacttttacgcccgatggcaagaagtttaccggtagctggggaccacaaggtacgtttgatacggatatccactggataagcaaagaagatattcctttgttaaaaacattcgagccgatgggacctccacccaatttacttatcaacagcaacggctaaacaagcttgcctctggtttttccaagcgggccacttttcaataatacagagagctccaaatttatttggggctccctgtacaaatacttcagcctgaatatcggtatgtgtgaactcctcaatttcatcaaaactgttgcgtgacgaagatatttgggaaaaattgctggaaattctgatggatgatctggattatgaatagctgatgattgatgctagccactgtaaagttcatccacatgctagcggagccagaggtggcaggatatgagctggacaaaaagggactcaacaccaaaatatatctggccgtggatgcgcatggtatgctggtcagaatccttgttacactaggtgtcactactgattgcacgcaagttaggtacctgattgaagaagttggtgcagattacctgttggcagatcgtggctatgatagtaatgcaatcattgatctggcgaaaaaacagaagatggaaattgttatcccgcccaaaaaggatcgaaagataaaaacgtctaatgataaagcgctgtatgaactgaggcatcttgtcgaaaatgctttccttcatttcaaaagatggagtggcgttgccacaaggtacgccaaaaacacctcttctttccttgccgccgtacaaattagatgtatcgccctctgggcgggtgtctcgtgaccacgatgtctgggatgtggctcacattttcctgaaaatatttttccactgaatatttgctatccatcttatcaatattcaatattcactttgaaccccgataaaagacaggatcaatctgtatgtttatcaaaactgcactaaaataccgcccggtatgaaagatatgaaatgcagcatttgatttggagcaatagcggaaaataatggaatcttcacatagtagaacctataagatctttgcctcttgtaccagcttctgctatcgccatgctctctgggttttattaatctcatttatttttgttgcgataagcgcggtatataccactcgtaatcttggcatgaatactgatacaacggatatgctttctgagcatttgccgtttcgtatcaacagtgaaaagtacgaccaggctttccctcaggacacgaatattctgttgttggtactcagtgctcctacccccgagcaggcttattccacagcacaccggctggtagcactcctgaaaaaagataacaaaaatttttccgatgtttatgcgccaggcgtagaagatttttttgggcgtaacggattgctctatgaagatattcctcaactggaacgcatcacggatcatttggctgaagctcagccgctgattgcgcaaattacccggaaccccacactgcacacatttatcacgctactcacgcaagcgactgatgaattaaacaaaggccagcacctggagttggagtcggttttccagggagtgagcgagactatcgatgcacagcttactggcaaatcgcgccccctatcatggcagacattatttcgtggcgaaccgttaaaggctagttatcaggaaataattattgtcaaacccatcccggactattcagagctgcttccgagcaagcaacctgttatggcggtgcgcgcagccgcagaagaagcaggtttgaccgacgacgggccaattcagttgcgtattaccggggacatggcgttggctgatgaggaactcaagagctcgctggatgggatggaaattgccggggtcgttacattcatcatggtgggtgcagtactttattcggctatgtatacggttggtatgactatagctgtactgatttgtctggtggcgggtttagtgctgacagccgcgttcgcaacggttgctattggtcagctgaatgtgatttccattgcttttgcggtgttgtatatcggcctgggggcagattttgctattcactttctgcttcgttatcgggaaatgcaagaaagtggtttgctcacaaaaaccgctgtatatcgggcgggtggcgaagccggggttgcgctgactgcctgtacggttgcaaatgccattggcttttatgcattcatccccaccagttacagcggagtggcagagcttgggattatctcaggtacgggcatgctgatcagtctggtggttacttttattgtcggatcggcactgctgcgctatttatcggggcaatcagctgttaaacccaacggcaggaaaatgttgggtaaagtgcttgaggtttcgctgaagtggcgaaaattgacacacatttctgtttgtttagtgttgttgttggcagcagtattgtggccacaaatcaggtttgactataacctgctcaatatgcaggatccaaagggggaggctgttcagactttccgggaattgctggcatcacctgatcattcaccgtggtatgcggttgtgctgactgaagatcgcaatgaaattcaacagttgaaagaaaatctgagcaaactgccagaagtaagtaaagtggtttcaattaaggattttgtgccatccgagcaggaagaaaagctggctgcaattgaagaaatgtcacttatcatcggtccggaactgtcaatggcaacgccatctgcggttaagcaaacagtatcacaacaacagcaggtgctcgcctctctgcatgctacgttagaacgttttactgtgggttatccagattcctccactttagcttctgcattggcactcaggaattcagtggaatcattgcttcaccggctaaacaaggcaggtccggatgagcaggataaattactacagttgctggaagaaaacctgctgtccacactgtctgtcgcgcttcagcgtttatacaatctgattgaagctactcctttcggtgaacaggagctgcccgtgccactggccagtcgctggcacagtcatacaggggaatatcttgttgccgtatatccgtctgatgatattggtgataatgagtcattgcgccgttttgtcagatcggtgcagcaagtggcgccgcatgtaaccgggatacctgtaatcagtctggaagcaggcaatgcggtaatcgatgcatttattcaggcattctcactaacttttgtgggggtggtaattgcgcttctgctcatgctgcgcagcataaaatataccgtgctggtattgattccattgttgttatccagcatatttatcggcatttttactgtcttgctggatacaccattcaacttcgctaatatcattgctctaccacttttgttgggtctggggattgacagcagcttgcacatggtacatcgcagcatggataaccaggttggcagcgaaattttgatccataccagtacggtacgagctatcttttacagtgcgttgaccgcgctggttgattttgccagcctcatgttttcaccacataaaggaacggccagcatgggaacgttgcttaccgtcgggctggcatttaccctgatctgtacgcttgttattctgccttctctactggggaattccagccgacggacggcatcatgaagtcctcattatccggcatgtttgaacagggcaggtcaaccttggtctggtttgttctttccgtagcgatgtttaaggtattcaattacaggtgggatgatcgataaaataatgatcacaacaataaccagcttgaagtttctttgtataaatgggagttgcccgaaataaaatccagcgtaaacaaatatcccgacccacagcgcagcaccaatgatgttgtaagtaagaaaggtgcgataaggcatagtgccaataccggccacaaatggagcaaaagtacggatgatagggataaagcgcgcgatgataatcgttttgccaccgtatttgaggtaaaaggcatgcgtcttatcaagatgctcctgtttaaggaaacgaaacttctccggggtaaaaacctttagcccaaattcttgacctatccagtaattaaggctgtcacccaaaataccagccaggcataacccggcaaacaggatatggggattaagctgtgatccttgtatcgatgcaagtgatcctgcagcaaacagcaaggaatcaccaggcagaaaaggaaatacaaccagcccggtttcacaaaaaatgatcagaaagagaatgccattgacccatattccatattccaagacgagctcccgcaggtggctatcaatatggataatgaagtcgataagaaacatgggcagagggatatgggtttgttgtggagaacgaggttacggtttgtaacaatcagtgcaagaatgctgcgccagattacctcgaagcatgaataaatctgaacaataaaaaaggcacttgcccattttctgaccaagtgcctgtgtctggtaggccgtgcgcgattcgaacgcgcgaccaacggattaaaagtccgctgctctaccggctgagctaacgacccgaaggcggcaattataccaattcattcctcattggggaacactttatcgtgattagaagaaagtgatcacatatgttgccgggttattctgctgaaactgcgtatgcctgagctgataatgataatgaaaccggtttgtaccaggcaccagcgggtaaataattctgcttcgggcagaatttgcttacgatcagggccaagcagaaattgggggccagaaaaaatatgtccatatttatgcacttcggactccagcccaagagagagtagccaccatcctattggcagcattataagggatagtactatccctaagatccattccataacgttaccggatagattgacaagtatgatggcgttaacgcagagaacaaagagtagaacgtaaagataaaaacctcctcccatacctatggcaccattgcgggcgattaactcattcaggttgtcagttgaggaccagctaaaggtgatggttttggccagccagagccagggtagtgcgctgataaccagaataagcatttttcttgtgacttgtgcacgctgtttacgtaggctgaagaaactgataatcagcgccagaaagatgacaaggggtgcatacagcgctgtatagcgaactggtctttccagtgtggaaatcaatgttggcccaagccattcaaagatatgtcgccagccttccccccagatgtctttgttaataacgaaccagtaaatattattcgatccagtgatatcggcaatactttcctgggttacgctgattgaaagtaaccccaggctgataagactgactgtgagtacccatcctggcaagcttataaagggtctggtactggaaagtattctggagctgatccatgcggctcctgctccgatccatagtagtgtcagaataaaaatgaatataaataatatattgccatcaaacagaaatagctctttgaggttgtaaggtatttggggcaagtgcaagatcagccagagcaggcttgtagctcccattgacaaaagaattacgggaatccatgcactgaataaagacagatttgtaggggaatcagtccggtgagagtggggtgtgaatggaatgggcttgtccggtacagggttagctatgggatgaggtatttcaatacggcactcaagttgtctggattcacccaacccccatgcaatcagtccgatcagtagtggctcggtaatatctgcattacgccctaataacgccatttgaatcagttcgatgactatcgaccagaagaccagtgccaggactatgccacgaaaatttccaccggtatatggagcgaaccataacagggcagaatagatgtaaagagacagaaccaatgccatagcattggtaagcatggagccctcaagcatggtggcgaaggggataaaattgaaagtgccacctatcgtgaaggagaaaggtgtcagggcatgaatagtccaagcagtcagtagcgaccagaaagcgacgactatcctggtgtgtggactggttttcagtaacaaaacgcttgccagataacccgccagtaaccccgatatggttgatgtgtcaaggagctgatttacaatcgtaatttttccggccagaatgaatagtaatgctcctgtcagccagactaggggttttggggccagtaaggaaagtatgcttccggctgttatgatgcttgctgcatgtatccagatagaggagaaactgaagtcaagtgtttgcaggggtttgacagcatccttgaatttttgccagtccagggatggaacgagaggtaataattcactgcataaccagagcaataatattgctaaagggatagcagccttgccacccgggaaagactgcctgcctggccataataaggatatctgttttatcaggacacttactccgattcctgtgaacaggcctgttatgttccagaatacatccactaatgctgcggatcgggtaggtaaccatatttgcaggatttgtagaatcagtgagaatataaagctgattatggttaataacaataaatcgggtatcttgttttgcgagtggattactcgttctccggcaatgccaagcgggagaaatagtacgatattgcctaatatgtcaccgatggacgttgtccattccggatttataaaaaattgttcaagtgctccaggagcggcgtgtgtgaaatttcctgggtaaagtgatccataagtgataagtaggacgagaacagtcagtacttttgtgctgaaggataaatgtctgctgctatggctgatcatcatgggtttttatccggtatttcgtgtctgttatctgccgcagatttcagtgattcaggttataacgttaaaacatccacttcttttgcagtagccgggtagataattctctataattattggagtgtacggtcatatcaaaaatctctggataaatatgaaatgtttctgtttgtgtaaaataattatccggattcaagggcaagcgatcgtactgattacttaaaacttttccggtccctgacttcttctgattttaaacctgatatttcactatgctctggattaaatcgttacatatcatttctatggtgacctggtttgccgggttgttttatttgcccaggttgtttgtttatcacgccatgtgtacggatgaggcgggcatagatcggttcaaggtaatggagcgcaagctctattatggcattatgaccccaggtgggttattgacgatcatttttggttcgtggttatggcttggttacggtttttctggagggtggctgcacaccaagctggtactggtggttttgctgatcgcttaccatttctactgcgggaagttgctggtcgatttcaagcatgatcgtaaccggcatggccatgtttactaccgctggttcaatgaattgccggtactggcgctgtttgcgattgttatcttggttgtggtcaaaccttattaacagggtagtgcaaagaatgaatcagtcttctgcgattgtctggcctgggaatagtgtatcggtataaccgaattttcgcagatcattgattcgcataggatagagtatcccattcaggtggtcacattcatgctgtaccacgcgcgcatgaaacccggcgactgttctgtcgatgggagtagcggtttcatccaccccctgatagcgtaagtgagtgtagcggggaaccagtccgcgcatgcccggaatactcagacaaccctcccagtcttcttcctgttcttcggtcaatggggtgagtatggggttgatcagcacggtaaatggcacactttcaacatccggatagcgcggagagtgctctatcccgaagatgactacttgcaagcttatgccgatttgcggggcagccagcccggcgccattgagtgcagccatcgtatcctgcatgtcctgcaataattctttgagtacaggtgtgtcaaattgctcaattctctgcgcaggctgcaacaggcgtgggtcccccatttttaatacgggtttaatcatcattattccttaccagatgctccaatatatttctgacattcatcattgcatcttccagtgccttgtgcgcagcttgcagcgggatagcttgtttgctttccccgcgtccggctgcatgattagcaatggcggcaatggtcgcgtaggaaatacctaattcccgcgtgagaattgcctccggcatacccgtcatcccaactatatctgccccatcacgttccagacgattaatttctgctgctgtttcaaatctggggccctcggttgcagcataaacacctccatcaataactgattcacccgcatcctgtgcagcctttaggagacagtcgcgtgcaatagggcaatagggttgtgtaaaatctgtattggtgatggctttgtcagatcgatcatgaaaagtagcttcccggctatgggtgtaatcaataatctggtcaggaatgacgatttttccaggttccatatctttacggataccgccaaccgatgtaacagcaatgatctttttgacttgctgggtatgcagtgcccagatgttggcacgataattgaccatgtgcggcggaatggtaatgccatggccgtgccgggacagaaaaacaacttcgtgctcgcagatcgtgccaaaaatcaatgaaccggacggttctccataaggggtccttatgacctgacgatgggtaacttctaggccagccagtttgttcatacgtctgccgccgatgattgcaatcatattgatcctgatgataataagttatttttttacatttatattataactggctacatacgcgtaatacgcgtgcaagagaagataactgcaatcaagaagattgttattgatcaattaccttactgtgcacctgtcgagatattttgcagcagtgacagtagctgatcttcatccagtatagaaatgcctaactcgattgctttagcgtacttgctgccgggatctgatcccgcaacgacataactggtggcagatgaaacgctgccggttaccttgccgccttgttgttcaattttgattctggcctgatcgcgcgtcatggttggcaaagttccggtcagaacgaaggttttaccggaaacagctggattggtttgtgctgattgttgtacgccatggtttggtatttcccactgcaacccgctatcaagcagttgtctgatcacttcccggttatgtgcttcagaaaaaaaatctataatactttgcgcaactatcgggccgacatccgggatttgttgtaactgctcaatatccagagtcatcagctgatcgagatcgcttgcctggttagcaagcgccttggcagtcgcttcaccaacatgacgaatacccagcgcataaataaaacgcggcaacgtagtttttttgctgtgttctattgcggtaacgaggttgcgtgcggatttttcagccatgcgttccaggcccgcgagcgtatcaatgttcagtttatacagatcggcaggggtatgcaccagttcgcggtcaattaattgatcaatcagtttttcccccaatccatcaatatcaagggcacggcgggaagcaaaatgccagattgcctgtttacgctgagctggacaatataaacctccggtacagcgggtcactgcttcacccggtagacgtgccgcttttgatccgcataccgggcaatgatccggcatgatgaacggttgagcgtgagcagggcgctgttccggtattaccgccaccacttccgggatgacatcgcctgcccggcgcacaatgacggtatcgccgatcatgatctgtttgcgttgaacttcatcttcgttatgcagggtggcattggtaactgttactccccccacaaataccggggccaggcgggcaaccggcgtcagggcgccggttcttcccacctggatttcgattgtcagcaattcggtactggcttcttgcgccgggaatttatgtgcaatagcaaaacggggtgcacgtgagacataaccaagtgtttcctgttgcgtcagattatcgactttgtacaccacaccatcaatttcatagggaagggataaacgtaaggcacccatttcatggtaataggttaatagtccagccacgcccgttgtcgtaccattttgctgcgccaccagaaactgttgtgatttaagataatctagtatttcgctatgtttggaaaaaaacggctgatctttatgagaaagcacggcatcataagcaaagaaagtcagtttgcgtgcagcggtgatattggaatccaactgacgtagcgagccggcagcagcattacgcggattggcaaagagcttctctcccttgtttcgctgttgttcattgagatgctcaaagtctgctttcaacataaccacttcgccacgtacctcgaactgatcagtgacaggggctgtctgcaggcgcaaaggtatggatggaattgtgcgcagattcagtgtgatatcttccccggtataaccatctccccgggtggctccgtttgtcaatattccatttgtataaaccaggctgacagccagtccatcaaatttgggttcaactgcgtaattaacctgatccacattcagtgcttcacgaatgcgcttatcaaaggcaatggcctcatcttctgtaaaagcattggtcagtgacaacatgggtgtctggtgagtgagccgagcaaatacttttagcgggggggcacccacccgctgggtaggtgaatccggtgtgatcagatgcggatattgctgttccagttgttgcaaggtgcgaaaaagcttgtcgtaatctgcatctggaataattggcgcatcctgcacgtagtaatgaaagtcatgcaacgcaatggttgaacgtaatgctttcaggcgttcttcaatcattttttcggattccatgtcaagaattaccatgtgaggggagtagaatggggaaatcccggttgtaggataatagaaatagattgcgtggagagagtttccgggtttttcataaactttgcgcaagacagattgtctaaagtgcttgtaattttatttacaacaggagaagtaatatgaatatcagattgaccggattatcaatcctcatcggcgctttatttgccattcccgctaccacggcaacagctgtttctccggttgctgaaacattaatccaacgaggagaagcagttacccttatcctggcacaagctcaacaaaatcagtaccagagcaaggaaggagaaggtagggcccaggaagaacaaggaaagggtagagaaaaaggcggaagtgatgcaggccattcagatcatgatggccatgatcagggagatcaggcgaaacaagaaaagggaaagtgcaaaggaaaagataagagtaaagataaggaaggatatgatcgaggagacaaggccgatcatgagcaccatcatcacagctatgcacataatgttgtgaggcaagcagaagcacttggtctttccgatgaacagcttggcaaaatcgtacgcattcatctgaaagaagatcctaaagtgcatgatcatcttaaaaagaaaatgaaagaaagcatgaaagctttccgtaaagcggttgctcaacccgccgttgatgaagaaactttacgcaaactggggcaggatcttgttgatagcttcaatgaaatggttgcccaccatattgaagagcgaaaagctattcgcagcatattgacgcctgaacagatcaaaaaattgaaagatgtaaagacagagcatgatcattgatctgatctagcaacctggtgtcggcagtagtaaagatatactactggcagtaattttgtgttctgactacggctctttatggctggctgaaggatcccgataaaacggatattcttcagtcagccgtattcatttcagccccatgcgcccattcgggattggaagcctgccataaaccgctttatgatcgaatctggtgactgactaaatggtcatctgtaattaaccggcaaaggtgtttacacaaaaagctttacaggctcgtcttctccacttattgcctgttatttctgctttcgaccatagagtccttgtttcgtaaggatctgttgtttagccaaatgtacgtggtgatccagaatatcattatgtatctgtctggtaagtctgtcccagttttcgtttgtggtcgtggttggtcagcatattttgcaggtgtgtcattcgaggttcggtgatggtgcggatttcagcatcacgagcgagtatctgctggataaggtcaattttttttttctgttgagtttcacttaatggctgccgggtgtgctgttccatcagtcgattggtcaggtacttacaatcgtgctccagtgccaccagtttatcccagtcgctgttttttgctgcttgcagcatctggttggtgattgtcaggattgcttcatacgcggtgatcatttgcataccgtcgttgctgtcatccggtggaggtttggatgagttgttgagattcatatagttgcacctgtttcaactgtttgttcaatcatcgtgttgacagctacttttgtatctattttgcctacaggttgcttttcaatggaagcccaggcttcttgcaattcgcccagcagctggctgacttcttcgatgatggccggatcattctgaaggttggcggtaagcagtcgggtggtcatgtagtcgtagagctgatcgagccgcgtggccagttctccgcctgctgttttgtccaggctggctttcaggccgtgatcgataatcataatcgccttggagatcatctcccctttggcagcaattctatgttgctgcatgtatagtcggctgcaatctaacgcctgccgtgcgccttcaaacaacatcacgatcagcttgtgtggatcggcagatgccacgccggattcaactccgacactctgatagttcttgatcgctcggccaggtgattcaatgaacatgatcgttttctccttttcgaaatgagaatattggttaatgatcgttatctggcgcgattatttgtcgccaatcttgggcaaatttgccaattgctgctgcaggtaattgttggtctgagtcatgctggcaaccatcgaatccagtgcggtgaattgtgctcgcaggcgtttttctacttcccccagacgatgttccagtgcctcgcgctgtctgccgatgcctttgattgtgctgttaatgccgtccatgcggttgttgatcaggccatcgcttcttgccatgccatcgagcagctgatccagccgggtagcaaaaccttctgttccttccattgtctgtgtggaaaaaaatgcagccacgttcttgtccggatcaaccaatactgcgctcagtttgccgttgtccagttttaatgtgccatctttttggaagctgatacctagttcggatagtgaattgattcccccgacagctgattggttgccggtcagcatggctcgtaccctgttttgcaccattctcacagtggagtccccggttaatactgaggcctgtttgttggcggtatcgtaacgagagagattaccaatgcttttctccagttcgttgtatgctgtgacaaacgcctttaccgctgtttctacactggccttatcctgctccactgtcagtgtcatgtttgtgcctggattggccttgagcagattgaacgttacgccttccagtgcatcattaatagtgttggaagatttttccaccgctatgccatcaatcttcattttcgcattttttgctggtaccgcctcggccatgttagtaacgccaccagtagatgacgcatcaaacgccagctttgataacccggtgttatcggtgtgattgccatctgcatcgtctaccgtaattttcagtgcattggttaatccggtatctctggaagcaattaccagtcggttcccgttgccatcgttaacgatgcttgccgttactccggtatttgcttcattgatcgtgttgcgaatatcacttagtgtggatttggctggatcaatcgtaatagttttagcagccttctctgtattggcggtaaacgtatcgtcttcgttataggtgccgaatgcgatagtcagcgtaccgttaccgattatcgtatctgtcgtgacaaaagcttctgatttgattttttgcgcctgcgccagtgattgcacttcaatttcgtgcacacctgctgctactttggcagatgtacttactgtggccactgtcgtatctgtcaatgtggccttaaagccggtgaataacgcgggttttgccagcgcctttacactttcttgaaacgacgataaggcactttttagactaccaaaggcagaaagctgtgcctgttgtttggcttccttagtattaagctgagtgagcgggcgctgttcaacctgcatcaatttgctgataatcccactgatatctagccccgaaccaattcctggtgatgaaagcataatctatacccttggtgtgatctgtgttatttcgtcaatttttaccattgccaattttcctgttgcctttggattactttagtgcgtcatctcgtaaagacagcgcttttgtctccgtgcacttgttgtgttcacaagatcgtcaattaagctgtggcgacgctgagacaccatatcggcaagaacgaaagcgactttacatattctgttaatatcgtttctggattacttcacgccgtttacgttcgtaatatcagggattttatgtacagcgggtgaggatgaagtaggtgtttgtgtaaaagtaagccggaagggtgtagtttgtcgaggtggagatatactttaaggataccttagagccagcgtcgtactctggttttgtagtcccgataggcatctccgaatctggcttcgaggtgcgcttcttcatgacggatgacgccgtagcgtaacattgcccagatcagcggtgcgaagaatagaggccaccaggttgacagtagtattgaggtgccgatgaaaattaaccagtcgccgagataaatcgggttgcggctgtaacggaatggcccagtagtgcacaggctggaggctgctttataggggttgacggtagttcgatagcgccagagagtgatggctgtccatgtaagcagcgccaatccagcgattatgcccagccaaccgagtggttgagttgccgcactccagccccagtggagtgcttgaatgttacgatcgatccaccagccggcgagtatggctgcagcgtagggtgcgggcgggagaattaatgtgcgtggacgatgaatgttgtgatccatgatgattcagtcagttcgtcaggacggagaagattcagggttcgaatcaaatcggtgtatccagtatatggcagcatacctgatgcaaaaaaatgtgcaaaacgaaagaagtagctttatgttgtactttaaggatgatggacgacaaactgctcgaccacattttcttttttgttgcggatggcgagtaagggaaaaacagcaagccgttcgtttttagatgcaacagtaatgaattacttgatagaatgtagccggtttgtattaaccatagccgacgagagggatgaagtgtcggctggtgatctgtgccgatgatttgaaccggtttttcaggccgggaaatactgatcagggggcggattgcagggaggcctgaaaggttatcaggtaagagatttgttttaggaaatttgaagaggagtgcaaatgaacaaggtgatcgtcgcagctttcgtttctatttttgtactgggttccacagcaacgtttgcaagtggtaacttggagtcttccttagcaccgatcagtgctaaggatctgttgaattatctggcttgcaaagataaaaaaccaactgatatcgtgaaaagccataccgatgttgaaaatggaaaaatcgtcagagtaaaatgtggcgatgccgtagcggttgttcagcaagcgagagaaaaatcgggtgacgcctggaaaggcggttattgatccgttttgtttgcataaaaagggcctgttaatcaggccttttttagccacttctttagtatttcaatgaatgttttgttccagcgcatcaatcattagccctgcaacatttattcctgtttgatcagagatttcccgcataccggtcgggctggtgacatttatttccgttagatggttaccgatgacatccaggcctatcagcatcaagccgcgagcataaaggatttgtccgagttcttcagaaattttcctgtcatgtgctgacagcggttgtactttaccggtgccaccaaccgccagattgccacgcgtttctcccggtttggggatgcgtgcgagtgcataatcgacaggttttccagcgattagcaatatacgtttgtctccttcgcggatttccggtagaaagcgttgtgccatgatggtacgagtgccataacgtgttagcgtttcgatgatgacgccaatattatggtcagtgttctgcatgcgaaaaataccagcacctcccatgccatccagtggtttcaggataatatccttatgttcggcaagaaactggagaatcagctgttcctggctggttaccagtgaagagggtataaattgtggaaattctgtgattgccagtttctcattgtgatcacgaatgccccgtgggctgttcacaacgtaagcaccctgacgttcagccagttcgagtagataggtgctgtagatatactcggtgtcgaagggaggatccttgcgcatgagcacggcatcaaattcggtcagtggaatttcttccataacgccttcctcataccagcgatgggggttatccggtggatcgatgagtgtcagtgatcgtgcgaaaccaattacctggtgatttttccaggccaagccactttgttgcaaggtatacagctgatggtgacgggacgccgcttcacacatcatggcatagcttgaatccttgccaattttgatactgtcgagcgggtctagaataaaagccagtttcattgggtttcggccattgccagtgtggacaatggggtttgaatataccgttccagctcgatggcagaggcaagtagtgccagcctggcgattacaccataggtataaaaacgattagggattgcatccggaggggcggagggatcggtctgcatacaggtggtatcaaatgccaatggtacaaaatgcatgcctggtgcattcaggttttcattaacaccccgactggtatggacccggtagaaacctcccactacgtgatgatcgatcatgtagataacgggctccgctacggcctggtgaatgttctcaaatgtatgcactccttcttgcaccagtacgtttttcacaaccagcccctccttgattgtcgtcattttgttgcgctgtttgcggttaagtttgtagacttcagtaccatctttgatactcatgattcccatgccgtaagtgcctgaatcagccttgacgataacaaacggctcttcactgattccgtattgtgtgtatttttccctgatctggttcagaatttcatctacggccgcagcgacacaatccagtccctctttttcttgaaaatcaactttcccgcaagcggtaaaatacgggttaataagccagggatcaatatcaatcagctctgcgaaatcctgtgctacgttgtcgtaggcgctgaaatgccaggatttacggcgagtggcccagcctgcgtggagaggtgggataattatctgatccagattttgcaggatttcaggtactccgctggacagatcgttattcagaagtatggcacaagggtcaaaatcctgaacaaacagtttgttccccttgcgctgtactggctccagtaacaaaggctcaccactaggtagtggtacggatacaggatgatcaattcctggcaatagtgagccgatgcggatattcataccagcctgctgcatgatggactgcaacatggcaatattttgcagatagaaaatattgcgggtgtgattttctggaatcagcaaaacattatgtgcgtccgggcagatcttttcgacggcattcatcatcgcctgaatgcatagcgggatgaaagtcggattaaggttgttgaatccaccaggaaacaggttggtatcaaccggtgccagtttgaaaccgctgttgcgcagatctactgaacaataaaaaggcacggtatggagttgccattgtttgcgaaaccagtgttcgatagttggcttggctgtcagaatacgtttttctagatcaaaggtgggtgcattcagggtattggtgagatggggtaccggcatgagagatccattacttggaaataaaccggctgattataacaccgcacctgaatgggcagattctgtctataaaaaaggcaataagcacacttgaaagagtgcttattttaaatgttgtatgtcgtggcacgattgaatttattacacaaaatccacgtatgttattataatgcgcggttctaggacgggagatggaatatgtacgcagtaatcaagacaggtggtaaacagtaccgagttcagatcgggaataaattgaaagtggaaacactgcccgtggaagtaggaagtgatattcagctggatcaggtgctgatggttgcagatggagaaattgtttctacgggtgcgccgttacttgatcaggcaaaagttagcgcaacagtaatcagccacgggcgacatgacaaaatacgtatattcaaaatgcgccgtcgcaaacattatcggaaacaacaggggcatcgtcagaattacactgagatccagataaccggtatttctgcataaggagactattcatggcacataaaaaagcgggcggaagctccaggaacgggcgtgattctcattccaagagactgggtgtgaagcgctacggtggtgaagtaatcagggcgggtggaatcatcgtgcgtcagcgtggtactcagttccacccgggtgataacgtaggaatcggacgtgatcacactctgtttgctaaagtggatgggaaaattgtttttaccatcagaggtcgactgaatcggagaacagttgcagttattccttcctgatgatccgattgatcggactggatagctggaaaaaagccccattgcttgaatggggctttttattttgtatggttttttaccaggataaatttctccgtctgcaatcgaaatagttgcagcggagcactcatgaaatacatagatgaagtaaaaatacaggtctttgcaggagatggcggcaacggtgttgccagctttcgccgtgaaaagtttattcccaaaggtggaccggatggaggagatgggggccgtggcggcagtatctatgcattggcggatcacaacctcaatacattgatcgattaccgttttacgccagtttttcgcgcaaaacgaggagaaaacgggcgtggctctgattgttatggcaaaggagcagaagatattgtattgcgtatgccggtaggtacaatcataaccaattatatgacaggcgagcttgtggcagatctcaagcaaaatcaacagaaagtgctgctggccaaaggcggtaagggagggttgggtaatctccatttcaaatccagcactaaccgtgccccccggcaatttactcatggtgaggcaggagaacagtttgaactcaagctggagcttagggtgctggctgatgtgggattgcttggattaccgaatgccggtaaatcaaccttgatccgtgccgtttctgcagcgcggccgaaagtggctgattacccgtttactacgctttatcccaatttaggggtggtgcgggtcgatgccgggcgcagttttataatggcggatattcctggcttgattgaaggtgctgcggaaggggccggtctcggacaccgttttcttaaacacctcagccgcactcatttattgctgcatattattgatgtggctccttttgatgagaatattgatcctgttcaatcagctagggcactagtagacgagcttcgcaaatttgatgaagtgctttatcgtaaaccacgctggttaatatttaataaggtagatttactgcctgaggatgagcagcaagctgtttgcacgcatttgctgcaggcgcttgactgggaagatcgctggtttgccatttctgctctaactgggagagggtgccaggcgctgacctatgccattatgggatatctggagcaactacagcctgttaccgaagaaacttgattcttatgacacgatcaattctgcaatctgcacgccggattgttgtaaaggttggcagcagtctggtgacaaacgaaggaagcggccttgatcgtcaggtgcttggaggctgggctggacaaatttcccgactcaaaaaaatgggcaaggaagtcgtgctggtttcctccggagcggttgctgaaggtatgcagcgcctgggctggaaaacgcgccccgccgcgctctacgagctgcaggcggcagcggcagtcggtcagatggaccttgcccaggcctatgcagattgtttcagtgaatataaattgctgactgcccagattttgctgactcatgatgatttatcgagtcgtaaacgctatctgaatgcccgttcgacgattctcacattgttgaacctggatattgttccaattatcaacgagaacgatacggtggtttctgatgaaatccggttcggtgacaatgataatctggcggcactggttgccaatttgattgaagctgcggtgttggttatcctgactgatcaggagggtctgtttacgggggatccgcgtaagcatgccgatgcaacactgatttccgagatcagtgtcagtgatccgcatatcgagactatggctggcggaacgggcagtggtatcggtcgtggtggcatgcagagtaaagtgatggcggccagacgggctgctcgcagtggagctcatacagtgattgcatcaggcagggtggaaaatgtgctggttcgcctggcgaatggagaggcaattggaaccagtctgctggccgatatgccggtgaaggttgcgcgtaagttatggttggccgatcatcttcaggtgcggggtagcgtagtattagatgatggcgccagcagagcattgctgtctggaggcaaaagcctgctgcctatcggtgtggtggaggtgagaggaaattttgaacgaggtgaggccatatcttgcctgaataccagtggccgcgaaattgcccgtggcctggtcaattacagcgcacgtgaatcacacaagatcatgcgtcgcccctctagccagatcgaagctgtactgggttatgtaggtgaatatgaacttgttcacagagataatctggttattctgtaatggcttgatctgctggatttacctgtttagaaggtttaatactatttacaatgactacccatttctctttgcccggatcccggttacttcagtcttatcatgcccccggatggcttcctggaggaaacgcgcagaccatttttccttatttcgttaatctgaatccgacaattcgttaccagcgtgagcgctgggagatggatgatggagattttattgatattgactggctggagggggagccggataaaccgttggtagttctgtttcatggtttggagggcagttcacaaagccattatgcgttgagtatcatgcgattcttaaaaacattgcgctggcgtggtgttgttattcattttcgtggttgttctggatcccccaatcgtttgccgcgtgcttaccatgcgggtgattcgcaagatattgatcgtatgttgcgctatgtgacgcagcagaacgattcgcacaaacaaaatactacctgttatgttgtcggcatatcgcttggtggtaatgcgttgttgaaatggctgggtgagcaaggtacccaggcagccagattgattgcaggtgccgttgcagtttccgttccgcttgacttggcagtagctggaaaggtgctcgatttcggttttaaccgggtttatacccgtcattttcttatcacccttaaacgcaaggcgttgagaaaaaataaacagtttcctgggttgctggatgccagggcagttgcggcctgcaattcattgtatgagtttgataacctggttacagcaccgttgcatggttttcgggatacggatgattactggcgccaatccagcagcaagccgtggcttggatctgttcgtgtgccaacactgctgatcaatgcgcgcaatgatccttttctgcctgaaagtgtgctaccacagaaatctgaagtatcatctttcgtttcactggagtttccgcggcaaggagggcatgttggctttatgtatggtgcttttccggggaaactggattggctgccgcagcgcatcgtaaatttcttctcgcttgtataagatccggataatattccaaggtgaaggctgaagttggaaaaacggatactgctggagctgtactgaaaaatcaatcctgtcactgctcataattacgtgaataccttttggctcagtcttgctcccattttatggctgactattattgctgcattgacggggatgatatttgatatagcaatcgtactgggtctgtacagcgtcatcctgctcgggattgttatttatcatctttatacattatattgcctggatcaatggttacgccactcggattattcctattcgacagtgcccgatagatctggtttgtggggagtcgtttttgccagattggcacgtttcgtcaggcgtagcgataaggaacgcctgggactgaatctctcgctggagcgactgcagcgcgcgacatctgctttaccggaaggaattgtcatcctgggcgacaaagatcagatcgagtggtgcaattcgtctgccgagttgcacctgggcctcaatcttgggatggatgccggccagcatattactcgcatggtacgtcaggtgcgatttgtggcttatcttgatgcgggagatttcagcaagccttttctactcaatcagacacgttttcgcgatacgctgctttctattcagatagtgccttatggtgacagggaaaaattactgatcagccgggatgtaacacgttttgaaaaacttgaaattatgcggcgtgattttgtcgcgaatgtctcgcatgaattgcgtacacccttgacagtaattggagggtttcttgaaacgctgctggaagaaaacaaggtatccggtgacatggagaaaaatgcactgcgactgatgtttgaccaggctacccgcatgcgccgtctggtagaggatttgctgacgctatcccgactggagaatgccggaaataatctggctgaagaaaaggtagatatcgttaagctgttacagggactttatcaggaagcccaatcattaagcgctggccgccatactatttcccttgatcttgccagccatgccatgctgcttggcagtgaagatgagctgcgcagcgcatttgaaaacctcatcagtaatgctgtgcggtacacccctgaaaatggggtgatttccctgaactggacggtggaaaatgggaaaggattgttttacgttcaggacagcgggataggcattgagccgaatcatattccccggttgacagaacgtttttatcgggtggatcgtagtcgttctcgcgaaaccggtggcaccggtctcggacttgctatcgtcaagcatgttctgaaccgccatcaggcgagtatggaaattaccagtcagcctggggcaggcagtatttttaggatgtggttccctgaaagccgagtattgcctgctgaaaatgtgactgagtaatatctgggtgtgtagagtaagcttttctggtcagggacttgttcgacgttccatgtcgtctgatattagctcgctgttgtttttattccactccttaaactccttttttggataaaacataaaaacagtgctacacgagtaccattatagccgtgttagacttatggtttttcgcatcatattttgacagcgtcaatacccacaagatgaatttttatgcattctaatttttttgttgatctgatgatgcggcaggtttaggatcttggcaaaaacactgccagaaccagtcagtttacccatgagggtacttactttaaccaaataactagaaattcaaccagggagggtaaacagtgggcgttaaaggacagttattgcaagatccatttttgaatgttttgcgtaaggaacatattccagtctccatctacctggtcaacggtatcaagttgcagggacatattgattcctttgatcagtacgtggttttattgagaaattctgttacacagatggtttataaacatgctatttctactatagtaccaggtaaggcagtttcaattccggtgccagctgaaacactgcccgagtaagatgaatcatgacatcggaacggcagcggataataccgcaatattagtagatatcaattttggcaaaaatgataaggaaagtctggatgagctgaaagagcttgcttacagtgatcaactgtccatagttgcggtggtcgaaggaacacgaaagcagcccgatcctgctactttcatcggaaaaggcaaggtggaggaaatcagccagatagtggtgcaaacacaagctgcaatggtgatattcaaccacgagctgtctccaatacagcaaagaaatctttccacagcactggcctgtcgcatcatagatcgtaccagtctgattctggatatctttgcgcagcgtgccaaaagccacgaaggtaaactacaggttgagctggctcagctggagtacctttccacacggctggtgagaggatggacacatctggagcgccaaaaaggtggaattggtctgcgtggccccggggagacccagctggaaactgaccgacgcttgctagcaaagcgcgtaaaattcctgaaggagaagctggctaaacttaaacagcaacgagatgtgcaacggcgcgcgagaaaacgctctgaaatcatgtccgtttccattgtgggttataccaatgctggtaagtcaactttgttcaaccggcttgttcggtcggatgcatatgctgcagacaagttgtttgctacgttggatacgactaccaggagactttttcttccagaacgtggtttgatcgtaatttctgatacagttggttttattcgggatttgccgcatacgcttgtcgccgcgttccgtgccacactggaagaaaccatacaggccgacctgcttttgcatgtggttgatgtatccagttccaatcgggatgtgcaaatcagtgaggttaataaattattgcaggaaattggggcagatactataccgcaaatcctgattttgaataaaatcgacctcattgagcagggttcgtcagaaaattacatgcgcgatgagtatggtagaatcgcaagaattcatctcagtgcaaggacgggagcaggttttggttatctctatgaagcgctggtagaagcgtttgatcaaaacttgaataaattaagcagcattcagcaacatccgtaagcatgaacgacaatgtccgtgccacttctataaataatgaaaaggactaaatcaacatgggcttgaatgatccgcaatgggggaaaaggagaggtaattccggtcctcctgatcttgaagaagttatgcgcagctttaatcaaaaaataaatgagctttttggtcggaagggcggaggcgatagtaacgggggttctgatgggaaggatcccgatggaccaagtagtacaggtattgcaatcattgggttcctgctcttggtcgcgtgggcgggaagcggattctacatcgttgatgaaggccatcgaggagtcgtgctgcgatttggtaaacatgtagaaacaacgcagcctgggctgcgctggcatgttccttcaccaattgaatctgttgaggatgtcaatatagctcaggtgcgtacagtagaaattggatatcgtaataatgtacgcagcaaggtgctaaaggaatcattaatccttacagatgacgagaatatcgttgatattcagtttgctgtgcaatatatacttaataatcccgaagattttctgttcactaatcgcgagccggaagacagcgttttgcaggtagcggaaacagctattcgagaagtgattggtaccagtaaaatggactttgtcctttatgaaggacgtgaagaagtggctgctagaacgactgtattaatgcaaaaaattcttgatcgttatcagattggtatttctatcaacagggtaactatgcagaatgcacagccacctgagcaggtgcaggcagcttttgatgatgcggtcaaagctaatcaggatagagaacggcaaagaaacgagggacaggcctatgcaaatgacgtgattccaagagccagaggtgctgcagcccgtttattagaggaagccgaaggatataaacaaagggtaatcacagcctcagagggtgatgccagtcgttttgaacaggtgctggtggaatatgccaaggcgccggaagtaacacgtgagcgtatgtatattgatacggttcagcacgtattatctagtaccagcaaaatcctgattgatcaggaaaaaggaggaggaaatctactttatctgccattggacaaattgattcaggctgattctggggtggcgaaatcacctacggggacaattaaacaacaaaacgaaaatcaagatttttcctcagatataagctcgcgctcgcgtgagtcttttcgcagtcgtgaacgggaggtgagataatgaaagcgatttcatctatatttgctgtacttttgctggttttggcagttgtgggtagttctgctatttatattgttgatcaacgtgaacaggcattgttatttcagctgggggaggttgtaggggtaaaaacatctcctggtttatatttaaaaataccttttgtccagaatgttcgtttttttgattcacgtattttgacgatggattcagaagaacctgaacgttatatcacttcagagaagaaaaacgttctagtggatctattcgtcaaatggcgtattgtagatgtaaagcagtactacgttagtgtgcagggggatgaaacgttagcacgagtacgtcttgcacaaacaataaattctagtatgcgtgatgaatttggtaatcggacggtgcatgatgtggtttctggtgagcgcgacaagattatggaggtcatgcgccagaaagcaaacacagatgcagaaaagattggtgtagaggttgtggatgtacggcttaagcgtgtggatctgcctcaggaagtcagtgaatctgtttatcgcagaatggaggcggagcgtaagcgagtggcaaaccagctgcgatcaacaggttttgcggaatctgagaaaatacgggcagatgctgatcgtcagcacgaggtgattttggctgaggcctatcgtgacgcacaaaaaatcatgggggagggtgatgctcaagctacggcaatttatgctgaagctttccagaaggatgcaaaattctatggattttaccgcagcttggatgcgtatgaaaaatcctttagaagtaaggaagatattcttgttgtggagccaaactcggagttttttaaatatatgaaagatccgacaggccataaaaaataaaaatggaagcaaagctataccttgagttgaaatatcatgctaaaaatcagcatttcaggtattggaggatggctgatataaatagttgtttatatagaataatattttattaatgattgggatttaatatgtgggatacctttctgaaggcaattgcactgatgctgattctggaaggtatctttcctttctcgtctccaggtgcctggcgagaagtttttcaaaaactcctgcagctgaatgacggccagataagatttatgggtctcagcacgatgctgactggtctcattattctttatctagttagttgattgatctttcctctgataattttgactgttcctgttattgatccaggtttaattcattctgggcaacattaaaaatgcgtaactggttgcttcctgaatatatcgaagatgtactgccgcgtgacgcttatcgtatagaaaagattcgtcgtcttgtcatggacaagctgtttgttcatggatatcagtttgtgatgccacccctgttggaatatgtggagtctctgctggccgggagtggcagtggcatgaatctacgtatgttcaaggttgtcgatcaactgagcggcaggatgatggggttacgggcagatatgacaccgcaggcagcccggattgatgcacatttgctgaacaccaatggtgtgactcggctttgttatgccagcagtgttgttcatacggtacctgatgaaattacccgcacacgagagccatttcaggtgggggccgaattatatgggcattccggtatcgagagtgatcttgaaatccagcgtttgctattggaatgcttgtctgtttccggtatccagtcgattcatcttgatcttggacatatcagagtgttccgcagtctgatttatggttcaggaatcaggcccgagtttgaaatggagctttatgctgcattgtgggccaaggatacgagtgctcttagggaactggtatacactggcctgaatgacttggataagacggttcgggaagcattgctgctgttgccggagttgtacggagatgaaactgttcttttacgcgcacgcaaatacctaccgaattttccggagatcagggaggctctggatcaactggagcatgttgcgaaggcacttgaaccttatgttgacaggataatttttgatctggccgacttgcgaggttatcactatcacacggggatggtgtttgccgcatatacacagggaagccctgtcgcgattgcattgggagggcgctatgatgaaatcggtaaatcattcggtagagcgagaccagcaaccggattcagccttgatttgaaacaattatcacgtctgactgatataaatgattatccccgaggaatactggcaccgtggaggccgcaggatgatgcacttgcagcaatgatcaagcagctgcgtatcgcagggcatatcgtggtgacagaattgcctggagaaaacagtaaagaagtagcggggtgtgacagaaatctggttttacggaatggcaaatgggaaatttgccctgtttcagggtaaacagacatctgtagtagggaatctctctttaaagatagggccccgcgctgttggaagaatatgtctaaagcaccacgctgtttacagcgtggtgctttattttggaaataatttctgagagatcgatgagtgtatggtcaggaatgttgtagtcattggaacgcagtggggggatgagggtaagggcaagattgtcgactggttgaccgatcgggctgcaggcgttatccgtttccagggaggacacaatgcggggcatacgctggtagtaaatggtgagaaaactgtgctgcatttgatcccttcaggaatattgcgcaaggatgttatttgttacatcggtaacggtgtggttttgtctcctggtgcattgttggacgaaatgagtatgctggagcaggctggtgtggatgtgtccggcaggctacgtatcagcgaggcttgtccgttaattttgccctatcacatcgcagtagatggcgctcgtgagctggcaaaagggccggaaaagattggcacaactggcagggggattggcccggcttacgaggacaagattgcgcggcgcgcgatacgtctgcaggatctgttttacccagaacgatttgccagcaaattgaaagaagtactcgactaccataatttcttgctggagaactattaccatacagcaacggtagactacgaccagatactagatgaatgtctgaaaaaagctgaaagaattcagccaatgatcgcagatgttcctaaactgctgtttgaagccaacaaggctggaaacaatctgttgtttgagggtgcacagggagctttgttggatattgaccatggcacctatccttttgttacttccagtaattgtattgctggtgcagcttcagtaggcagcggtgtcgggccacagttgctgggttacgtactgggtattaccaaagcctacaccactcgcgtaggttcggggccttttcctaccgagttggcagatacgactggtgaatacttggcacagcgaggcaatgaatttggctccactaccgggcgcccgcgccgttgtggctggtttgatgcagtggctaccagacgttcaattcagatcaacggtgtttcaggattatgtattaccaaacttgatgtgctcgatggcttggagaaattaaagatttgtacgggttataagtcaaaacagtcaggcagattgtatgatgctttgccatttggtgcggatgatctggctgatattgaaccagtttatgaggaattgccaggatggcaggcatgtacggcgggaatcaaggattttgatcaactccccaagaccgcacaaaattacctcaaacgtatggaagaagtctgccagacacccatatcgatgatttcaaccggtcctgatcgaatagaaacaatcgtttttcatcatcctttcggataaatgcagcgtaatctgagctggcggggcactgcctgacaatctccccgcatggcctaattccctaattcctattgatgccatttctggtaaagctcttcggaatagtcactccatctttttttggctgctgtcagattttcttcagctttttgtgaagcctgttgtgcagcctggaattctttctcggtttcagttactttttcctggtagtaacgcaaattgtcctgcttgatctgcatctccttttttgccttactggctttgctttcagcctgtttcatctgttcataagctgtattggtttgtcgctgcaaattggatagatcgctggctgcaaatgaaacaggagcagccagcaataataaaatcaggataggaaatttcattttttattccattttcttgtaaaactgaaggattataagtcgtgataatgcgtcaatagaagaatgcgatggtacatgggttctatcaggctgagaacaatgctccatccaatagtcgatcattgcagatctgaatcatgatctttcagatacgggtgctgataactgattgggaatgtcatcatcccggttcttccgtgaggaaatggcgtattttttgtaaatcggcatgaatggtagcctgttttcgttttaactggtgagcgagcacttttgaatcagttgtcttcaagatgatgctggtttcgagtaactgaagtaacgctggcgggagattttccttgctaccaaagtgactgatcaaatgggcaacgtgcatttttgcgcgccgcagctgacctgtttcgtacacggatgagtaattgttttggcagtggaaagagggagtgcttgtcgtgttctgtgtttcgtttcccataaggttttctccttgtatgagttgaacgtgtcaggattgcgactgcgatcggacagcaatatgacagatgaaaaaagctgcctgataatttaactataactcggatgacatttaatggctatgcgacaaattgccgctgctgtaagaaaagtgggtagcagcggcttcttgtcttcaggatgattcctgatcgctgttgtcagatgcgttaatagaaacatccaaggccgcccgaatagcatcatcagcagtttccagaaaaacaaactgcatggttgcgcgtattgcttcgggaacatcatgcagatccttccggttccgggcaggcagcagcacggtttgaataccggcgcgttgtgccgccagtattttttccttgataccgccaaccggcaagaccaggcctcgcaggctgatttcacccgtcattgcaacatcgtgccgtaccagttgattggtgaataacgaagctagtgcggtaaacattgctaccccggcacttggtccatctttaggaatggcaccggcaggcacatgcaaatgcacatcgattccgtcaaacattgaagccgcaatattcaaatcactcgcacgtgccttaaccagcgtgagtgcggcctgtgcactttctttcatcacgtcgccaagctgcccggttaggatcaggcggccactgccactaacgcgcgtagcctctataaacaggatatctccaccgaccggtgtccaggctaagccggttgccacccccgacaaactggtgcgaagtgccagttcatgttcatatttttcagggcccaggatgtccatcagattgttcgcgtcgattcgcacctgttgctgctcaccttgcgcgattttcagggcagcgtggcgcatgatacggccgatttcacgttcaaactggcgtacgcccgcttcacgggtgtaattggcaataatgctttgcaaggcttcaggtaacaatatgcattgatccgattgcaagccgttggcttcgctttgtcgttgcaccagataacgttgtgcgatttgcagtttttcttccggtgtataacccggtagatcaatgatttccatacgatcgcggaccggcggtgagacttggtcaataacattggcagtggcgatgaaaaccactcggcttaaatcgaacgggacacccagatagttatcacggaatgttgcattttgttccggatcaaggatttccagtaatgctgctgagggatctccatgtgcgctggcggtcattttgtcaatttcatccagcatcatcacgcagttgcgtgcaccagccttgcgtagattctgcacaatattgcccggcatggcaccaacgtaggtgcggcggtgaccacgcatttccgcttcatcatgtataccacccagcgatacccggacaaatggacgttgtaacgcgcgggcaatgctttgtccgagcgaagtttttccgacaccaggcggaccgacaaaacagagaatcggtgcgcggccttgtggtttcaatttttgcacagcgagaaattcgatgatgcgctgtttgattcgttccaatccaaaatggtcagcttcaagaattgagcgcgcagcatcaaggtttatcggtgtttcctccggcaacttccagggcaattctgtcatccattcaaggtaggtatgcagcatggaaaattcgctggaagcagcaggcatccgctgtaatcgctgcaattctttgcgggtttgctgttcgatatcttccggcatgccggcagcagtaatggcttcatccagtttggcgacttcctgttcattttcaccctcttcgccgagttctttctggattgctttcagttgctcgcgcaacaaaaacttgcgttcgcgatcttccatttgctccttggtacgctcgcctatttcttgtgagagccgcagcacctcaatacgccgcgccagaatttgcagcactttatgcaaacgttcttcaatatcaattgtttccagcagcgcctgcttttcagctacttcagtatcgagcagactggcagtaatatctgccagatcagacggtgagcgggttgcctgcagtgcatgcgccagttcagccggtacaccaggtaacagtgacaaaatttccatggcacgctcacgcaattgcaacgtgagtgcttctacttgcgtggtatctggtatggtttccgggatgcgttgtatccgtgcggcaatgaaggggtaaccttcaaccagttctttgatccggaagcgctcaatgcccagacaaattgcatgatgcgtgccatcttcggatgtgatgtggcgcacgacattagcgagggtgcctaccgggtaaagtacatccagtccaggttcttcaattgcaggatctttctgtagcacaatgccgatcggtgtttttgattgcaggacatactgaatggatgcaatcgatcgcgcccgaccaaccgtgacaggcataacgacatgcggaaacagtacgacgttccgcatcggtatcagggcgatgatatcggcgggcagctcaaacggggttacagcggattgttccatgtggtgtttcctctcaggaattgttaactggtctcaatattgagcgattcagtggaatttcaagagagcgtgcgagaagtaagtagtaagcttgccctgtagctgccatgtttatgacggttccattgacaagcttctggtaaaactagtcaggggcgatgacgtatttcttttttatgttcgtaccggatcaatttagcaagatcaagcatttcttccgatagtatttccataatatcgtctgttgtgaggattccgaccagctcaccgttatcgttaataatcggcaaacggcggatagttttccggcgcataaaattaatggcatcgtgtatggcagtattttcttttacggcgaacagttcctgtgtcatgacatcgtcgacagtaattgcttctttatctagcccggtggcgagaacttccactacaaggtcgcgatcagtgatgactccgaccggtattacacgatcgttcactttatcgatcacaataagcgcgccaacatgatattggcgcatcatcctggccgcttctagtacagatccgtcgcgttgaatggttctgacttcccggttgcaaatttcactgacagtcatggcagtctcctgtatgtgttttgagaacagattgattggttaacggtttaacgggaccagtacacacgcaacaagttttcatcctggttatattgaagttccaggccgccttgataggcatcatgaatcgcctcaccaatgccacgtgccagatggatgtctgtggtcgtaatcagcaggctgttattttgttcttctgttgcgataatacgttgtagtggatgctgagattttttcattttctcgaaattctgcacaagacgtaaaatttcatcatgatgagactggagaaattctccttctagtgttaaatagccagccgggtaatgatcaagtatgcgctggcaagctggacagagatgttgctgtgcctttacgggcatctcaagccattgccagcgacctttctggaatactgcgctgcattgtggacacactgttggttctggcagttttcctctgattttgtaggcatcatcaacgcgttcctgaaagatagtgtagtgtgacgagacttgacggaaaccaggctgaatattacgaatactcatgatggcattctcctttcatacggcagacttgtttgacagcggacagtttcaacccgttactagaactgacaacttcacttctctcttgtgtactgtgtttttatcttgcgccgtttgatgattttgtcaagaattttcagagtgtttatccgggattgcagtaccgtgaaaagtcagttgtgtaaactgatcacaatggttttcggggctgaaaaactatgtgtcccgggtatttttgtggtcagcttgacaatcaccggctcaggtgatgtcatcgggtgatctcttcgaaaggtttgaagttaactatttttatagggccgtgccgggcactggcaatccatgtatcacatcgcgttgaaaatgctgacgggggacaggggaaagtatctgggtatcattatggggctgactttcgcttccctgatcatgacccagcaacctgctatttttctcggactgatgacccgaacctacagtttcataacggatgtgagcttgcccgatatctgggtaatggactctaaagtacaatttgttgatgacatcaaacctttgcaggataccgagctctaccgggtacggggagtttccggggtggaatgggcgacgccaatgtacaaggggctattgagagctcgtctggctaatggcacatttcagagctgtttcgtcgtcgggttggatgatgctacgctcatcggtggtccacccatcatgctggaaggcaacatcgaggacttgcgccgcagtgacggcatcatcgttgatattgatggggtgcgggataaacttacaaagccgtcacgtgaacctggcggaaaatcagtacccatcaaagtcggtgacagtttggaggtgaatgatcaccgggcggtcgtcgtcggtattgcaaaaatctcgcgcactttccaggcgcagcctattatttatacgacatattcgcgggcaaaaagttatgcgccacgagagcggaaactgctttccttcattctggtcaaggcaaaatccggacaggatctttccgtactgacccgtcgcatacgcgaatccaccggtttggctgcctacactcgtcaggaatttatggatctgacctacgactatttcatgaagaatacaggcattccgattaatttcgggatttcggtgctgttgggatttatggtaggcgcagccattgccgggcaaactttttataatttcacgttggataacttgcgccagtttggtgtgctgaaagccatggggaccagtaacagaactttgctaaaaatgattttgctccaggccattctggtgggaagcatcggttatgggctcggtgtaggttcaaccgcgttgtttggctatttcatgcacgataccatacttgcattcaaatttacttggcaactgctgatttttagtggtgtggggattggccttatctgtatatttgctgcggtcatcagcatactcaaggtgatccgtctggaacctgctattgtcttcaaaagttgatgagcgtacatacgctggcagtgcgttgccggaatatcgttaaagtctatgagactggtggccaaaaagtgaccgctctcgatggtattgatcttgatattgcaacaggtgagttgatgatgctggttggcccatctgggtgtggaaagaccaccttgatttcggtcattgccggtattcttgatcaggatgaggggagctgcgaagtattcggtaaagatttggctgcgatgtcggatcggaaaaaattagcattccgagcgaatcatatcggttttgtttttcaggctttcaatctgctaccgtcgctcacggcgactgaaaacgtgtccgtaccgttactcatcaatggtgtcaagcgtgtcgaggctgaacgcagagcaaatagcattctcgaagaggtcggcctcggtgatcgtaccacttccctacctgcacagctttccggtggacagcagcagcgcgtggcaatcgcccgagcgctgattcacgatcctgggctgattgtctgtgatgagccgaccagtgcgctggatcatgaaacggggcacacgatcatgcaattgctcaaaagtaccgttctgcaagcaaaccgggcattggttattgttacacacgattcccggatttttgattttgccgatcgtactgccaagatggatgacggtcgtatcctgaaaataacgtaaagctatgcaacttattgaatatatgttggtttgtcataagtattgtacctctgaaaatccggttgtgcgggatgaagcgcaacaacgagacatatcaaatggataggcgaggtagtgagtatcgcgtaatgccgcggttcacctggaaaataatttttagaggtaccctaaaaaatcatcatgaaaattggacataccttgcctatactggcaattggtggatttctgttcgcgtcctatacgatcgtcagcagtaaccagccgttcccagtggcccttgctgcagcagagccagctgtctcgccttacgaatcatttattgcaggagcgggtatcatcgaggcgaaaagtcggaatatttctgttggtaccgctttgtctgggctggttactcgagttgctgtcgaagtgggagataaagttgaagtaggcactccgctcttttacctggatgatcgcgaagcgcgtgcggaactcgccgtcagaaattctgatcttgccagggccagagctggtcttatggaagccagagccatgctcgaggacagcaaatcgttaagtgatctgattgaatctcttgccgatcagcgcgccgtcagcagtgaagaaatgctcaggcggcacaacaccttgcgtattagcaaagctcggctgagcagtgcggaaaccgctgtacggcaggcggaggccttgctggccagcacacggactacgcttgatctgctgattgtccgggcaccagtgagcggcgaaatcttgcaagtcaatattcgtccgggtgaatttgcacaggtgggtttcctgaccacgccgttgatgctgttgggcaatcttgatcagttgcatgtgcgggtggatattgacgaaaatgatgcctggcgattcgaccgacatagcaaggccatggcttatctgcggggaaaccggaactttagcgttgaactaacgccagcttatgtggagccctacgttatccccaaacagtcccttaccggcgacagtaccgaacaggtcgatacacgggtattacaggcgctttatagcttcgatcgagaacaattgcctgtttatgtagggcagcagatggatgtatttattgaagtgcgggaccatgcagacaatggtagtcccgctatctgattttcagcattatcctttatacatatttccgataactccaatatttgcatcatgctcaaaatatgaagaccccatttcttcttgcgatgagtgtaaatcattcattgtaatgatttttatgaataagtagtaaagggaaagcagttaacgaaaactgtaataatctctgaatccctacctggtttattagctgggcagcgtagataaattgcgtcactgtgcatcagagttatctgccttgttgtgtgaaggtggtaccagcgcaatgacggtccagccatttcgtggttccgttttatatttgtcattggcaatttttaattgtccggtgggatcaatgccgaagagtaaaatagcatcttgaccgtgttgtgctagaaattcaggccagccaaatacgttggtcagctcattggatttgatcgtccatccttgcgagagtaattcgttgaacttgagttgcgtcatgtcgggatcaaataacaccttgctgcgcagtctgccagcaaatgtttgacgatccgtagtatcgcccggcttcagaacacgcatgcgataaaccgcttcgcgtcccagctcctcgcggtagtgcagacatgccaaataattgagttctcgccggccggaaattgccaaaaaatggccaatgggagtcagatccagatgtaattcggcgtttcttgaggtcggattgccaaaaaatgtttttaatccctccatgcgtgcctggctgatcatattccagttgtcatccgcaagaataacgtcaattttttgttgattgagtgccgtagcaatcgttcgggcagctgtgtctgagccgaaaatcaacactcctttgggttctggtgcgagtaccccaagccagcgtgccaagtggtgtgctgtggcactttgtaataccacggtggcaataattaaaataaataccagcggcaccaaggcgtcagcaccctctatgcccaaatcatccaggtgtagtgcaaaaagtgaggaaatagcagcggcaaccactccacgcggcgaaacaaaactcagcaaggctcgttcacgccaactgagttgactgcccagggtggcaacgaatatcgatatcgggcggatgattacttgtgctgccagaaatatcagaatgccggcccacagcacaccatcgggcagtggccattggaggcgtgcagacaatatcacgaacagtacggaaaccagcaaggtagacaaatcttccttgaaagtcatgatatggtcgatgtgaatgattcttaagttgcccagtacaatgcccatgacggtaactgcgagcaagccggattcgtgtatcagtgtgtttgacagcgtgaatatacccagcacggtagccagtgtggcatagttctgcagatattctggaatccactgctgatagatcagagtagccaaaattgcggcagcaccgagtccggccactacaccgaccgctaccattactagaaacgtgcccggtgaatggtcttgtagctgcgtcagaacggcctggaacaccagtacggcgagcagtgcccccagtggatccagaacaatcccttcccagcgcaaggcattagcaacgtgtgctgtgggccgtaaggtgcgcagcatcggttggattactgttggcccggttacgcacgttagagcaccaaatagaaacgcgatcccccaggtaagatctgcaatccagtgtgccgctactgctagcattattacagccagtgctgcgccgtaagtgatcatgccgtgaacagcgcgacctattccatgcaattctgaaaaacgtaacgtcagactaccttcaaacaagataatagcgacggcaagtgataccccagggaataaaagaggaccaagtgttgcatccggatcaaaccagccggttaccggacccagcagaatgccgatcagcaaaagtggcaatattgccggcaggtgagtgcgccagcccagccattgggccagaaagccgataactagcagtaacgttaaagtggtgcccaagtccagtgtcataaggatcctgtttttgataaattgggatagattaaattcatcttacgaagatccgcaatcgaatctggtaatttgaactggtgatttttatttactacataaccgtatcagataaattttagtgctcaatatttgaatggtgtcgattggtggtagcttataggtagttgttgtctcgatcgtgtgcgtcacgaccgatagctccgatatccgtaccatattcaaagtatggcaaacccatttttttgcgattaacgcaaatggttcattgtagtgattttgctggctggattatctgttttccatagtggttacaggtttataaagcagcaggctataattcccggctggataacttgtgcggatagaaatgaatttaactgaggaggttggcaaaaaagctgctatacattggtctcatgtattgctgattgttttagctacgatcgttctgaccgtggctggtacttactgggtgctcagaacgtatattttcgtttcgtcctttgagccagttgaattgagtcaaagagaagaaaagacattacagcaaaagcttcgatcaatcggttatgacttttcattttcatcaccgaaagcaagccaaaatagtaaatacaaggatggcctcctgaaaccggaggcatattctgaacagggcgcaaagcgtgaaattagctttaccgagcgagaaataaatgcgttgctagccaaaaataccgatctggcgcagaagctagcaattgattttgcggatgatcttgtcagtgccaagctgctgttaccgctggaggaggattttccggtgctgggcgggaaaacgctgcgtctgaatgccggtcttggtatggcttaccgggataacaagccagtcatcatcctcaagggtgttagtatcatgggggtccccattcctaatgcttggctgggtggattgaagaatattgatctggttagcgaattcggggttgatcctggtttctggcaatctttcgccgaaggcgtggaacacattcaggttacagacggcaaaattgatatccggttgaaagaataatttctggttgtgttgacctgctatttgctaccacctatttatataaaatccggaagtatagtggccccaattttcggacagcaaattaagatggtaacctgctgtaaaaggagcaggagatgagtgttaaacttgagcacttatattagtcaattcaaggagtaaaaaccatgcgaattatatctactacactttcaacaggaatattagcagtttttataagtgctcagaacctgttcaaagtttttctcggcgcttctgaataaaactaaaacggaatactctttaccgttatttttaagctcaattttcgtcaatacaaggattccttggattttttacttatcctgttgtcattgcatgtatccgtttgaggttctaagccatagtaacccaaccagtttccattcgccagctgttacttgaatcccccgcatcaggaactggcggaagcctaattgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacacctaatatctgtttgataatgccaaacacgggctcggccagcgcatcacttggtagcaggatcgttaaccgttgtccacgcgcattacctgcagcgtatcagccgcgtcctgcgctgccccggaggcggacaacatgacgacgggatcgcctggctgagcaagcccttgcgcgcacagccagtggctggccaagtacaggtacgattgcggttcaaactccgccacggctaacaacggtgatacgccccagaccaccgccagacggcggcacaagtcttcagagtcagccataaccactagcggcgccgcgggccggaagcgggcaatccccagcgcggtcgctatatccctgacgggggcaatgatggctttagcgttgagacgggccgcaagctggcaggcaaccaggctgatggggtttgtcgctggggtcgactcacttgcccgtagccggtcacgtgcaacgcgtactgcatactcggtttcagtggccgtcagtacccgctgcagaatttcggcagcagccactggaaagcgtccgatggcggtctcggcggacagcatcacgccgtccgtcccatcaagcatagcattggcgacatccgtcacctcggcacgtgtcggctgttcctgagtgaccatggattcgagcatctgggtggcggtgatcaccgggcgtgcctgggcattggccaaggcgatgatccgtttctggaccaggggtatctcagccaaatcggtctccactcccaaatccccgcgagccaccatcacaccatcggacgtcgccatgatcgcatcgaggtcgaccagagcttggcgtttttcgatcttggccatcagcaaaggctgttggccgggcggaagcagtgtccggacgcggatcaggtcatcagcggactggacaaacgacacgccgatccactccgcctgttgctccagcgcaaagcccaagtgccggcggtcatcgtctgtcggtatgagcaccgagcgtttggattctggcacgttgatgcccgaacccgatgtgaccgtcccgctgacgagcacctggcagacaacccgctccgcgccagcgattttaacctcaagcctgatcgcgccgtccgcgagatatactgactcacccacgcgcagcgcctgcagtaacgccgggtgcttcaccggtagcccatctggaggatcggcctcgagcgccaggatcacatccgcgcccagatgcagttcgcgcgcaccgttggacaactcccccaaccggaacttcggtcctggcaggtccatcaggacggcgatgaaccgtcccgtttgttgcgccaattgacgcacctgctgaatccggcgggcatggctggcgtggtcgccgtgcgacagattgaagcgggcgacatccatcatccccgcgccgatcagtcgcgccagcacgcccggttgatcggtcgccggacccagggtgcagatgatctttgtccgatgccaagggagttggggcatctctgcctgtgcggggtcgtccatcagcttggattcgggaatgcggaccatctcatgagccactgtacgcttagtgtgttgaggcgccaaggacgccaagaattatcacgcgccgccccgtcataaaacagaaccgcgctgccttccctgatgggcagcaggccgaaaccgatcacaatcacagcaatcacccagatccggatagcgcgttgcctgtgtgctgtcatgtgcatcacagcgctgttgtagcagtcgattgcttcaagctctttcatcaacgagacaatggtgcgatgcatatcgcacgtttcaatcgaaagaggttttcaaactgctcgtgaaaatcggtgctgagcatggtttgtctcctcgctaggggttcgggaacataagaatttcgagagctggagtttcatcaggttttctcaatattgccgcgtcggtaaatcgcaaaaacaccaagtggaatacagaaaaaataaaccactttttccatggttgctaaatgtattgaaagttggcccagctgccaatcattgtgttaactgattaaatgtgagtatattccggttcagttaatatgaaaagccaaagattctgcagcattttggcgcttcaggtgtaagacgtccaagggtaaaaatctatccagtgataaaaaggattgaaagagtgagtacaagatcaggatgacttgaaaagatcgtggatttgtgcaggcgttctagacggcgcccaggcaggccgagctgatcaagaatttggtgatcgcgctggattcaaagatggcggtaatgattttcatatcctctccacaacgcggacagtattcgatatcgctatcaaacacccgctttaacaggcacgcccaaccgatacgcgcagaaaccggtggatattgtgcatcgttatattcgtatcggatgggctacttttgcctgtcttttcgcctggaataatctttgggcgcgagcactaaagtggagaattcacttgatatttagtcccacgatgtgctggttttaactaaatctgtcgtgttggtaagtgctttcgatggtgctttcaaaaatttctgcgtctggatcagcagacacgagacggatattgttcagaaaaaacttttaaatgcgcgctagaacagaatcaggagcttgtaaacacattttgaaaaaaggctgaaatacgattatcttttttcttaccggctagctttaaaatttcatgtgctgatacttgttcggcctgcacgagagaaaggtctgccttgatactgcttacttctccattatgaatggcgtaaaattccccagttgattgatgggctagtttactggaaacatccgttttcgcttcacttaacatgggtttcaatttatctaatgcagttttttctttgatgcacccgataaaccatgtagagatctgatcacgtgatcgataatccagatcgcccgggctttgggttgcaagcatcaatccaattccagccgagcgggcgcgtctgagcagattttccaatggctctttggtagctggcttggattgggcgggcaaataaagatctgcttcgtcgagcaaaatgacgccttgcagtttatcactcggcgattttgctgcgaaacggccaatatccagtaatagctgcgatacccagaacaatacgttgtcattgttgcctagattgctggtgttgatgatacttagctgggttttcccgttcgaatggccgaataagttttcggtattcagtaattctcctgatcgggaaaacaggcttccatgtcccaatgccagagtttgtaaatcctgcactagttttttagacaacttggagtcgagtcttccaattgcattgagtaatagcggatcatctttgtcaataaaatccagcagatgatcaattgtcaatacacggcccttgttcaattggcccaggatggaaattgccttcccgagaatgatgattcgagctttatcctggccgtgatctttatagcccataattcttcctagagagaaggctgcatggttggccagctgatcacattccccagatgataaattctccaatcctttaggtacgataggtatgcttaaaggacggccttgcccttcaataacgccaggtgtgtaaacgaccacttcaattttatttcgtaaatccttgcgcatttgagcgcgcattggatctgcgacagggctacgccatgcttcgtcttttgcatagctgcaaagatcaccctttctatccagaagaattgccggaatgccttgcagcagtaattgttcgatgatattcaaggccagagttgttttgccgctcccggaactgcccaaaaaagcagcgtgacgcacgaattgagaaatatcgactttgtaaaaggagggttgatagccttgagtcatacctattttcagctgtgaggtatctggggccaatagttgcacgttcacaagagcaggaggaactggtggctgtgcattttctggaacggaggaggtttcggatcttttcagagtcatttcaagatccagaatttgctgaattgaaggcaagctgagcaatggctgtgccttttgcagccaactcttgaagtcagatcgttctgcgtattgtttacggaatgattccatggctaccatcgtgcgccagtcagcatccgggatcagcacttttttaccaccatctgctacgaatttacccagttggatggcaatctgggtttttggattagcgggaaactcgatagagcggatagcgatcgccgtgcgtccgcttgccgctgtttgtagtttattgatttgtcttgccagtgcgcctccttgtgaaggtttttggcataaacctatggttgaccaataggcaatattctccgcagaattttgaatgtctatatccagaaaatcatctcgttgcacaatactacatttgagcgaatgattgaattcaacggcgcaatgctcaatcccgcgtccgagtaactgcaacatttcatcctcattttcgggtacagcatgcggataagctaaatgatcattccatagctgttctaatggctggatgatttttttatcactctcttctgtttgtggtggtgtgtctctgtttttgtcgggtaatcgcggaagattacccgtgcggattgaatattcacgttcctggcggcaccagtcaatgatttggcgtgttttcatcccggccaacagcgtaggtgtctcatcctggaaaggaaaaatagattcccctgaactggagtagattccctggctatcgtagagagcttctaaccttatgctaattatttcgcgtatttctgctttgctgcgctccccgcagagtgtaatcgtatcgggatcacgttctattcgatcaatttgggattgaggtaaactatttcttagcaaaatgtatacgtcgtccaggcaagctatcacaacgaacacattcggtatttcagccagcctggtcattgtttccatggcacgccggaattttatttcgacatcttttgcaggatgaatatcttccaattgatcaagacaaatgacaaaagctcctttattgattgccatcatcaaatgtgctaaagcttgtaacagacgatccggagcatcttcctgaacacgcggtgtgagattgccaagtattttgcaatcgtattccgacatattttcgcagcgaagatacttacgaactctggcatgaatagcgggttcgtcgtgctgtagatagaggagtacgcgaattaaatcaagatcaacgtgccggaattgctccccttctttattcagaatggcatcggtgattttggaaatcagctcactcaactcgtcatggttcaattcaccattgcgcagttgctcaatggcatgttgtgaaacaatctgtcgtctttcaattaatgcattggataagtgcatcaatcccgtcgtgctgccattaattgcacaatacggtttgtcgagagaatctatcgtgtaatgaagcgcatagctcgcataatttgaaatagaagaagtcatttgcatgtaggcaaaataccccagtgacttttcatgcgtgtaattacggaaagctcgcatgagatgggtttttccagctccagactctcccagcaacagtatgatgcgccccgagtctgtttgctcacagttacttacacgattcaataaccgttcaaagcactcacggctttcctggtggatgctttcaatatcataaggatcaggttgccaaatctgattgtgatgcgtaatggaatggaaaatatcttcctttacgcgggaacgaaaaatctgtagatattctttttgtggggttccagacatcttatggtttcaaacgtataaaatggaaagtcgagtttagataaagagtttctgacaacgagacggcatcttgatccatagcataaggaagatctgcacggcttaggttgactaaccccttgttattggccagtatcaggtagtatttgaactcattcagatccagcccaaatgtattaccctcacgctctatttggtgccaaacgtgcgagataaatagtttgttatcaccaaatttacccgtttggcagcgtctggcagattgatttacctggttagcgaagtgttccagattcaatggttcaggctgctgtggaggttgtttttctaatatctcaggttgctgtaaaggttgtgtagccgttctgagaattgctagtcgcagttcttctggactgatacgtcgtgcacctgcagcttttgcagccagttgttttaatgcactatcccaggataattcacgctcggttcctaatatgccacttagaagcagggccgcaaccgagcctgccgtaaaaggcttcgcatgtgtgatattggatgccgctaatttacattgtagatttgcactgtcagcaggttgggctaattgttgccagagcaggttatctctaactttgatcagagaagagtaggcgctggtagtaagtttaaaggcattggccaaaatagctgcccgaaggccatcagcacttgtaatagctaggcgatcacgttcattgatcggagcaggtaatcccaacagagcagcaatgagatagcagtttctcaatgtcagccaacgtaatgtcgggggtaaggatggtaggtccaatttttgcagtgcttgttcccgccctgcaaccgtgatttgaaatcgtgacttacctgttttttttaatagcccatgttcggttagttgctgcaatgtttgtagccattcattacttgagggcgcttgatggaaaacaggggttaatgatttttttacctcactgattgtcaatccgttagctgaacaagccaggaatcgaattggaatcagctcttgaagtgtcagatatccagttgcactcatcattgattttctggtttaattttttatttcgtcggtgctgtaatgcttggtaaacgttatcaagaatttcatccagttgggaaacgatatcttctgccaggaagcgtaaaacaagtatgtcatgcatttgtaatataagatccttgcgccgatcccggcgccaggattccggatcctgaaaatgataatagccatctatttccaaggctatttggtcagaaatggaaaacagatcaatctccattagtcgcttcccaaatttaaacggcattttgacatttaacttgaatacgccacgtgtttccggtacccattctagtatgtgaaataaaaattgctcggcctgactgcgagcaacagaagaatcatctttcttctcaacgatcaagcggagcaatgattgcgcttcctcatacaattgcgtcggtgcattacattgccgaagaatctggtctgtcttgtcgggtaaggtgtagtgagaatctgaataggactgtgctttgataatacctagccgtaacatagcctttattcttgattcaggtgcttttgtacagtagttttcgaagtgtgcaggtatggctgctaatgcaattggcatttccggtaggcgctctgcaatctgcgccagcatgcgaatgaatggagatcgtaataattcatcatcagtcacttccatcagtaagccgggtaaaatttccactggcaataatttggtaaaagccatgataccttgcgctagattttcgccatcttccaatttcatggcctgtgccagatttgacgctaaatcaggtgtcaattcacaggacaaggcgatttgtgtcaaaaaccagcttaggagtaacgattcttgtgtagagagctgaatgggtaactgctgttggaaaatctccaattcatcactcgatttatttttcagcgcaaggaagatttcttccgtggtacaccgattaacctgcgctagatacagtagcaattggtgctgcaggtcggcgcttgcaagtagcgtctctatccagctgatcgaaagtgatttagccattccgggcgaccagatgactgtatttctactttcttgttgtatccaacggcaccatattccccgggtgtcattcaaagtgcctgtcaggaccgttaagaccggagtgccttggctacgtcttagcgaatgtatggtgagataagtttgtggagaaacttgagaatcagtctgcgtggattgaaatgtgcgtttcatcattttctcttgttcttgataaacagatgattgagaaacggcaactaaatgagtatttttgaggatgtcttgaggaacccctgcaaaatctcgttatcgtaaggaacgtagcaacgtgcgatccatataagtatttgataaaatagactttatagggtgtttcctacttcattacattcgtagtcacaatgatggtgcggaagttgtacagactgatccttaatcaagcatcaccggccagcctattcgccaatggccggaattgcaggtggtagaacatattgaggtagagatcggtttcttctcgctcaagcccactgacgaatttccagaagctgtatatacgcgatagcgtcatcatgcgctctgcatatagtttccaggtgtagcggctagcaacgcgtgcaagtgcgccttgcgagagacgttcccattccagcggtttttcatggctcttttcgagaaaatctgcgatcagatcagcagtagctgtaccttgattgggatcgatatgaaaaccagaacgattgtgctggatgatttccagcggcccgccatagcgggtggcgaaagtcggcagaccggatgccatggcttcaatgatagtcaggccgaaggcctcgaacaaggcgggttgtacgaatatgccgcgcttgtcggcaatatagcgataaagctcacctgccagatttttgtcaaggcgcatacctagccaacgaacctgcggatcgagcttgtattcgtccatcaaatgatgcatctggtgtatttgctcttgttcttcatggtcagatgagtgctgcggatctatttttcctcccactatgacaagattggcaagtgagcgtaagcgctgtgaggcgccgtatgattcaaccaggccggtgatgtttttgatacgatccaggcgcgccatggtgaagatcaaaggtttatccgagtcttgtaaaatacctcgggctggaaagttcgcagtattgtcaaagagcatggattcaatttcggggatcaggctgtgcagacgcctggactgatcggtataggggaaataaacttctgcatcggcgcctggggaaacgatattaaattttgggtcgaatagatcaattccgttaatgacccgataaagtccaggcatggagaaagcccggtaactttcgtactggccttctgcttcccgtgtcccggcgatttcctgataggtgcttgttacgatgaagtcagcggcgttcatggccagaagatctgccgtgtattggcaggaaaaatggtatttgtcctcgttttcctgccagtaaatatccgaatgcagatatttggttttttccagagcgtgtgcgatgttgcactgtgtgacgcccagtcttctgctgagcagggtggcgaccagattgccgtccgagtaatttccaatgatgagatcgggacgtctacccagttccgctagcgcctctcgttcaacatcgagggcaaatgtctcgagatgaggccatatctcaaagcgtgagatccattgaggaataatttccccattttttttacgaaatggaacgcgcaaaatccaggtattagtacagccactgaccttttccaacctttgattgcaagtggtgtcgcccgcatcaggaatcagacgggtgacaatcagtattttgggttcgacctgcacgccttgtagttgcagtcggtcgcgcatttcctgttcgagtgcgcgtacctgatcaagaatatagacaacctgaccaccggtatcaggcagtccgagcacattatcctggccgaaataaccatgaggggaaagaatcaatagacgagagatcatgggaatacgtgccagaaatgcttcgagtgcagaaggggagggtgcttccaaaatatccatcagcatattcatggtttcagccacccgggcggcgttatgtccccagcctggcgcgaatccgattttgctcatgtctgaggatagttcggcccagggcgtcgtaccatccactgcttccagtatttccagcgcctgccgcaactggctgcgcaccatattgatattgtgtgaattgctggtgaacatcagttgttgtccgtcgatagtatggacgcctagaaagtgcagcaatcgggtactgcctgcttcgatacgggtgaacatttcactggataactggcggttgaggaagataactccttgcccaattgagcgagattccctcaatttgggaaatgtccggttgaatggcccgaaatcgacctctagaatagattcgatcgcttcacctttggtgactgtttccttgaacccgagaaattcattgatggttatcttttccggcatcaggtgttcctgatgcatacgtacgaattccaattcggcaattccgggtcgaagtacaaaatatgcccaaggtgaagagaagacgccttcctgtagatggaatacaaattcgtgaagcatatcggaccgctcgcaatctttttccagctgtagcaattcatctcgcagatcggattgcaggagcaaggggcgattcgttgagaaatagcgccgtaataatgtataaacagcatccctattctgtagggtgcaagtggtaaatgtgtcgatcgtggtcatggtgaaatccttattgtgcaaaattgtaatgctccagcccttccaagattccacgggcataggtattgctcgcaaagtacatctgttctagtccgcgtaatggctccaactccgggctgtggttccccaccactacacccagtgtatcgcctaccagcatttcttcatcgttgccggagtccccggctatcagaaaattttgcaatgataatccccatttataggctagataacgcacagccagacctttagaagcccgcgtcggtagcacatccagaaatgtttcgtgtgaatagatcagtttggcatgtagattttgctgatggagatattggtatagctgttcgagtgggggcatttgttcgggagcaaccaaataactcagtttgaattcacgctgattttccgggggttgaagcgttaatcccgggatggcctgcagtgcttcagccagcgcttctcgtcgccattggtggcggatgtgattactccagccctgatctggccgcaaggatggccagtaattgatttcgctgccgaccgaggtgatcaggacgtcgggcattggcacatgccattttttgagaatttttactgcgctttcgagcgatcttccggtagccaccccgaatgagacggtatcggcatgtgctcgtaaccattgcagcaattctgctagaccctgttcatcaccaagcagggtgttgtcgatatcgctgatgattatttttctcgccaatggaataggtgcccaatcaggatacagcgtagctgcggactggcggcgtagacgtttgcgcgccttacgcaataatttattgacttcccttacatattttgtgacatgagcatcccaggtgtagtggcgcctgacattggttatgccacttctggaccagtcgcgccagcgttttctgtcggataacgcttctttcaacgcgttagcaatttctgtatggttcagtgtgttgacgagtaatccattgcggcaattggcgatgatgtcacgcggaccaccatcttccggcgcaataatgggcaggccactggccgcagcttcaatcagggtaagcccgaagggttcagtgagggcggggttgataaagataccacgtctgcgaacagccaagcggtaaagttccggtatgtcttccgctgtgaagtgcttggggatcgcaaccttgccccacaaatcataacgatcaatatcaagcaataaatcattcatgacttcgcgctgcgatgtttccatcatacgaatatcttcacgggagccggcaacgattaccaggttggcgatatcctgcagggattgatctgagccgtatgcctctatcagtccatcgagattcttgcgtgtgtccggacgggaaatagccagaatcatcggtttcttggggttgcttagaaatcgatctacgcctgtttgtgtgttggggtcaataagcttgcgtccaggtggtgagaaacgcgaggtatcagttcctggcggaataactcggcagcggcgcggatcagtatttttatacataccgtattgatcttctatttcctgcgaggtgctggtgacgatcaatgaagcgtggatcagtgtttcttcttcagccgcgatgcgttgtgatagattgaattgtcgttcgattgcctgctctttacgtccggcggcaagcagacgttcccgtttggggcgaccaagcgaatggcctgtatgtatttgtgggatgcctagcagattggataaatgcaggccgatatagccggcatctgcataatgcgtatggattaaatcgggtaaacgtccttgttggcgcagatagtgcagacagcgatccaccatctggtccaggtgtggccacaacagctctttacgcagatatttacgggggccgcagggtaatcgaacgatctgcgtgtttggcccgagtttttcgatatgggttgcataatcaggggagacttttgaatcttcgatctggcgcgttagcagatcaacctgggcaatattactgttgcgtcccaatgcgcgcgccagttcgacaacataggtgatctgtccgccggtatccgcatcgtgccccagctccatatcatgaccgcgtatcaggccatgtacgctgatcatcagaatgtaaagtttttgatctaacatcgttttattatcatagcaggtcccaattcttgagaaaaacatcataaaatccggctgattccggtgtggcgccacgtatcccgcatagggcggcagcaaaccggtttgcacgttccagtgttaatacatttggccagtcaaacagcaatccaaggatgaagactgcgcaaaaaccatctcccgcgcccacggtatcaacgatcgacacattggcgattccgagtatttcagtgtaattgttagcctgatcaagcagccatgcgccattggctccgcgcgtcaccagcagggtttttagctggaaattttctatcaggcgtaatgcggtgttgcgagcatcactggtttggaaagctaataagccggataactcagctagttcgtcttcattgactttcacatgatccgcctgggtcagtgaatattgaatggtttccgggcgataccaaggttctcttaaattgatatcaagtagacgagaggcttgtggagtgcgtcgtaatacttcttccagcgctacgccggataccgggttgcgttgtgctaatgttccaaaatacaccagctcgggtttagcagtcgatgcggtatcaccggcaacatgtgggtcaatgaaatcgtaggcctgatctgcaaggatttcgaactcatgaccgttttcaccaggtttaacctgaacttgtccagtgggatagtgtgaatcacactggacgccgattgtaggcatcccggcattattcatcagcttgatcaatttctggcgaagaggatcgtttcctgtacgcgttatcaagaccgagtgcaaaccgaaagcttgtaggtgatatcccacattgaagggagctcctcccattaccgggccatcggggaagatatctgctaatacctcaccaaacaaaataatgtttcttgtgggtgtgctgtgctgatcagtggacataatctgtcaaactcctgtcagtgatggccggtcattcccggaaataaagcggacaaatttttttgtccgaagaagtgtgtgctggttgtaagcagggaagtgagaatgccggaaaaccctgtttccagccgagtgctctttttattttgacacggatgaacgatctatgcaaaacttgcaggagagggaatcaatcagatttggagacgcttcccggattttttaatcgctggctgcagtatgtctccaatttcagtgggatcaatcataccgataaacagcttgtttttaagattttttatttcatcacgatactgggctgcctgttcaaattccatgctttttgcggccgtcagcatggctttttccaaccgttgaatttcttttgcaagttgtgtttcatccatggcagcgtagtgcgcctggatttgtgcgactttctgatgttccgccgcatctttgctgtcgtaaacaccatcaatcaaatccttgatccgcttgctgacaccgcgtggcgtaatattgttctgctgattgaacagcttctgtttgttacgtcgccgttcagtttcatcaatggcgcgccgcatcgaattagtaatcctgtcagcataaagaatgacggttccattgatatgtcgggcggcgcgtcccatggtctggatcaatgagcgttctgaacgcaggaaaccttctttatcggcatccagtatgccaaccagtgaagcttctggaatatccagtccctcccgtaacagattgattccgaccaggacgtcaaatcttcccaggcgcagatcacgaataatttcaactcgctcaacggtatcaatatcggaatgtagataacgtacccggatgccgtgatcagaaaaataatcggtcagatcttccgccatgcgcttggtcagggtggtgatcaatgttcgctcgccttgtttggtacgcgttgagacttcagacatcaggtcgtccacctgggtggctaccggacggatgatgattaccggatccaccagcccggttggccgtacaacctgttcgacaatctggccgctgtgctgtatttcataatctgccggtgtggcggaaacgaaaatagtttgaggcatcagtttttcaaattcctcaaacctgagcggtcggttgtccagtgcggaaggcaggcggaatccgtaagccaccaggttttcctttcttgaacgatcacctttgtacattccgccaacttgaggaacggtaacatggctctcatcaataatcatcaatgcgttatccggcaggtaatcaatgagtgttggcggtggatccccgggtaagcgacctgacaaatggcgcgagtagttctcaattcctttgcagaaacccaattcatttaacatttccagatcgaaacgggtacgttgttccaggcgctgagcttccaccagcttatgattttcgtaaagatgagtgagtcgttcggcaagttcggttttgatggtttcgattgcgcgcagggtggtgctgcgcggagtgacgtaatgactggaagggtaaaccgtatagcgcgaaactttctgccgggtatgtccggtgagcggatcaaacagcgctatgccttccacctcatcatcaaacagggaaatgcgtagtgcggtttcagagttctctgccgggaagatatccagcacgtcgccacgtacacgaaaggtgccacgcgcaaactcgaattcgttacgctggtattgcatgtctgccaaccgctggatgatgtcgcgttgcgtgattttttcatgctcacgcacatgtagaatcataccgtgataatcaacgggatcaccaatgccgtaaatgcaggatacgcttgctacgatgatggtgtcttcccgttccagtagggattttgtagcagagaggcgcatctgttcgatatgttcgttaatactggaatccttttcgatgaacagatcgcgggagggaacataggcttcaggctggtaataatcatagtaggagacaaaatactcaactgcattttctggaaagaattcacgcatttcagcatagagctgcgcggccagcgtcttgttcggggccatgatgatggccgggcgcccgagttgcgcaatcatattggcgatggtgaacgtttttccggatccggttacgcctaacaacgtctggaatgacaagcctgattctattccatccaccaacttgcggatggcatccggttgatcacccgcaggctgaaatgcctgattgagcttgtaaggactgtccggaaaggtaataatcacaagtttgatcgctgtactcgaaatttaattattttttgattctaacatgcgcaaatcacatacatcaggagctgtctcgtgaaactctcgcaacgcgttcaggctatcaaaccttcgcccaccctggcagtgactgccaaagcagccaggctcaaggcggaaggaaaaaatattattggtctgggtgcgggcgaaccggattttgatacgccgttgcatatcaaggatgcagcgattacagcgatccggaatggttttacaaaatatacggctgtgggtggtaccgcatctttaaagcaggcaattatctcgaaattcaaacgggaaaattccctggactttactgctgaagagattttagtctccagcggaggaaaacaaagttttttcaacttgatactggctacaattgacccgggtgacgaggttatcatcccggcgccatactgggtttcctatccggatatggtcttgattgcacaaggaaaacctgtgtttattaataccgggatcgaagaaaaattcaaaatatcagccgatcagcttgagaaagcgataacacccagaactcgcatgtttattctcaacagcccaggcaacccttccggcagtgtatacggtcaggaagaattacaggcattaggggcagtattacgtaaacatccggaaattctgatcgctaccgatgatatgtatgaacatatcctcctgaccagtgataagttcgtcaatatcctgaacgcttgccctgatctgaaagcacgaaccgttgtcctcaatggcgtttccaaagcttatgccatgaccggctggcgaattggctattgcggcgggccggcagcaatcataaccgcaatggaaaatattcaatcacaaagtacatccaacccgaactctattgctcaaatggcagcagaggctgcattaaatggtgatcaatcctgcatgattccaatggtggaggcttttaaggaacgcaatcagtttctgacagatgcgctgaattccataacgggtattcactgtttattatccgaaggggcattttatgcttttgcggatgcaaggcaggcaattaagcagttgcaatcccaacaagtgttgcaggacagcagtgacgttgctttttgcagttatttgctggaacaggctgaagtggctgttgtgccagggtcagccttcggctgtgaaggctatatgcgattatcgtttgcaacttccatggaaaatctcagggaggctgtcaggcgtatcgccagtttgctgagctgacccccttcttaacccataattgagtgtacctatttttattaggccattgcaatattgcaagatgagcggagagtgatgcgtagtaaccagtgcggattgctgtaaaaaaattcgacactctctgctatttcttgccttacattttctgttttctgaatttcatactgccgttgcctgagcctgtcagggtgtgttggtactggtttttgccaatttctggagggcgtcaccaaccagattttggtgaaatattacgtgcttttttttaagatcataccagcaactggctgtcgataaattttacagtctccactaaaaaatcttatcttctttgggtcatctctggtaagcgtagcttactgtagttgatgagggcttttcagattcatctctaggcttgcggtgaattactttcttctttgcaagcaggagtaagaacctgtttacgatctttctgctatccttgataatgtgcagatgaagagaacaaaatatgccagtgatatcagcagagagaagtttgccgagatagagccgctattgcgcagcgtgcgacgcagcaccaagcccacgacagtggatctgtatgaggtattctgcgctgtgctgtacctgctgcgcaccggttgccaatggagattcctgcccggtgagtttcccaaatggcagagcgtgtatgctcattggcgcaaatggagtgagcccgatcagcacggcgtgagtgtgttggagcaggcattaaaaaaatcaggttggcgcggcccgcgagaaacgggggcgcaacgcttgcagcacgttcttgatcgtggatgcgcagagcgtgaaaaatacggacacggctggccagaagggttatgacgccggcaagaaggtatcgggtatcaagcgccatatcgccgtcgatacccagggcttgccgcatgccattgcggtgacgacggcggaagtgactgaccgcaaaggagcattgcaagctctaaaacgctgcaagcagagtctggggcaggttcaaagcctgctgtgcgatagcggctatactggagagccgtttgccgaaggcgcgcgagaaattctaggaaaacttgttacggtgcagattgccaagcgcagtgaactgcacacttttgcagtcatacccaaacgctggatcgtcgagcgcagctttgcctggctggagaagagccgaaggttatggaaaaactgcgagcgtaagctcaataccagcttgcagttcattcatctggccttcctggcgctactactcaaaagatcgtaaacaggttctaagtgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacatctaagacgtctattctgcctgattaaacctttttcctctgctttacgcagtgcttcatatctgcagtgaacctgaagaaatgccaagattctctggaactgagttcgaatggttgccggagatcgattgaggtgctgtgcgaggatctttgtattagttgttttcttttcacggctggcctcaagcaaggtgtagtgcgaccggggtaggcgcttatatttttcatagtccataaaacttcactccaattttatcgaggcttatttttattgctgtcatttgtgagcggttataaacgctatttttaaggcttaattcgctacaaagcagtattttccctgaatgcctcggtcttcgtaagtatatagatagattaataagcataaattatgccaatatatttaatatattgattattaaaagttattttttttaaaaaaagtattttatcggcaactgttaaattttacgacataaatattaggtgaactttatggagcaaatatatttttttgtactgaagttatagcttgtatgcaattgcagtattgccactgtgacagtaatttcattagtatctcgactcgacaagggttgtggttgattagcgacattcgtcttgttgagtaatgcaatagatgttatgcaatatctatatttaattaaatagttgatattaaaggaaaataccatggatcaattttctaaaaaaattctggctgccagtatcgttctggcgtttggttttgcaggtaatgcttgggcagttgacgcggtaccgtcaccgttgtctatagatggctctgctggcatcaaaggtgacggaagtactgcaagcgtaggcaatacaacctccgctgatggcaacacaagcactgctgacaacaacggcaatgacaacagcaccaacacaagcactgctgacaacaacggcaatgacaacagcaccaacacaagcactgctgacaacaacggcaatgacaacagcaccaacacaagcactgctgacaacaacggcaatgacaacagcaccaacacaagcactgctgacaacaacggcaatgacaacagcaccaacacaagcactgctgacaacaacggcaatgacaacagcaccaacacaagcactgctgacaacaacggcaatgacaacagcaccaacacaagcactgctgacaacaacggtaacgacaacagcaccaactctagcactgctgacaacaacggtaacgataacagcacttacgctgataacactaacaacagcgataatagtgataatagcgacgctagcgacaacagcgacaacagcgacaacagcaataacagtaccaacaccgctgacagcaataatgacagcagcaataacagcaccaacaccgctgacagcaataatgacagcagcaataacagcaccaacaccgctgacagcaataatgacagcagcaacaacagcaccaacaccgctgacagcaataacgacagcagtgataacagcaccaacacagctgacagcaataacgacaacagctccgcgcatactgacggctatggtgctgctgccaataatggaagtacagctactgctgacaacagcgacaacagtgacaacagtttggctgatgcgagcggtcaaggtagtgctgcagctaacaatggtagtacggccacggttgacaacagtgatcacagcgacaacagctccgcatctgctgaaggtcgatccgcagctgccaacaatggcggcactgcaactgtagacaacaccaacaacagtgataacagccaaactactgcaagcaatggtagtgcagcatctaatggtggtgatgcaacggctacctattctgttaacaattcagcattggaaggatctgtaacaggtcagtcagctggtggtttgtcagttgaagaagctgttgcacttgcaggtggaagtttaagcaacaatatttctgattcgttcaatggcgcaggcctgaatcaagttgctcagaaccttggatccagctcactggttcaacagcaagtttccttccagggtaatgtaaacgttaaccaataattgtaagtttggataattacaacttgagttaataacgtaactcttctaactggcaagcagtaatgatattgcttgccagttttttttgctaaaacagaagatataaatataagcaatatgtggaggtcagtatgaaagccgatatcaggaaaggcttgattgcgtttgcattattcatgcctgttagcatgatttacgcggcatccggtacagaattaatggcggttgaggatgcataccttcctcatgcagaaagagcttccttggaggagcttgatggggcgacgggccgagagggtattgacgtaactaccctgaacaatatgaatgttcgtgcacttctttctggcaatacagcaacgaacaatgctagtggctttaatatgattgacagcggttcttttgccggatcagggggtatgttttcagtgattcagaattcgggtaacaatgttcttattcaggattcgacaattattaatgtaacgatattaccctgatttagattgaatattttgagagaacagccgataacacataaagcgcacacagtttattgttttgttagctgcttgagatttattacatagtttgcatgaggtggtaagcaattttagttactccaggacaaaatcgcatatgagactgtctccgatcacgtttgctttattagagatcctgataattccttgtagtgaagtatcagggatggatatgatcgatatggtaggtggtgctaactttaatatacaagtaaaaacttttgcagaacggcgtttcaatactgtttatcggcagcagtatgatttcagctgcggttctgctgctctggcgagcttacttacttttcattatgacgatacggtagacgagcaatctgtatttatcgacatgtttcagcatggaaatcaggaaaaaataaaacgggaaggcttttccatgctggatatgaaacggtatcttgaacgcagaggatatcgctcggatggcttcaagattgatctaaataaattgcgttctactggaaatccagctattaccattatcaaccataatggttacatgcactttgtcatcattaagggagtggatgaattcaaaattttattaggtgatccggctcagggtgttaaatctatggatcgttccgaatttgaagaaatgtgggggaatcgtattttatttctgatccatgataatcgcgatcctgaagtaagctatcaaaaaatatatcaggaatgggtgggcagagtggctccgctgggtgaggctgttgatcgatcaagtttgggagtttttaatgtattgcacccaggcccttgggacttttgataattcgtacagcgcgggggaaaaatgagaatcaagagttttcgtctgatggttaaaaatattcaatcatgtcttgctatgttggtactgtcttgttccatggttgcagcatatgcagaggatttgaatactagaacgtcggcacaagatcattttcaccaggaatgggagcgagtaacagatgaagagctttcaacattaagaggagggtttattcttccaaacggcatacacattgatatgaatctggaaaaatttattcatttgaatgatatgctggtgcattcatcttccatgcaagttcctggagaaagtgtggttttacagacgggtatgcaaaattcgatacctgattctgttgcaatgccgcaactcagttcttttattcagaacacgctggatagtcagcatattgatgcactgacaaaaatcaacatagaggtgagcaacttgaaggaagtgatggcgaatggcagtaatcatcatatttttactgaatttctggctccggcattattgcgatagtttaatcatttacgttgctggatatgaaaagagatgtacctaaagaagttggtcagttgacgggtagtatgatgtacaaattattcgcaggttgtctcgcagtatttctcgtcatttacgctcaagcaggaaggtcagcagatgaagtgcttgagcaatataaatctctttttgcacagcaacaaaaggaatttgagaagcagcgacagactatcattgagcagggaaaggaaattgagaatctgaaagctcgcctggattctttgattacctcgcaatcagctgatcgcaattcctctggaaatactgctgctaaaaatggagcatcccacccatcacaatcttctccaccaaagacgacggctgctaaaccgattaataaaaatactgatcatgttcaggtgcgtgcagaatccagcaatcttccatcaaaaccggtagggcaggcaccacccaaacaggatgaaaaaccaagaccacctgaaatgcccagattgagtgacgcagtagggggagtgctgacacgccacggaaaaattgtgattgagcctgcgctggaatatgcttttacagacagtaatcgggtttttctggatgcatttacatttatcccggcaattgctatcggcttgatagatatccgccaggtagatcaacatagcatgatggcaagcattggagctcgttatggcgtgacagatcgtcttgagatcgaagcaagagtcccttatcgtgcacgttttgatgagcaacgctccaggccggtcagcattggtgcggggattgatgaaacgttcaacgcatctggaaatggtttgggagacattgaatttgctgctcgctatcagcttaactcaggagcgggggggtggcctattttggtgggaaatatgcgagctacagcgcctacgggcaaaggcccttttgatattaaatatgcacgagcacaaggagttcctggagctatatttcctaccgaggttcctacaggatctggtttcttcagctttgagccaagtgtaactgcactttacgcgactgacccggccgtattcttcgcaaatctggcctataactataatatgggcactaaggaaaaggcacttgatggatcaggtgacaaatttaaggtcgatccaggttatgcggtgggtatgacttttggtatggggttcgggatcaacgagcgctcgtctttcaatatcgggtatggccatcgtcacatttttaacaccaaaataaataaccgtacattgaaaggtagtcagctggatataggacagttactgcttggctatgcattcaaatattcgcagcagaccaccttgaatttctctgttgctataggcacaaccaatgatgcacaggatgtcagactcagttttagaatgcccatggtattttaggtacaaaaacagaggggcgggtattctctgttgcgaaatgatggatagatctgcttaacatccaccctcaatcttggcacaccagtatttcttgattttttcttccatgccggcactcataccagcagcacgtccttccttgaaggcgatttctggagaaataccttccttcagtcgataagccgtccacatggcgcctgcccggttgccagttgcgcaatgtaccagaaaaggaggagatgcttgttccagaacccgcttaaaggctgtcaattgtgattcatttacgccgtcattggtaacgggaatattgatataggtcattccagctgcttcgacagctttcctttcatttggtgtaccttccgattcaatacgtaaatcaattacagtgttgaagctgtgcttgaccagctcttgaatgctgtcatgagtaagagctccagaagtggcaatttggggagtgacacgataatagcgcatcagatcattaacctgcgtagcatacggtacctgatctttagcgaacgccaagcttgtcgacaataagacgagaagggtgataattgtcctcgcaaaaaacatttttacctccaactgtaaaataatgtacgaaaatcgtagcatgaataccgggacgggtaaaagagccggtataaattatgcaatgataatagttacctaattagatctggcgattgattttttgagttgttgaaaggagggatagatcgtactgataaattaaggtgatcgtgcattatctttatctttcttaaaggaatgataaacaagtgtttactgcttcagattatatgcacatgtcgcatgccttacagttggcagaaagagggttatttaccacaagcccgaatccgcgtgtagggtgtgtgattgtaaatgatggcaaggtagtcggaactggatggcatgagcgggtgggggaatcgcacgcagaaatcaatgcgttgcgggaagcgggggatttggccagaggtgctacagtttacgtaacactggaaccttgcagtcatcatggtcgtacaccgccatgcgttgaagctttgatttgtgctgaggtatgcagagtgattatagcaatggatgaccctaatcctcatgtaaacggccaaggaaaggagaagctgcagagagccggagttgaagtgcaaacaggcttgttggaggatgaagcacagcaactgaatattggatttattacccgaatgcaccatagccgaccgtggatacgaactaagatagcggccagcctggatggcaggattgcattgaaaaatgggaaaagccagtggattacaggcgagccagctcgacaggatggccacaggtggcgtgcccgttcatgtgcgatattaacgggagtcaattcagtaaaggtggatgatccactgttgacagtacgatatatcgagacttcgaggcaacccatacgtatcgttctggattcgaatctggaaattcctctacaggcaaaactgctggaaaatgctgatacaacctggattttcacggtgcaggctgacaggggaaaaatacatcttctggaggaagcgggtgctcatgtcgttgttctgcctgatttggcaggtaaagttgatcttaaagcaatgataacgaaactggccgaattgggtatcaatgagctgctggttgaagcaggtccagtgttgaacggggcgttggtagcagccgaattgatagatgagattattttttattttgcccctaatctgttgggtaattcggcgcaagcaatgctggtactacccgaaattacagatttatcagagaaatataatttacagataactgatattcggaaaatcggaatagatatctgtctggtagcaagatttatcaaataagaaaggatacagaaattgcgtggtaataaagaaagaaggggttttgtcgttggaaaaacatcgatggtaccgttatctgaattttatccggctgaaaactaaattatgcgtattctgcacattctggatcactccattccgttacacagcggttatacatttcgtaccctggcaattttgaaagaacagcgtgctcttggctgggagacattccatgtgacgagtgccaaacatgctggcttaaccatgttagaagaagatgttgatgactggcatttcttccggacacccaagcgtgcgcatcctgtcaacaagttgcccgttctgaatcaggttgctgttatgagtagcttgactgatcgccttatcgagattgttcagtccgtcaagcctgatattctgcacgcgcattctccggcgctcaatgctattcctgccttgcgtgtcgctcgtaaatcagggattcctgtcgtttatgaagtcagagcattctgggaggatgcggccgtggatcacggcaccagccgggaatggggcatgcgctatcgtctaacgcgcagcttggaaaatcatgcattacggcatgtggatgcaatcaccacgatttgcgaagggttgcgcaacgacatgatcgggcgggggattgcgccggaaaaaatcaccattatccctaatgctgtcgatattgagcagtttgtgtcaacatatcctgctgatgaatcgctgagagaacgattggggctcaagcacaagcaggttattggttttattggttcgttctatgcctatgaaggcctggatatcctgctacaagccttgccgctcatgtcgccgtaccatcctgatttgcgcgtactactggttggaggcgggccacaggataaacagttgcggcaactggccagccagcttggtatagaagataaggttatcttcaccggccgtgtgccgcatggtcaggttcaattttattatgatttgattgatgtgctggtttatccccgcctttccatgcgccttaccgatctcgtcactcctttaaaaccgctggaagctatggcgcagggcagggtgttggctgcctcggatgtcggtggccaccgggagctgatccgcgacaatcataatggtatcttgtttaaatctggtgatccccattcattggcagagaaagtcggaacacttctgaacacccctcagcaatgggaagaattgcgcagagcaggacgaaaatttgtagagaccgaacgcaactggcggaaaagtgtggacagataccagtttgtttattgtgatttacttaacagacaaaaaaacaaaagatgattatttctgggtagatattcaaagcggaaaatatgtgagttaaatttgtgccgtggcttggacgtttactttgagataagatgaaaatgggtagaaaactatgaaaataagtgtaattggaactggctatgtcggactggtaacaggtacttgtctggctgaagtgggcaacgatgtgttatgccttgatgtggacgtcaacaagatcaatttgttgaaacaaggtgagattccgatttatgaacctgatctagaagacatggtcaggcgcaatgtatccgtaggccgtttgcgctttactttggatcaggcagaatgtacggatcacgggttggtacaatttatcgcagtcgggaccccgccagatgaggatggttctgccgatatgcaatacgttacgacggcagcacgggcaattggccagaatatgcaggattataagctgattgtggataaatccaccgttcctgtggggactgtagatagagtacgcggagttatttatgaagaattagcaaaacgtggtgttgagattgatttcagtgttgcatccaatccggagtttttgaaagagggtgctgctgtagacgattttatgcgcccggatcggattgttatcggcgcagatgatgataaggccatagaacttttacggacattatatacgccttttaaccgaaatcatgaccggctggtcgtaatggatgccagatcagccgagctgaccaaatatgctgccaatgctatgctggcaacacgcatttcatttatgaatgagctggcattactagctgagaaattgggagccgatatcgagcatgttcgtcggggaatcggttctgatccacgtattggttatcattttctgtatgcgggttgcggttatggaggatcttgttttcccaaggatgttaaggcattgcaacgcactgcaagagaaaatggaactggattaaaaattctggaagcggtagaagctgtgaatgctcgtcagaaagaggtcttgcttgacaaaattcgggcaagatttggctctgatctttcaggtaaaacatttgcgctgtggggacttgcttttaaacccaatacagatgatatgcgggaagctcccagccgaatgctgattaccggtttgttggcgcagggtgctgctgtttctgcttatgatccggtggcgatggatgagacaaaaagacttttcgcgagtgaacccggcctaaaactggcaaattcatctatgtcagctttggaaggtgctgatgcactcattgttgtaacagagtggaagatgttccgttcgccggatttcagtgaaatccggcgcaagctcaggaatgcagtaatttttgacggacgcaatatatacgatccagatagcatccgaaccgaaggatttgagtatttttctatcggcaggccgtgaaccagtgcagatgtcgcttgcgtgtaaaattttacctgattagggtctgttgccgtttcaggctaccttcttgcttcataagaacaggctcgtattgccgttgtagttctcacacaacagcaatacgagcttgcaatgccccgattactgctcaatgatgagctctggtcgaagctgctggccgttttccttcacaataatatctctacaacaagcaagatttgcgtatgattatcgaaggcatgctgtaccgcatgcgtactggttcttcctggagagatttacccaagggtattcgggagctggagcaagatttataaacgattcaccgcctggtctgccagcggaaaatggctcaaggtatttcaggctctggtggttgagccggacatggagcgggttttcatctatggtagctctatatcaaggctcaccagcacagtgcgagtggaaaggataaggcaatcggaaaaagctggggcggtatacctgcaagattcgcatggcggtgatgcccacagactttccatcgcattcgatattaccggtggtcagattaatgattgcacacacgcatcggctttgctattcaggctgggtgtggctcaatctattattgcaggcaaaggctagacagtcagatcatacgcgatcaaattgaacagcaaggtgccaaggcagtcattccagggaagtggaactccaaaacaggtaatgcagatctgtaccgagaacgataccgatatctggtagaaaatattttcgcacggttgaaacagctccgggcagcgcgcctcgcgctttgataaacgcaagcgaaactacgaaagcctcgtggctatagccctgtgcctttctatggttaccaatacggactgagaacaggccctagcagatgtcacggcattaaactaaacaaaacggagattaaaaacaggtggccacctgatcctccatacagagcggatttgactatagcttgaggtattgcgtgaaggtagtttggtagtactacggtagtactacatgaggtagatttaaagagttacagactacattgatcatggatgtaacctataaaggagttcctaattagtggcgcgttaactactaccggagctttggctatcataggttttgctacaattttaatgtgtcttacttttaccttacttgttgaagaacagaacattaaatcgatcaggtcatatcttgctgaatcatttcaagatatttctgatgaagatttgtcgtggcttagtttctggggcgtacttagtaaagttaatgcatgattttatgattccaatcttctttttttaagatattttattgaatgctattggcatagatgatttgttattatcttttttgatcaaataattatggttttagtagtatgagacacactccatgggaagtgaagaatagggataaaggcaataatagtgatcttggggttgttgtatttacttcgctttttccacatcccggtcagcctaatgcgggattgttcattcgcgagcgtatgtttcgagtgggtaaacatctgccgcttgtggtaattgctcctgttccttggttcccattgcaggggattctgcgccgctggcgccctcatttcaggcccgatgcaccttatcaggagtatcagcaagattttgaaatttaccatccacgttttttttctgtacctggatttttgaaatttctggatggttttttcatggcactaggtagtttgctaactttgtggcagcttaagcaacgtttcgattttcagattattgatgcacattttgcttatccggatgggtacgctgcaagccttttgggaaaatggtttcgagttcccgtcactattaccttgcgagggacggaagcgcggctttcctgtagatttttataccggttcctcatgcgtaaagccatgatacgtgccgtaaaaattttttcagtatcggattctttaaagcgagtagcggtgacagtcggaattcaggaaggcaaaatactcgtagtaggaaatggtgtagatcttgataaattttgtcgtgttgatcggcttgaagcacgcaggagcttggggataccggaagatataccaatattggtatcagtgggtggtctttgtgaacgtaaggggtttcaccgtgttatcgagtgcttgcctgatttaagaaaaatttatcctgatattcggtttctgatagcaggtggggcaagtgccgagggtgactggactgggaggttgaagcaacaagttgctgaatccgggctggaggagcatgtccgatttctgggtattgtttcgccggatcgtttgaaaatcctgctttcagccgctgatctatttgtgcttgctacaagaaacgaaggctgggccaatgtatttcttgaagcgatggcttgtggcttgccagttgtcactactaatgtgggagggaatgctgaagttgtctgtaatacagagttaggtaaattagtaccctttaatgatcaacaggcacttaggtcggcgattgataatgctttaaagagcaattggaatcagcaaaaaattattgattatgcatataaaaattcttgggatcagagagttgctgtgcttgtagaagaatttacgaaaattgctgctcaatcagagcaggcgaaacgatatggatcattaagatagacagtaagtttatgcctaatattagtactcatttggtatccaggtttctttttccacttcatgaacagattaaaaaacacagcagtgttaatgtgcgtaagtctatggagaacacccagtggttttctcctgaagagattacacagttacagattgaaagattgcgtcaattactcatctacgcgaatactcatgttccttattaccaaaaactatttgccgggttaaattttcagccggaaaagataaatgtgttagctgatttgcagcatctaccttttctggacaaaccagcgattcgtgccaatctggaagcacttaaatctaatcaggcgcgtcatctggctcgcttcaatacgggtggatcaagtggcgagccgctggtgttttttattgggaaagagcgtgtcagtcacgatatcgctgccaagtggcgtgctacacgttggtggggagtggatataggagatccggagattgtggtgtggggctctccaatcgagctgggggcgcaggatgcattacgtgccgtgcgcgaccgtctatttcgcagcaaattgctaccggcatttgaaatgtctgatcaaaaagtagagggtttcctcagtactatctgtgaatttcgacccaaaatgttgtttggctatccctcagctttatcccatatcgcgaaacatgctgataaaatcggcatcatcatgcgcaatctgggtattaaggtagcatttgtgacgtctgaacggctgtatggcgatcagcgtaagcagatcagcgatacgtttggctgccgggtagcaaatggctatggcagccgggatgcaggttttattgcgcatgaatgccctgcaggcgggatgcatattaccgctgaggatattattgttgaaattgtcgactctcacggccaacctctcccgtatggggagtcaggtgagattgttgtgactcatctggccagcagggattttccttttattcgttatcgaaccggtgatattggcacgcttgatgacaagatatgtgactgcggacgtggcttgccgctgatcagggaaatacagggtcgcagcactgatttcatcgtcgcccgggatggtacagtcatgcatggcctggcactgatttacatcctgcgagatatgccgcagataaaaacatttaaaatcatacaggaaagtatagatcttacccgcgtactaatcgttactgagggcggcttgaatcaagtggatacaggccagattattgcgtcattccaggctcggttgggccggggtgtaataatcaaaatagagcaggtatccgaaatttcagccgagaaatcaggtaaatttcgctatgtgatcagcaaagtggctgcaggttgaattaatcagccggatgcaggtatggtatcggaactcccatccataacaatgcaacgattatcagagctattccaacgccgatggtgccgacgatcatgccggcgaaaatggtcaggccatctttgctgagtaatccgagcgacataataagaataccccagcctggcaaaaaattgatcaagggaatgggcagcgcaatagaaattgaaaaaataaaagagaagaggccaatgatgcgctcccaggcatgcacgctgatgtaggttagccgcgggtgcaggtgtctttctatttttcgcaaccatggtgtgatcttgttgatcagtttatccagtgttttttttcttattgctttctttgccagccactggggaatccagggtgccctcatgccgcatatcatttgtactgaaaaaataaaaagcggaatagcaaaaacagtcgtaaaaccaggcggggcgggaataggaagacaaattggcaaggtggcaatagccagcaatacagcaaatcctcgttcatccagagaatgtttgatctgatcgacagtgatcatctcattgttattttgtataacaatcagttgtaataattcagacgtatttttttctttgtcctccactactccctccttggttgtttcgatataaaattcaggccatttctgttaccaggattacttttctaccgggtttttgtaatacaggccgtatggcaacgagcgatttatcatgttctttaccgtttctatgaatttgcttcctgtagaggctgtgcgcgaaactatcgaattgtaaagcattgcgaccgctggtgacctgtggcaatatcaattggttgcagtggcaaatatcagttatcttgaacacgttatctcttttagaggaaagacgaggatattttggaaaaatttattgagcaggtatcactctatattcatgatgccccgatttggccatttaccctgctgggtttggttttggttgtgggggtgggggtggatattattaatcatcggcgccgagcaggagcggtggaatattacgactctgtttttcacgaggaactaattggtttgtatccggtgaccactcgctggccggatgatctggtggcctatatgcagcctcgcctgcctgtgttgcgggatgcctttgaagtcctgagaaatttcattccacaaaatcagttgcgtgaatataacgttgcatggaacaagttctaccagtttgcacgtttaggtggaaatgagcaggaaggtttacctggaggaaatgcacaggactttactgcagaacaacccgatcagcatcaacagcagcagacttttcagcaaatggttgcagatttgctggcttatactgatcagttcaaaaaataatcaggttgcaattatatccggaaggaagtgttcgatttgtcggacaagtcgttgcttgagcttgagcgagcctgtttattaatgaggacatgagcatattcctggatcatccatcagaaggaaaaatcgaaattctcccgatttctggttttcgcggagtagggaagtttattgatgtaccttggcaagtatatgcagatgatccgctgtgggtgcctcctcttcggctggaacgacgactgcatttctccagattcaatccctatttcaagcatgcccagtggcaaggatggatcgcctaccgtaataatcagcctgttggcagaattagtgcacagatagatgaactgcatcggcagcggtacggaccagataccggacattttggtatgctggaatcaattaatgatgaaaccgtttttagtgggctgatacaggcggctgaagattggctggttaaacggggagcgcgtcagatcagcgggccattcaatttttctattaaccaggagtgtggcctgttggttcaggggtttgataccccccctgttttcatgatgccgtattcacctcggtggtatgtcaatctgctggaacaaaatggttatcatcccagcaaggatttgctggcttactggcttgaaacagattttgaatcgcctcccaccatgcaggctattgatcgtaaatatcagcatcggataaagatcaggacgctgcaacgcaatcggtttagcgaggaaatcgagatcatgcgaaatatatttaatgacgcatggtcggggaattggggattcgttccctttacgcaggaagaatttgccgaactgggcggttctttacgttggctggttccagatgaattcgtccagatagcagaaatggatggggagcctgtcgctttcatggcagtgctaccaaatctgaatgaagtgttgccagatctgaatggaaatctttttccctttggctggctccacctggttaataaactgaaatccaattcaattaccaccggaagagttcccctaatgggtgttcgcaaacaatttcatcatacgctctccgggatggcattggccttcaaggttattgatgcaccaagaaaaatagccagaactaggggtattcagcatgttgaattatcctgggtccttgaggataatctgcccatgcgtgcaattctcgaaagaataggagggaaagagtacaagcgttatcgtatttatgagaaaacgctggcatgatcaggatgcgatcaaatcaattcagcaagacaaaattctgctttgctcgcgatgcgcgataacgatcaatttactgccctggtattggctgccgaccggggtgatcaggatcctgtggcaaggtatacgggagcggtatgcaaggcttatgctcctgtttgtggaaaaccaatggttatccgggtactcgatgccttgagcggttgtaacaaaataaaatccattcttctgtgcggcccgcccgaatcgctgttatctgcatgcggagaactcaagcaacgtatagaaaataagcaggtagattgggtgaaaaatctggactcacccgcccgtagtgctgttcatgggctctcgcaaatcgatatgcatcaaagaattttgctgacgacagccgatcacgccctgctgacgccggaaattgtggaatatttcttgcaagcctcccgcaatctggaatgtgatgcgactgtcgggatcatccggtatgaaactttgcaagacagatatggtaatgccaggcgcacggtaattcgtttgcgtgatggaaatttctgtggctgtaacttgttcacattcaattctcgggggcgcacactggtggatttctggcagcaggcagaggcattgcgcaaacgtccctggaaactgatcaaccgggtgctgggttggcgagctgtctggtcatatctgaccggacgtttaacgcttgatcaggcgctacaggaagtttcagaaaaaacaggggtgcaggtgcgtccggtaattttgccatttcctgaagcaggcattgatgttgataaagtggaagatttacagttggtaaaatctattctagccaaagcaatatcgacacatccaccggtgtagaacggacagctgactttcatgggaattattgaaagatatatttcacgggagctattacttcctttcttcgtagtaaccatcatcctgatcgggcttttcgtaagtttcagcgttgcgcgttttttaaccggggcggtggctgagaccttgggtgctatagccatgttcaaactggtggggctgaaaactattattgcgctggaagtgctggtgccgattgctttttatgttgcggtaatccatggtttaagccggatgaaccgtgatcaggaaattaatgtgttacgttctgtcggttatggtgacaaccagattattcgtactgttttcataattgccctacccattgccatcctcagtggagtcctttccatttatgctcgcccgtgggcgtatgcagaaagctatgtgatgaatgcacaggctgaagctgagttaaatactgatcgatttcagccaggaagattctacggtagtgagaaaagtggccgtgtaatctttatccggggaaaagatgatcttgaaaaacgcatggaaggcatttttcactacatcagaacagctgaaaacagagaaattatcgtatcccgagaaggttaccagcagcccatgacacaggagcaatggccgtatatcgaattgctggacgggaaaatctatcgtcttggatatgatgcagtcagggatagtactgttcagtttgaaaagatgatttacttcaatgaaaacgatcaagcccaaaactatcgacgcaaggctgcatcaacgcaatcattatggaattccgagcaaccgcaggacatagcggaattacaatggcggctttcccggccagccgcaaccattttgctggctttgatcgcgatttcttttacccggacagcgccacgtaaagataaagctgatagaacatttattgttgcagcgctagtattcgctgtttattacaacctcagtggattagcgaaaacctgggtggagcagggcgttgttgctgccgtgccggggatctggtgggtatatggattgcttctcatggttgttgtattacgcctgcctgagctcagattattcttatctgcaagaaaatagtgaagatctgttatcgctacatcgccttgcaggttttgacagggatgattattgctactgtggtactgttgcccttgttcagtttttttgatctgcttgatcagctggatgatgtggggaaaggaacatataccacccgggatgctttcctgtatacggcaatgctgatgcctcgcagatttatccaaattgcgcctttcattgcgctgctggggacagtaggtgcgctaggtgggttagcggtcagccttgaattggtggcgatgcgcgtggcaggattttctcctttgatgatcagctttgccccgattggaatcgggggggggcttatcacctcaaccatagcacttgagtatttggtggcgccacaatttcaacagcaggcgattgtattgcgtgcggtggcgttggagcaaagtgcggaattggggaaggggctcggaatctggacacgtaatgagcagaatatattacgtattggtgaaatgctgcataaagggcgggcaatagatatcgaagtcatgcattttgataaacagggattgatgactgcccatatacatgcgcaatatgcagatattttcgacaaaagtatgtggaaattgcatgatgttactgtacgtatgtttgccccagatcgtatcttttccagaaaaatacacgcacttcagtggcactcgtttctcggccctgaagatatcgcgacactgacaaaaccgcctgaaagcctgaccccattggagttgttgcaccatgccgagttcttaaagatgaccggtcagaaagcggatgcctatgttatggctttatggcgcaaggtcggtagtgtagtgatgactattgcaatgattttgatagcaattcccttcatttttggctcggtgcgtgaaggattgggaggaaaactggttctggcttcattgatggggatcagtatttatctgctcgatcagattatcgctaatatcgggctggtatttcagttgaatcctatcgttgtttcaattgcacctggatcaattctaattgttattgcagcatattggctgttacgacgaactttttgagataaacatgtctgcaactttctttgttcatattgtcggcaatagtaaagctaatttgtggggggtgagtgggcgcactcgtcttgaacggatgctgagctcaatcgggacagccgctgtggtagaagatctttcacaattggctggagcggatttcgtgttgttgctgcgggctgattatctgttcgatgccagagtgatcaatgccctgatggtattggataaacacacggcacttgttacacctgtggatgaaattccagtggcgatccggacagacggaaacgacgctggtgtgatgtgtgaagtattgagcgagaaacggccggtacccgatgatcttccacgctgcaccttaaaagacctcccgattcaggtacagcaaaatctgaaaaagaaagatccaccttatgtactgccgattctgcgttgcaatcaggccgcgcttgaatccgagctttttgccgcctcctataaaggtgtgaccgatctggtcactaaatggctatggccttggccagcgtttatgactacacgtctgtgtgtgcagctgggactgaagcctaatcatgtaacattacttagcctggttctggctgtactggcgggcgtggcattctggtatggtgcgtttggtatcggcctgatcatggcatggttgatgacttttctggatacggtcgatggcaaactggcacgcgttacgctgacatcaagcaaggtgggcgatatattagatcatggtttggatattatccatccgcccttatggtatctggtttggggtgttggtcttatgactaccaccacaccgctgaccaatctcgaattattcacctggttaatgtttattggctatataggtggtcgtctttgcgaaggcgcctttcagttctggctggcctctttcgatatttttatctggcgtaaagtcgattcatttcaccgcctaattaccgcacggcgtaatccgaacttgatcttgttaactgctggctggatagttgataggccggatattggattcattctggtcgtactgtggcattgtctgtctaccttcttccttatttgcaggctgtttatcgcctggcaaagccgatcccgggatggtgtactttactcatggatggagggcattgatcccgttcgtgacagacggcaatttgcagtcagagtatttacccggccgtctctttcccagcgatatgtcaggccaacatgagatggccagtaactctgtggggaattttgtgcctgccagggtaggtttgatctacaacccgctgggaggctggtttcgtaaacatgccgcacggatgcagagccttctggcaacattgccggaaatcagacaaattcaggcaaccagcccagttgagtttgagcaggctgttatcgctataatcgaagcaaagattgaatggctgattgttgtggggggagacggtactctgcaaggcgtgatcagttgtttgtttgaacgcttgtcgctggatagatggccggaaatcactattgtgccggctggaacaaccaacatgaccgcattggatctagggacgaatgggcgggcagagcagattttgaccagaatcaggcaatatgtgcaccaacctggtgaggtgaagcggataaagaggccagtattgcggattgaacaggccggtacaagaaatgtatacggaatgatatttggccttggtttgattgctcgtggcgtgaaattctcgcacagtcagattaagcaaatggggattactggcaatatctttacagtattgatcgtgctacgttcattggtgggctcctttctgggacgcccacaaactgagtgggccccggtgcatattactcaagaagataacacgggtactttgagcgaaaaagtatatctgtttgcgctcgtcagcacgctggaaagattattgctcggcattcgcccttattgggggcaggaacctgcgccgttacgtacaacatttgtcgagcaacacagcaagcacttctggcgaaatatctggccgctgatcgcagggcgcggccaccacttgaaaagagaggaaggctatatcagttataacgcagcttcagttgaattgtggctggatgatgaatatatcgtggatggcgagctttatcatgcttccagtcagtacggaccagtaaaaatcacggctgatggcccgattctgttccgtgttttctaaaagagagatctgaatgggcgattccgttgatttacaaagtatccctgacctcctgatacaggaaatagcgatccaggatgctcagcctgtacacccgttatttcgaggctttactgatgcgttgagacagcgtttcggggaggctctggatgcagtcgttctatacggttcatgcctgcatacttctgatctgactgaaggtattgtcgatttttatgtgctggtcagtgattatcagctagcttattccgatcatctgctggcctatctgaatgcctggttgccaccaaatgtcttttatctggagattcccgcttcaaccggtgtcatgcgtgcaaagtatgcagttatatccacagcagattttgaacgtggcgcccgtcactggtttcatccctatatctgggcgcgtttttcgcaaccggccagattgctttatacacgtgacgaccagattcagaagcgtatctaccgtgcgcaggcgcatgccatacttaaatttatcagttcaacgttgcctgtacttgagtcaggctccagtaatctggagacaatctggacttccgggctgatgctgacttatgcagctgagctgcgtgctgagcgcaagggacgcgctcaacatttagtacagcttgatcccgagttctacaaccaattaaccgtagcggccgtacctgccttgagtccattgctgagtttgcaaactgatgagcagtatcatattggagcggtaacctcgctaaagaaattaagtacacgtatccaatggcgattgcggcgctggcagggaagagttttatcaatactacgcctgagcaaggcgacgataactttccgggattgtctggattatgctgcgtggaaaattgagcggcatacaggcatcaaggtggagattacgccgatgttaaggcgtcatccgatactctggggctataaggtgatgtggcaattactgcggcgtggcgtactgcggtgagattaatatctatattctgagtcctcaccgagggtttacgagatttattggggcgcgacaatgaaatattcaaatcaaatttttgttatgggttttgcagtttttctaactgcttgttctactatgtattacagtgggctggagaaagttggcatcccgaaacgggatatattggtttatcgcgtggaaaaggcgagggacacgcaagaagaaactagagagcaattcaaatcagctttggagcaattttctgttgccacgaattttaaaggtggcgatcttgaaggagtctataaaaaactgaaccgtgaatacgaagcaagtgtggataaggcaaatgaagtcagaagccggatagaggatatcgaaagtgtttcggccgcattattcagggagtgggaacaggagattacacaatactcaaactcgactttaaaacgaagcagccaggaaaagctcgatacaacgaagtcatattacagacagcttgttgctgccatgaaaaatgctgaatccagaatacaacctgtgttgactgtttttaatgatcaagtcatgtatcttaaacataacctaaatgcccgggcgattgcttcattgaaaggagaattgaaaacactgcaatcgaatgtctcaattctggttgccgcgatggaaaaatctataaatgaagccaatacttttatcagcaatatggagaagggttaaacagcgatttttattcatgatggctgtttgccagcaaggctttgagggaagattgcaagggggattcagctggtaatgaacaggatagtctgtccagatgctcaacagcagtctggcttagtaaacgtttaatttcatgagtgtcttcagattcttgggaatgcaactgaggctggatgcgaaacctgatatcttcaaccttgattccggttttattcattttttgttgaattgatggggcaaagttgcgtagccgagtggcagaagcaccgttatccacataaataaccaagaggccgtcagcggtatgctgccctgccgtacatcgatttttgaattgagatggaataatatccagtaggtgtttctgtacctctgccagatgtcgtgccttgataaataattgaccataatcgggcgtattactcagaactgtcagatagttgcttagattaaggatggacatgccattttgctttgtatacatattataaatattgaagattatgctggataatcagggtttgagacaatatgctcggtaccaaaacagttattgtcttttctgcttatcatttcgattatggtagtatggtcggactttattatcgcaacgatttgatgtgtcgctgcggaatttatcctgacatacgatgaattagatcagttgatgctcagccagataaatgattgcgtaaataagaaaagtgcgggtcacagcaagcactacttaacgcactgaatccaaatataatgtgtatcacttatcctcgttacgtatctgcaactattatgcgcttgcatgcattttctataacattattctggtttgatcatgaatcagccagcaagaaatttcagtacccctctgcttccccctgctgtgaaatagatcatgtttgatagttgatctgtattacagtgcatttttacatcaatagataaacaacaatttcccatgctgagtaatttactaaaaggtatttttggtagtcgtaacgatcgattggtaaagcaatattcaaggatcgtccgcaccatcaatgagctggaagctgtcatttcaccactgtcggatgaggagctgcgtgacaagacgagcgagttcaagcaacgtatctcaaatggcgaaaaactggatcaattgctgccagaagcgtttgccgtagtcagggaggcgagtaaacgtgttcttggcatgcgtcatttcgatgtacagctaatcggtggaatggtgctgcatgaagggaaaattgccgagatgcgtaccggtgagggaaagacattgatggccaccttaccaatctatcttaatgcgctttccggaaagggagtgcatattgttacagtcaatgattatctggcgaagcgtgatgctgaatggatggggcaaatttatcaattcctcggattgagtgtcggggtggttttgtcacagatgcctcatgaagataaacaagctgcttatggtgcagatataacttacggtacgaacaacgaatatggctttgattacctgcgtgacaatatggtggggcatagcgcagagcgggtacaacgcgtgcttaactttgcaattgtggacgaggttgattcgatccttattgatgaagcccgaacgcctttgatcatttctggcatggctgaaggggataccgaagtctataaacgcgttgacgtattgattccccggcttactcggcagaaggatgaaaatagtccgggtgattatagtgtggatgaaaaaacgcaacaggtattactgagcgaggaaggatttatacatgctgaaaaattactgggtgaggttggcttactgccagcggagtccagcttgtatgatccggctaatattactttgattcaccaccttaatgcgggattgcgtgcgcatgcgttatacaaccgcgatcagcattatgttgtgcagaacgatgaggtggttattgtagatgaatttactggtcgtttaatgccgggaaggcgctggtcggaggggttgcaccaggctgttgaagccaaagaaaatgtttcaattcagaaagaaaatcaaactttggcatccatcacctttcagaactatttcaggatgtatgaaaaacttgccggtatgaccggtactgctgatacggaggcatttgagtttcagcaaatctatggattggagacggttgtaattccaactcaccgtccgatcgcacgggaagatcgtatggatcaggtttttcgtacggcacgagaaaaatatcaggcgattattgcggatatcaaaaactgttacgagcgtggacagccagttctggttggaactggctcaatcgaaaataatgaattgctatcaaccatgctgacaaaagagaagctacctcatcaggttctcaacgccaagcagcatgaacgagaggccgatatcatcgctcaggcagggcagtcgaagatggtgaccatagcgactaatatggctggtcgaggaacggatattgtgctgggcggaaatctggagcaggtaatcaatcgtattcgggtagatgatgctcttgatgatatgaccaaaacagaaaaaataaaggaaacccgccaagcgtggcaagtcaggcatgatgaggtaatcaagctgggaggattgcatatcattggcactgaacggcatgaatcacgccggattgataatcagctgcgtggacgttccggccggcagggtgatccgggctccagccgtttttatctctccctagaagatccactgttacgtattttttcttccgaccgggtagcgaatattatgacgcgccttaaaatgccagagggagaggcaatcgaacatccatgggtgacgcgtgcaatagaaaatgctcagagaaaagtcgaagccagaaattttgatattcgcaagcaattactggaatacgatgatgtggccaatgatcagcgcaaggttatttatcagcagcgcaacgagttgctggatgccgagcaaggtatttcagaaaccgttagtgctattcgtgagagtgtggtaaatcaactaattagtctttatattcctgcgcaaagtatagaagaacaatgggatgttcctgggttggagaaagctttggccagtgaatttctcttgcgaattcccgtgcaggaatggttggaagctgatagtgaactgcatgaagaaaacttgcgtggccgtatcatggaatctgtgaacaccagctatcagggtaaagtcgaacaagtgggtgcatcaatcatgaatcaatatgagcgtatggtgatgttgcacagtatagactcacattggcgtgagcatttggctgcgctggatcatttgagacaagggattcatttgcgcggctatgctcaacaaaatcctaagcaggaatataaaagggaagcttttgagctgtttgcggggatgcttgacgcgattaaagctaatgtaacaaaaattcttatgaccgtacaaatccgtagtgagcagcaggttgaatcagtagcagaaacctcaactccgagaaatttgcaatatcatcacgctgcttatagtgaggcggaagaggagcatcaatcagtcacggagggtcatgaagctaagcaacaaccatttgtacgtaaaagtgacaagattggacggaatgatccatgcccttgtggatcaggcaggaaatataagcaatgtcatggtaaattagattaaggcccatatcaattagtcgatagtaatcaatctatcttggcgagtatagtctatgctaaaataatcgcgctttttaagagggtgctagggtgccattttagaaattcatgtgcttcaaggtgccggaattaagtgtgttattgattagctggtaattaatgaaatggaattgttagaaaatgacagacagtggtgataacggaaagatgagcgggcgacgccgctttttactggtggccacttcggttgctggggtggttgctggcgcgggtgtggcgacaccttttttgcgtagtatgatgcctagcgaacgagctaaagctgcaggggcaccggttgaagtggatatcagtaagctggaaccaggtatgttgctgacagctgaatggcgaggaaagcctgtttgggtactgaagcgtacttctgaaatgttagatgatctgaagaaattaaatgaccagctggctgacccgaactctgagcgagatcaacagcctccttacgcgcaaaacccgacaagatcaatcaaaccccagatactggttgtgctgggagtttgtacgcatcttgggtgttccccagtatatcggaaggatatagcgcctgctgatctaggtgaagactggctaggggggtttttttgcccttgtcatggatccaagtttgacttggctggtcgtgtctacaaaaacgtaccggctcctaccaatctggtagtacctccttatacctatttaagtgataaccaacttttagttggttctgacagtaaagagtccgcctaaaatgaataaacagcaaaattcaatgatggaatggatagacaagcgttttcctttgacaattacctggaaagcgcacctatctgaatattatgctcccaagaatttcaatttttggtattactttggatcgttagcgttattggtgctggttaatcagctgctgacaggtatttttctgaccatgagttataaaccagatgccggaatggccttcgcgtcggttgaatatatcatgcgagatgtggattttggctggttgatcagatatatgcattcaactggtgcttccatgttttttgtggtggtttatctgcacatgtttcgcggaatgatgtacggatcttaccgaaagccgcgtgaactgctgtggttgataggtatggccatattttttgttctgatgagcatggcctttacaggatatattttgccatgggggcaaatgtcctattggggagctcaggttatcgtcagtatgttcggagcaataccacttataggcgataccttgtcaagctggattctcggtgacttcatgctgtcggatgcagctttaaaccggttttttgcttatcacgtggtaacacttcctgttttgattgtagtactggtgtttgtacatatcattgctttgcacgaaacgggatccaataatcctgacggtatagaaatcaaggctaacaaagatccacaaactgggatcccggtcgatggcataccgtttcatccttactacacagtcaaggatatctttggagtagttggatttttgattgtgttctgtgggattattttctttgcaccagagatgggtggatattttctggaagataataattttataccagctaatcctttacataccccggatcatattgctccagtatggtatttcactccatattactccatgttgcgtgcggtgacagtgaactttttgggtgtggatgctaaattatggggtgttattttaatggcggcggctgtagttatcttttgtttcctgccttggctggatcgcagtccggttaaatcaatccgctataaaggaccctattttaaaattgcgttgactctttttgtgatcagcttttttgttctcgggtggttggggactaaatcggtaacacctttgtatactttactggcacaaatctttactacgatttattttgctttctttctgctgatgccgtggtatagcaaaatagataaagttaaacctgaaccagagaacgtaacaaaatgagaatgataaaaattttattactgaccgtattactaactccttttgtcgcacattcttccgggcaggaagttgagttagacaaagctcctatagataggactgataaggaatcgctgaaacgtggtgccaatagttttgttgaatactgtctcacatgtcatggcgctgattttatgcgctataaccgacatcgtgatatcggaatgagtgaggatgatattcgtacggaacttattcataccggacaaaagactggcgatcttatggaagcagctatgagaaagaaagaggctgagcaatggttcggtgtggctcctccagatttatctgttatcgctcgatcccgtggagcagattggttgtatacctatttacgtactttttatcaggatacgtccacttatagtggttggaataacttgacttttgacaaagttgcaatgcctcacgttctgcatcatttacaaggatggcagacattagaatcgggaaccaaaaatttggttttaacaaaatccgggacgatgacaaaagaggaatacgataaatttgtagctgatttagtaaattatatggtttatttaggtgaaccacatgcatcttatcgtaaagaacttggagtcatcgtattactgtttctgtttggtatgcttgggctaacctatctgcttaagaaagaatactggagagatatacattgaagattcttcagaattatcttctgtaaattaattacttgttatacagaagctatgatgacattatattcaacagcaacttgtcctttcagccatcgttgtcgaattgtattgcatgaaaaggatatggattttcaggttatcgatgttgatcctaataatatacctgaggatatcgctgtaattagttcacacggaaaagtgccaatcctggttgaaagagatcttgtattgtacgaagcaaacatcatcaatgaatatatcgatgatcgttttcctcatccgcaattaatgcctgcggaaccggtgatgcgtgctcgcgcaagattattattacaccgatttgagaaggagcttttcagccatgttgagtctctggagcagggcaatccaaaagcagcagacaaaattcgcatagaaattgcgaatggattggcaatgattgcccctatcttcgacaaacagagatatatgctgggagatgaatataccatgctggatgtggcaattgctccgttattgtggaggcttgatcactatgggatcaaactaccaaagcaggctgctgcgttgctaaagtatgctgaaaggctttttagcagaccgctatttattgatgcattgactccagctgaaaaattgatgcgtaaatgaataatgtctcttcaatcaaaccttatttaatacgtgctgtccatgagtggtgtattaataatggatattgcccttatatctcagcattagaagatggatgttctggtattccggctgagttatttaagaataaagaaattatacttaatataagcagccagtcagtgaatgacttacagattgataatgaaataattcaatttataactcggttcaatggagtaccaaaaaaaatcaggatcatgattgaagctgtatctgcaatatttgcgcgagaatcagggcaaggacttacctttattccggagattaatacgggatggaccgaggggagttgcatagacgattctattttacagaaagaccaagctttatccgttgaaggcaagcaacgagataaagcttttttaaaagttgtaaaatagttttatttttttttatttgccggcatagctcagttggtagagcagctgatttgtaatcagaaggtcgcgagttcaattcttgctgccggcaccaattaaatcaatgagttacatcgttatgatttagtggctgattgttacctgtccccagaaacgtaaccattagagcattttttatttaaatatatacatgtaatagactattttctatcataacggatggggaagggttatgcatgcctattcacaagatcttcgagatcgcattctgggtgcgttggatcgtggcgaaggtccaacggcaattgcccggcgctttgcgcagattcggcaatggatagaagccacgccggatctaacgcttgtcgagcttagtgaacgtttggctgtagaaggcattcagatcaaggtgccggcgctatggctcaactgaataaatgggggttgagttttaaaaaaaccctgcacgccagcgagcaatcgcgcacagacgtacgtcaggcacgaactgagtgggcccgcgagcagcagcattgggattgccgtcacctagtctttctggatgagacggcaacggccaccaacatgacgcgacagcggggtcgcgcgccgcgcggccagcgctgtgtggcttcggtgccccacggccactggaagagcaccaccttcattgcgggactgcgtcacgatgcgatcaccgctccgttagtgctcgacggcccaatgaacggggccgcgtttctcgcctatattcaaacctgcctgtgccccacgctgcagccaggtgacattgtggtggccgacaacctgtcttgtcacaagaggttccaggcgtccgcgcagccattgaagcggcaggtgccacgctgctctacttaccgccgtattcacctgatctgaatccaatcgagaaaatgttctccaaaactcaaagccctattacgcaaagctgccaaacgaaccatggatgccttatgggcgcagatcggcaaagtgttggatctgttcactcctgaggagtgtgccaactacttcgcttcatgtggatatgtaaacaaataaatcaaaaatgctctagatgatgtttgcccatttgtttcctcaatacctctaatgcggttgcatttaataatacgtgaatactctttcttcccttgacttgtggccggcatgtatccatgcaacgcttctcagtaaatcaacttgtgactactccaattcagtacatttcttttatacaaactggttgaaagagagaatttaaccaaatcaaccaggtattcaggcagttcactcagtaaaattaaaggctatgtgtcgcatcccggatgattgtaaagagacgggggtgagttttataccattctggcctgcattggagttttactcttggggcagattgcggtagttgctggttatacagactgacataacgcatgagggtctgttccagatcttcagtgttattgaatcgatgtgttttgagtacgtcagcaatacgctcgttaaaactgtagtggtctaatttaagcagacacctcgataggtggataaaatccactttaagaggacatactaatgaaagcacgcaggaaatttgacactcaatttaaattggaagttgttcacatgatcaaggatcacgaccttagtttgagcgaggtctccaaaacgatggggggggaaacagcgattcgtcgttgggtcgcgcagtatcaggcagatcttaacggtcaacgcggcatcggtaagccgttgacgcttgagcagcaacgcattcgaaccctggaggcagaggttcgacaattgcgctctgataacgacttgttaaaaaaagcatcggccttctttgcccgggaactgaaatgagctaccagttcgttgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccgtccagctcgcttcagactcacgataaccatcagacaatgccagcagttccttacgccccgtttcgtcagaaccgataatcaccagaagacataaccggtcatccattcgcacagtgctgtagataccatcagcccagacataagcataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctacccccagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctccagttcgttaaacagttacaaaagaagcgatccctgttgcccgtagttgtcgccttctggaggtaagtcgttcaggctattatgacgcggcgtcgctgtgctaaactagcttgttacaaagccagcatccatttgaaagcggcatttacagccaatcaccaaagttacgacagccgtcgattggttacagcaatggcggcacgaggactttctattggtcgttgtcgggtgcgtagtttttgatgcaccaagcgaacctggagcccgtctggaagcgtaaatttattcacaccacaaacaaacggcaaacacaatctgccggttgctgccaacatcctggatcggcagttcaatccggatgcgccaaatattgctggggcaggtgatatcacctacatccgaactggttcaggctgtcgctatctggcgattgttctggatctgttctcgcgcaagagagtgggtgtgcccagcatgcctgcagaactggcgtgtagtaaacaaaaatggtcagcagcttcgaccaggctcatcattgagcagtaatagtgacattgcaagctcgtattgctgttgaaatacagcgtacgagcttgcttctttaaatcaatagcttgagatcaaacgggaacaggccctaaactgttatttggcgacttgtctttcccggatttcgtccagggtcttgcagtcgatacaaagtgttgctgttggccgagcttccagccgctttaggccaatttcgataccacatttttcgcaataaccataatcaccctcatcaattttggtgatgatttcaccaatttttttgatcagcttgcgttcgcggtcacgactgcgcagttccagtgccatgtcagattcttgggtggcccggtcagccgggtcagcaaaaattgtggattcttcctgcatgacgtgtacagtacgatcaatttccttaccgagttcagcccgctggacttccaatattttccggaaatgtgccaattgctccggactcatatattcctcacctgctttgggttcataagggggaatggtgtttgattccaattgtttacccattcgtgacatgctccttctgataatacgctttataattgtagagttgaggaaaataaatctgtcatcaataccagaaagaatagggaatagcaagttttcatgtggaaatgttaacccggggcagtaatgtccccttttctggttttgaggagtagcgatggggggaagtgtattacgatgagttatcgcgaggtggatcggcttatggagttatccgggcgatagtagcgaggcaatgctcacagggtcaagcggctggtatgtcgatatcgggaagcaagaattctcccctcctggctctgtactttgctcctgccgagaccgcacaaggttaatatggcagtgctcaatgatccccttgaatttaatctctcgaacgggtgataaaaatatcatgcaaaagaggttggctggttatctggacgtagcggacagcctgttttttgcgttttcctttcagtttgagataaaagcgcttgctgaagctgatctcggtgtgatcaatctgtgcaatagcttcatgtaattcttcactaatcagtatagcgcccggacaacaacttttctcaagccgggcagcggtattcacaacatcaccaattgttgtccagtctagcctgcctgaagcaccgacattgccaatcacaacctttccccaatggatgccgatacgcaacagcagcagatccttgctggcacgcatccgcaggctattgaaatcatgggaatgtttgtgaatgtcgagtgcggccagtacggctttatatggttccttgaagagcgccatgacgcaatctcccatgaacttatcgataacgccttcatgctgtttgaccgcttttgtgattctgccaagtatcagattgagcgtatggataacggattcttctttttcattgttttccacgtaagtggtaaagccggcaatatcgcaaaacagaacggcaagctgacattcctcattagggagtgcattgccacccagccggacaatttctctggctttctgctcgactagctgaggcacataattacgggtaatgttatgcacacgagcttcgttgaggatagaaccttctgccagtgtgccagtggccttgtgatccagcgatacgatttgccacatcgtgtggattgtcatgtcatggtgacggtaaccactaatattgaaaagtatcgacaggctgtcatcatgaggcagtctgatgcgggttctgtagttctcgaacaaaccattctgtaattccaacgcaagcccccacaacacatcattataaaaatggctggggataatgcctgcaagggtatgtgctgaaacaggcgatacttccagtttcaggttgttgagaattgtgggtgatatagccaaaatatccccggcgctggagaaaacgataatgctgtagctcagcttactgaaaataacctggaccttatctgattcctccgcacgggtcagcaattgagagtgtcctgtctgcgactgatagaggtgatgttttgcaatatcccttactattctggcagcagaatatcctggcgaatatttatcatgagtctgttttgacaatacaaatccgattgctctggcaagcttgttatccagataggcgctatcgtcacagctgatcgggtattcaatctgtatcaaagtatctttttcttcagggaaagtcagcatgatctgaaaattgttctctttacagaattgctcgatattccgatcgccatgcatgaccagttcgttttgcaggagttcattaaatacgctattcctgctggcgatattaagaccgagatcaccttcaattgcctgctggaaagcatgacgatgcatggttttaaccagattcgtaaccagcttgtgtaatagcagtacggttgaatccagtaggcgcgggcaacacaaacgttccagtgagtgtgcaatttttcgttcaagctcctgccagatattttgctcaagcgaagtaatgatgatcgggtaactggatcgaatagcaattggcctggcttcacttgaatttgctgcaaaaggtgttttagctgtgatcatttgcacagaattgatagatttcatcattgatcaatttttgaaagaacgcctcgtcgagtaggtgatcggcatattcttcacttagcccgtaagctatcaatttctccttgcgaacatccagatcacagggattggcaccaataccggcacctttgatcagattattggcaatggccagccaaagcgggattttgttttcagtttgctcgggtatcagctgatcgagatcagtgccgacatatagttgaaactgcgatggaagtttccatgccctgaccgcttgctcaccaatctgataatgatccgttcccaggaatttctgctccgcctccctgcttgagcaatcgctctcaagtgcgtgggtgagggcatccatataatccttgcgtgcatgggtaaaaagcagaattttgccaatatcatgcaccaggccggcaacaaaagcttcttcacaatccgctgattcacctaattcagaacagatgttataacttgcaattgcaactaatagtgagtgctgccagatatgtgtacgtactaatgtatttttgtttttagagaataccgagcgtgaaaaggccagtatgactagggagcgaatgatgttgattcctaacagactgattgcgataggcagcgttctaatcggctgactgcggttataaataggcgaattggctactctgagaatgaacgatgcgaccacctgatcagagcgcaacaaacaatccatctccctgaaacagttcgaggattcttcatcaatttcgataatcctggagataatctccggttgcgtggattttattgttttgtagtcaataatgcatcgattcatagcttatggataccgagctcgcgataataaaagtttttatgttgttatgagttaaaacaacggcatttataaagcgggcttgataaacagctgaggaaatatatgaaatttgtctggatttagagtctgttcccgtttcacattggtaaccacaggaaggcacagaccatagcgattgctctcaaagggcaagcttgaaaagtagtcagctatttcatggcttatgtgttttcttcaatgaaaatttaatggtgtattgttcaaggttaggcgtgactgggtcattaccgggttgttgcgggacagcagattggtgcaaaaaagccccatccatatacaggatgaggcttttttgtgtggtgttctggcggagaaggcgggattcgaacccgcggtacggtattaccgtacacacgctttccaggcgtgcaccttcagccactcggtcacttctccttttgattttcttgcttggcgggccgtaaaggataaaccagattgatacagggagcaataagcggtgtgttttatttctttggagtgtttactaatgtttgcgatatgacgaaaatgatgtgttttcagccagcactgtaaaaaataaggaggtcaatttgaagaagatttttatatttgctttgggttttattatgacgactgccatggccgatggcgttgatcagcgccagattttacctttgaatgaaatgcagcgcaatcatctgctgggtgaaatgcgtatgctactaaccggtacaggtgccattttagaggcgcttgcgcaggatgacagggtggctgtcgcgcgtcatgctcgttcgcttggggtggaaatgccgcataaaatggaaggacatatggataaaatcctgcccgaacagtttatgctgatgggtatgagcatgcatcaggattttgacagaattgcacaggatgcagaatccgggaaggataccaaacatacgttgcagcaattgagcaaggcgttgggacggtgcaccgcatgtcatgctatctatcaaattggtactgtccagcaatccggcgagcagggtgcacaagatgttcatggaaaacatggggcacattcacatactcggtagattacagtttgcgcagacctgattatgaagtccgactactttttcggggagtgaagggagctgtggttccatctctacggctgaatggtcaaaatagcaattgctgccagaggtgatcgactctggctttgacggccgcatccatttcgatgacgcgaccccattcacgggatgtttcgcctggccatttgttagtggcatccagtcccattttgctgccgagcccggatacagggctggcaaaatcaagataatcaatcggagtgttctccacaatcagagtgtcgcgtaccggatcaactcgagtggttatcgcccagatgacttctttccagtcgcggatgttgatatcgtcatcggtcacgatgatgaacttggtgtacatgaactggcgcagaaaactccagataccgaacatgacacgcttggcgtggccgggatactgttttttcatactgactacggccagccggtaagaacagccttctggtggcaggtaaaaatcagtaatctcggtaaactgtttttgcaacaatggtacgaatacttcattgagggcgacgccaagaatggccggttcatccggtggtttgccagtgtaggtggagtggtaaatcggatcgcggcgcatggtgatccgttcaatagtaaacactggaaaggtttcctgctcgttgtaatagccggtgtggtcgccgtaaggcccctccaatgccgtttcattcgggtaaatatagccttccagcacaatttccgcgctggcggggacttgcagatcatgcgtcagacatttgacgatttcagtttttgcgccacgcaacaagccggcaaactggtattcgcttaaactatcgggaacgggggtcactgcaccgagaatagttgcaggatcagcacccagcgcaaccgcaacagggtagggttccccgggattgatctgacaaaaatcacggtaatccagcgcgccaccgcgatgtgccagccagcgcataattaccttgttgggagcaatgacctgttgtcgataaattcccagattttgtctggatttatgcgggccgcgtgtgactgtaagtccccaggtaatcagtggtgccacatcgcccggccagcaggtttgaatgggtagtttgctcagatcgacatcagcgccttcccacactatttcctggcagggagcgctggccaattcccggggaggcatgttgagcacctgctttaatatcggcagtttgtcccatgcatcgcgtagcccttttgggggttcgggttccttgaggtaagccagtagttttcccacttcacgcaaggcagaaacggatgtctgtcccatgcccagcgccactcgttccggggtgccaaacaggttacccaatactggaatagtatgcccagccggtcgttcaaacagcactgccggaccggcctgtttaagcaggcgatcacagatttccgtcatttccagatggggagaaacttcaatgtcaacacgtttcaattctccacgaagctcaagctgtgcgagaaaatcgcgtagatcgttatatttcataaaacagatccagtttttgtgaatgaattaaacagagtacgctggtgcagcgcagcattgagccagattcgtggtgagattggttgatcaactcaaatcagtgtatccagcaatatacccgcgaatatgactgctccaacccggttgttatgcaaaaatgcctggaaacaacgggcaggttcacggttgcggatcatggtgtattgaacgataaccaggcccaatgccaccagtaaggcgccataaaaccagataccgcgctgcagcaatattcccgcataagtcagaatactcaggaaggtaatgtggcacagcagaatacccgccacatcaaaccgtccaaacgtaatggcagaagttttgatgccaatttttagatcgtctgccagatctaccagtgcatattcggtgtcgtaagcaataacccagaacagattggccaataccagtagccacgcaagcggtggaacagttcccgtttgtgccgcaaatgccatgggaatgccaaagctgaacgctatgccgaggtacgcttgaggcatggcaaaaaagcgtttggtaaacggataggagatggcaaggagcagggcgggtacggatagcaggattgtcaggagattgagcggtagaattagtaaaaaggcgcacaaacttagcccagcagcaactagcagcgcttcgcgagagctgatgatgccagttgccagtgggcggttacgggttcgagaaacatgaggatcgatctttcgatcggcaaaatcattgatagcacaaccagcagagcgcatcaggatcgtgccgagcacaaagattaccagaatcattggatccggcataccatcggctgctagccacagcccccacaatgttggccacagcagtagcaggatgccaattggtttatccagccgggtcagcctggcgtatgcagaaaatcgttcactgaaagtcatattataaaagtcataaaaaccaggtcagtaaagtattccagcctgtttgagccggccgggatagagtattttatcgatttatagttggtggattgcaggcagaaatacttctgtaacgagtatcggctgccgcaataggataaataacgagcgccttgcccagagattgattgggcgcatctgcagttgtttgcaggcacgctcgaataatgggtggtgcggtttcagtttcttgaaggcaagaggagtgcgctgtattagcgggttggtaaacaacatagtgcccaatgatcgattacccaaacggcttaacccacgccatgctcctcgtaaatgttcttttttaacgatcgaatgggcaaatacaaccggcgtttcattacaacgcaggtaaacttcccgtaccaatacctgattttgtctgcgcagattcatgacttccagttcgtcgatgcatgccgttgccagtgtctgaaaaacaggttcaacacggaaatgctcacaatgtgcctgaagcaggcgagtgagggattcctggtgcatcagccaccagcggagattaacaggagcggaaacagggacaggatgccacgccagaggcgggttggccttcattacgacaagagtatggaaaacggggaaaccagttgtagcataagtctataaaaatcagaatccaggatcaggctggtactctattttttgatgtatgtttccggactgtgtcgagcagtgcttctttagtaaacggcttggtaaggtattcgtcagagccgaccattctgccgcgcgccctgtcgaataatccacttttgctggatagcatgataaccggcacggattgatatctggggtttttcttgatcagcatgcaagcctggtaaccatccagtcgtggcataacaatatccagaaagatgatatctggttgataatcaataaccttggccattgcatcaaatccatctgtagccaggattacttcgcaacctgaatgcgcaagaaaaatttcagcgctccgacgaatggtgttgctgtcatcaaccaccatcactttgatacctgctagatcattttccatttcagtcacaatttctccctgttttcaaggtctctcgcaaggtctctcgcaaggttttcattttgtatgccagagctcgttcttgtccgactttccttttaactacaggcttatttttccttattataataacgtattatcggttgcttcaattcggtctgaatattctgtcagccttatttccgccagaaggcgggggtgaaaacaatcatcagcgtataaaattccaatctgcccagaaacatggcaaaactgcacagccagatttgaaaatcattcaatgaagcatagttcatagatggcccgattttccccaaccctgctcctagattattcagacaggcaacagcggccgagaaagcagtaatttcgtctaggccgctcagtgtaagtgccagtgtcatcagcacgatgctggtcagatagacgaataaaaatgccaggatggcaaaaataatttcattggcgacgatgtttttaccaattttaaccagagaaactgcgcgtggatgcataatgatgatcatttcacgaaagaactgctgaaacaggatgcgcgcacggatcattttgataccaccgccagtcgagcctgaggatgtgcagaagccggatagaaatagcatccagagcggagcgaaaattggccagagggcataatcagtgttgctgtaaccagtggttgtggcaacggagaccacgttgaaagcagcataacgtagagcaaccaggggatccgtgtaaatacctttggtccagagaaaaccggttatgccgatgcagctgcttagcgtgatcaagatatacagttttgcttccgggtcagcgcggtaagcggaaaaatttctggcacgccaggcgacaaagtgtgctgagaaattgatgccggcaatcagcatgaacagtattgcaatggcttcgatcaatggggaatcccagtatccgtaactggcatcatgggtagaaaatccccctaggcctagtgtgctcagagcatgagcaatggcatcgaaaggggtcatgccagccagccagtaggcaattgtgcaggcaatagtcaaagcagcgtagatcagccataagcgcttggctgtttccgcgattctgggtgtcagtcgggattccttgattggcccgggaatttctgcactaaaaagcttccttcccccgacaccgagcataggcagaatcgctactgccagtacgattagtcccatcccgcctatccaagccatgagacagcgccaaaggttaatggcgtatggaaattcatcaagccccatcaatactgttgcgccggttgaagtcaggccggaagcagcttcaaaatatgacttggcaacgccgagttctggaaagtaaaagaacaagggaagcattccgaacacaggtagcgacagccagaccagtacaaccagcagaaatccgtcccgaatctgtagctcacgtttaaactggtatgtcagcagccatattgttacgccacatcccagcgtgatgaataaagtttcgagaaagacaggcaatgatccatctttcatccagtaggcaacgccacagggaatcagcaggaccagcccgaacattagtattaccctgctcaggatattggctaccgcaaggaagtgattcacaggaaatgtttcatagtatgtgattacaaaaaaccaacattgacctgaaacaatttctcaacctgtcgtaccatttttttattgacgacaaatagaatgacgtgatcgtcctgctcgatcaccgtatcatgatgtgtgatgatcaccgtagcctgattccattgatcagaaacgctattttcttctatttcagataatttttggtgataaacatccctaggtggtaggccgcgtacgatggcgccaatggtggttcctctgggtagtttgatctcttcgattttgcggccaactatccgagaagaattagcatcgccgtgagctaccagctccagagcttctgctgcaccgcgccgcagactatgcaccaccgctacatccccctggcgaacgtaagccagcagtgaaccgatcgtgacctgtgcgggtgaaatggcaatatcgattccgctaccttgcatcaaatccacataaatactgcggttgatcagtgcaattaccttgcgtgctccttttcgtttggccatcagggcagccatgatattgttttcctcgctatcggtcagcgcgcagaaaatatccatttcgctgatattttcactttccaataattcttcgtcggtaacatcgccgtgcagaatcagtacgttatgcagactttgagttagtgattcacatactttgatatcccgttcgataatccgtacctgatgggactgttgcaatacttcggccaggcgtcggccgattctgccaccaccagcgatcatcactcgtctgacaggtttatccatgcggcgcaattcattcatgacagcccgaatatcacgagaagaggcgatgaaaaatacttcatccccttcttcgacgatggtgctgccctcggggataatcgagtggttgtggcgaaaaattgctgcgacgcgagtttccagatttgggacatgctggcgtagttctttcagatgacgcccaatcagcggccctccgcgaacagcctttaccgcgaccaggctgactttgccagaggcaaaatccagtacttgtaatgcgcccgggaattcgatcagtttctctatgtattgggtcaggattcgttccggacaaattgcaaaatcgacacaaaaattttccttcgagaatatatccgggtgatccagataatcggtggtccggatgcgggctatccgggtgggtgtattaaacaggctggcggccagcttgcatgcaaccaggttggtttcatcactgccggtaagtgccaacatcatgtcggcgtcttccatgcctgcctggatcatgacgttagggtgagaggcgctgccgatgaccgtgcgtaaatctagtcgctcctgcagcggcgtgagactgcttcttgcctgatcgacgacggttatatcattagattcgctgaccagactttcagctacggttgatccgactcgacctgctcctagaataacgattttcactagagatgcctgctttcacaagtcgataacatttgatactgcctgtatttcggctcatggtggatcatggagcggaagattgcatggttagttggtaagtaaaaactgcgtcatgttatatcatccccaccccaaatccaagaaagggaagagccggggttatgcacggtataaatatagagacgctgtgtcttatctttttcagcagatatatgatctggctggtgtaatttttttgtttgtattgaaaaagggattgccgaaattcagtaatgcaaccatttcagggacgcaacacgccgctcgatttcatccatgattttgtgatatctgggatcgttgatggctccaaagcgggctttaaaagtactttcagacatgtgttcaggcaagtcggaccactggggaatgagatcatcatcacgaattccggacaggattatattgcgcattctgcgtgcagaatcctgactggccatggctttttcagcaaagcgcgtaccagagcgatctgcaatgaggtcgttaaaagagaatccactaccggaacgtgcgtcttccagctccttgtataaaccaattgcattggacagtatcgtgtccgaataggcggtaatgacagcagaagccatgaagtgcatggcaagatcactgcgcccgtccagcgtgatattgattttgaccggattcggccaattggcagcttccggaataatcaacttgagcgggacatgtataacatggaatgctgttaccagtattgcagcccgaaattcctccagcacgttttcatgtggtgtatggcggatggtttctcgcatgatgagtgccagtatttcagataatgggatcggttgtgaaacctgtcggcggctcttttcgttgagaaaaaggtgatagcgcagtaatctgtccagtgcttgttgatcaaaaaaagggagattgattaatgaatggctggtattgttaataccccatcccttccagtaataggtgatggttacctcgttgcgggaaaactgcagttttctgaaggcgtctactccggcgcgtatgtcggggttggtgatttgcagccatgtcagaaatttttcaaacagcaagttggcaaatacgcccgggacatacagatttccaatcttgatcgagctgaattcaggaaggccgtttgtttcagtcaacgtggcccgtaggtttaaataaccatccattatttccgacgggattggcaggcttaattgaacctgtgcagttttgtcatgcaccgtgatttgtgcataccctcgtccgagatggtaagccaaatagttcagtgcattatcgatatcatccggcagaattctaattgtagcggatgtgccgggaagtacctggtagcgatgggtatcaagaatacttttcgcacgtgcaatttgttctggtgtgatagagatttctctcgctatcttcggtcgggtatcgacagccagataagtggctcccgcgagaatggtaataagaaccagcaaactgatccctgtcagattgagtaatttccgcatacagatcaatgtggttttatatcagatcgaatacaatccggctaccatctggcgattggtctttgtcactcccggtctgatatggcttatattgatgctcaccgagatgaatggagcaagaatagcgtggcattaccaccataatctgtagggtctgtaatagccgttgtagaaagagggatacccgtaatagccgggataaggtccgtaacggtatctgctgttccagtacatattatcttcccgataagcctgcgaccagagatggatggccttggctgtaatgagcgggatatgtatggttttgtttccaactgtgcgctcaatactcccctttactgatccggtgatagtcacttccgctcctttgacaaaaattgccgggtccaggaattcactggtttcgacagcaaaacgcccttctccgagtttgttggtttgtgggtatgcgttacgatcaagtggataaaaaagtacctgcatcaggctggaatcagcttcattttccacttcaataactgtgcctccccagcggatcggagcattcttataggtatcaatgctttgattgatcagttgataggagatatctgtggccgcaaaatttctgatatccggcggcatgctggtgcatgcacctaggaagagcaggctgcaaagcaggaggcgaaacgggatcgagggtttcatatttttcttggctgatgagtaatagactttgagttagacaaaccctctgtagcaagattcgtgcggctatctttccgcattacattgttttgttcagactgtaagtaatttgttggatatctgatcaaaccagtttattccgtttgattgaaaggtataataatgctttttatatccggccccgggttgtcttgcataattccatttttcacatgtctttgcatcatagccggttttgtacgaggctgaggaattgctaatatgaatcagtcttctatcttagatttcaggagcggcacttcttttgcgccaatcctggttctctacagcaatgacatggaaatgatcagcaagcgattgcaggagaaaattgcgagcgctcccggttttttcagaaattctcctgtgttgtttgatttaagcgagctgaatgaaaatgacatggaaattgatgtcgcagcgcttatatcacgccttcgccaattgagtctgtttcctgtcgggatcaggggtggagatccgctgcaggaaaagcaggcattggcgttggctgttccggttgactctggccgtagccgtagtaaccccgttttgcctgaagtacaaaaaaaggacgatgccgttcctgaatttcaggctgtaatcagggatgcagttcatgctccagcgatgatgattactcagccggtacgttcaggtcagcgtgtctacgctgccagtgatctggtgattctggcacaagtcagcgccggtgcggaaattatggccgaaggcaatatccatatttacaacacattaagagggcgtgctttagctggtgtgcagggagatattgaggcaagacttttttgcctggatctgcaggcggagctggtctcgattgcggggatttataagactatcgaagatttgaaggagatttccaggaagaagccggtacaggtttatttacgggaccaagcattgatcatccaagaattaagctaaaaatatttctgagaaggagattcaattggcaagaattattgttgtaacatctgggaagggaggggttggaaaaaccacaaccagtgctgctattgccatggggctggcaaaaagagggcataaaactgctgtcattgattttgatgttggtctgcgtaacctggatttaattatggggtgcgaacgccgcgtagtatacgactttgtcaatgtcattaatggtgaggcaaatcttaatcaggcattaatccgggacaaaaattgcaatcagctttatattcttcctgcatcacagacacgtgataaagatgcgctgaatctggaaggggtgggcagggtgctggaagagctctccaaagattttaaatatattgtttgtgattcacctgcaggtatcgaaaaaggtgcctatctagctatgtattatgcggatgatgcgtttgtcgtgaccaatccagaagtttcatccgtaagggactcagatcgcatgctgggaatactggcgagtaaatcgcgccgagctgagttgaacatggagccaatcaaggaatacctgctgctgtcacgttatgattcggacagggttgaatcgggcgaaatgctgagtctggaagatgtgcaggagattttgtcattgcacttgcttggtgttattccagagtccaagtcagtattgaatgcatcaaactcgggaatccctgtgattttggacgaaaaaagcgatgccggccaggcttatgcagatgtggttgcgcgttatcttggtgaaaaaaagccccttcgttttatcgatagtaagaaagggtttttcagaaagctgtttggaggtaaataatgagcttactggattattttaaatcatctaaatctaaaacggcttcggttgctaaggaaaggttgcagatccttgttgctcatgagcgttattatcgcaataagccatcctatcttccgcagttgcaggaagaactgatgcaggttatccggaaatatgtacaggtggatcaggatgctatatctgtaaaatttgaacaggatgacaatcaggaaacgctggagctgaatattactctaccggatacgcaaaatccccggaatactcaacaagatatgatccggaatgcgctttagatgactgaaattcgtcaggaattttttgcagggggctggctgccagatctcttgagatgatttgcgttgtgcttttctgctttcccggtttgaatgccagtagagctggatgtgggaagtggattctgggtgtgattctgattttagccggatgtgccgggcctgaaattcaccgtgctgaggtaataacggttgttattcagcctgtgcatgaacagattgatacttcaggaaagccctttgtacttaccggcaggctggtagtgaatgccaagcagcagaaattttcaggtgggatacgctggcgacataccaggcagcgcgatgagatttatttgttttctcctcttggacaagttgttgcagaaattctccaggatcagacgggggttcgcctgacaacttccgagccagcaatttatcaggcgcaaagtgcggaatatcttaccaaccaggtattgggctgggagcttcctcttgctggtttgcaattttgggtacgcggagaacattatccggacaccattgctgaaaaggatctgaataggaataatcgcactgtagcaattcggcaggatggatggaatattgcctaccagagttactacccggaacaaccaactgttccggctttgcccaggttattggaattcagtagaatggatgtaaagatgaagctgattgttgatcaatgggaaaaagaggcaaagggcgttactggagtggacaggaagctgccgtaacggtttttaattctcatatagggtatgaacacgtttccagcgccggctaaacttaacctgtttttgcatgtaatcggacggcgagatgacggttaccatttgctgcagacagttttccgttttatcggctattcagatcaactgggctttgatgttaccaatgatggcgttatcagacacctgaatctagttcctggcctgacagatatggatgatctatgtgttcgggcggcaaaactactgcagaagagatccggtaaagaaatgctcggagttggaattcatctgagcaagaatattccacttggaggaggattgggtgggggaagctctgacgctgctacaacattaatcgttctgaacagattgtggggaattaactgggggcgagaacgtttgatggcactggggctggaactgggcgctgatgttccgatatttatctatggcaggaacgcatttgctgaaggagttggtgaaaaactggaggtgattaacttgccacccgcatggtatgtcgttctgacgccacctgctccgatttccacggcggcagtttttgccagcagggagttgacacgaaacacgattcccatcaaaatggcggccttttccatggcgcagggacataatgatcttgagcttgtcgcgatgcgtttgcagcctgttatcgccgaatggctggattggttaaaagggcggcatggatcaacaaaagtggcaatgagcggttccggatcatgtgtgtttgcagagtttccttccgaatctgctgcgcgagaggtactcagacaattgcctgatagcatgagtggttttatcgcaccagggcttgcaagacatcctttgtcggatttttagaatgtttttggggagtcgccaagtggtaaggcaccggattttgattccggcattcgtaggttcgatccctacctccccagccaaatctcagtgaatctgccattattatgtcaaatgtggcgcaaatggccgaatctgtctgtgtcatcttttaaaccagaagtaaaagttacctatgtcctatgacagcctgatggtttttaccggaacggccaatcctaagctggcgcatgatgtggtcaaatacctgaatatcaatttagggcgtgcgaccgtagggcgcttcagtgatggcgaagttatggtggagatacttgaaaacgtcagaggtaacgatgtttttgtattgcaatctacctgtgcaccaaccaacgacagtttgatggaaattctggtgattgttgatgcactaaaacgcgcatcagctagccgcgttactgcagcgattccctattttggctatgcgcgacaggacaggagagctcgttctgcacgagtgcctattacagctaaagttgtggcaaatatgttgaccagcgttggtgttgatagagtattgactatggacttgcattctgatcagattcagggtttttttgatattcctgtggataatatttatggcactcctacactgttgggagacatctggaagcatgattatcagaacctgatcgtggtatctcctgatgtgggtggcgttgtcagagctcgtcatatggccaggcgtttggagtgtgatctggctattatcgacaagcgacgccccaaaccaaatgaatccaaggtcatgaacattatcggcgacgtcaaagagcgtacctgtgtaattattgacgatatggtggatacagcaaatacattatgtgaagcagcttcggcacttaaacaggaaggtgcggccagcgtgattgcttattcaacccatgcagttttgtcaggcaaggcggtagagcgtgtacagaattctgatctggataagctggtggtaacagatacaatccctttaagagaagatgccagcaaatgtaaccgtatacagcagttaagtgtggccagtttgctgggtgaatccatgcttagggtaagtaatgaaagttcactgagttcgttgtttatagaataagataattttaaggtctgttcacggatgtgatgggctgttttcaggagaatagaatgccaattgagataagcgctaacagtcgtaatttacatggaaccggtgccaatcgccgcctgcgtatccagggcagattaccgggtgtcatctacggaggaggcggtaccgcgcaaccgatagatcttgatcacaaagatctgtactacaaactaaaaacagatgtttttcatgcatcgatactttcgattaacgtggatggaaaaaaggaacaggtacttttacgtgatgtgcaaatgcacccgttcaagcagcaagtactgcacattgattttcagcggatcagacaggatcagaaaatacatgtaaaagtaccgctgcatttcatcaatgctgacattgcacccggggtcaaattgtcaggcgggatgatcagccatgtagcgactgaaattgaaatatcctgcttgccaaaagatttacctgagtctattacagtggatctatcggaaatgacagccggtagcatactacacacgagcgatttgaagttgccggaaaatgttgaaataccagctctgttgaggggtgacaatcagccggtttccactcttattatgccgcgtggtggggaagttgcagatgagtccggcgaagaatctgcctgattttgtctgatgtacgccagagaatttctctggcgtaattcttgctattctgaaattcacttcactttttgttgagtcatctgttgtcgggactgtactgagttatggaactacccataaggttggtggtcggccttggcaatcctggcgataaatatacctcaacccgccataatatcggttttgattggctggatcgtttggctgatgcgcagcgagtttcttttgcgctggatatccgtttcaggggattgtgtgcacgcattgttcaatccgatacagatatctggttgctcaagccgcaaacctacatgaatgccagcggtatgtcggtgggggccatgtgtcgttactacaagataacacccgagcagatactggtcgtccacgatgagctggatttgcaacccggtattatcaagctgaaatccggtggtgggaccggggggcacaatggccttaaaagtatcgttgctgatctttccactcaggttttctggcgcttgcggattggcgtggggcatccgggggacagaaatcaggtagtggattatgtgctacacctcccgcgcagagaagaagcggcgctgattgatgaggcaatagaccacagcatacaagtgtggccactaatcgcccgaggaaattttgcagcagccatgcagcaattgcatacccggcaggaaaactgacaaaacaagcagcgtactctacgcaacattcaggaaattgatggaaaccggattatgagcttgaaatgtggaatcgtcggtttgcccaatgtcggcaaatctaccttgtttaatgcactgaccaaagcgggcattgctgcggaaaattacccgttttgcactattgaacccaacgttggcatagttgaggttcccgactcacgcctcgccgagctgagtaaaatcgttaatccgcagcgtgtgcagcctgctatcgtggaatttgttgatattgccgggctggttgcaggcgcttccaggggagaaggactgggcaaccagtttcttgccaacatccgtgaaacagatgctattgttaatgttgtgcgctgttttgatgatccgaacgtcgtgcatgttacggggaaagttgatccgcttgccgatattgaaattatcctgaccgaactggcgttggccgatctcgccaccgtggaaaaagccattgtgcgtgatagtaaaaaaatgaaatccggcgataaggaagcgagcaaactggttgcagtgcttgaaaaattggtgctacaccttaaccagggtcagccagcgcgcacttttccgctttcagacgaggaaagagaaatcatcaagtcattatgtttgctgacaatcaagccggccatgtatgtaggcaacgtgctggaagatggtttcgaaaacaacccacatcttgatcgattacgtgaatacgcagcaaaagaaaatgcaccagtcgtagcgctgtgcgccaagatcgaagccgagctggccgatctcgacgaagcagataaaaaggaatttttagcggatttggggctggaagagcccggcctcaatcgcctgattcgtactggttacgatctgcttggcctacaaacgtattttaccgctggcgtgaaggaggtgcgtgcctggaccatacacaggggagataccgctccgcaggcagcaggagccatccataccgactttgaaaaaggcttcatacgtgcgcaaactgtttcctatgccgattttattgcttgtggcggcgaagctggcgcgaaggaaaaaggtaaaatgcgtgtagaaggtaaagattacatcgtacaggatggtgatgtgatgcattttctgtttaatgtctagcgggctggtgaggtgtatttcttcatccgctagtttgtgcttgtaccttatatgtgtcaggaaatcgcattattctcactagcggcaatctcgcccgatacaagtagagcggtagttggtggtgttttgcgcaacatgtggaataacttcatttcctgtcagtacccgataaattcggcgataccataattcttttctgtcccacactgcattatctatcgacgctccaatgagctgatgaaacagtaggtcgtattggatttacttcatcagccgttgctttgcgcaactgtatgagcatggccaaatagtccggccacccctatcctgattctgtatttagcgaactgatttgcgcttgatagattctaaaagacttccttatctttctgaaagatatattgaaaaaaatttactgctgggagatttttcatttgcccggtaatttgttaattagacaggctttatgggataattacgcctgtaaaaacaggtaatcatattgaaaatgaaaacgttatacgacaagctttgggatagtcatgtagttcatgctgaatcggatgatccaaatggcatggtgatactctacattgatcgccacttggtgcacgaagtaaccagccctcaggcttttgaaaatttgaagctatcgggacgcaggccgtggcgtactgattctatcctggcggtggcggatcacaatgtccctacaactgaccggagtagtggtatcagtgacccgatatctcgtttacaggtcgaaacactaagtcaaaattgtgaggaatttgcaattaccgagttcaagatggatgatgaacgtcagggaattgtacatgtgatcgggccggaacagggcgcaacactacccggcatgactgttgtctgtggggattctcataccagtactcatggggcgtttgcgtgtttagcgttcggcattggcacatctgaggttgagcatgttttagcgacacaatgtctggttgcccgaaaatctaaaacaatgttggtcaaagttgaaggaaatcttggtcagggtgtaacagctaaggatattgcattggctattatcggtgaaataggaacagcgggtggtacaggacacgctatcgagtttgctggtaatgcgattcgatccctatccatggagggccggatgacactttgcaatatggcgatcgaggcaggcgcacgtgcggggatgattggagtggatgacgtcacgatcaattatattaagggaagaccttttgcgccccggaaagatttatgggatcgggcggttacgtattggcgtacattgaaaagtgatgaggatgctgtttttgatcatattgtggaattaaaggcagagaacatcaagcctcaggtaacctggggaacttcaccggaaatggtaaccacgattgatggatatgtgccagaccctgcagatatcagtgatccgatcaagcgtcataatattgaacatgcgcttgaatatatgggacttaagccaggaacgcccatacaggacatagcactggataaaatatttattggttcttgcaccaattcccgtatagaagatttgcgtgcagcagcagaaattgtcaaaggaaaacggattgcccctaatattaagttggctatggtggttcctggttctggtctggtcaaatcgatggctgaaacagaggggctggatagaatttttcaagcggcaggatttgaatggcgtgaacctggatgttcaatgtgcctggcgatgaatgatgacaaattattgcctggagagcgctgtgcttcgacttccaatcgaaattttgaagggcggcaaggccctggcggccgaacgcacctggttagcccatctatggctgctgcggctgccatatctggtcattttgttgatgtacgctcttttgcccattaaacagagtttattatttatataggagattggtgatgaaaacactgttcgcattatctttgctgctgataattactgcgcagctgactgcctgtaatacgatgcaaggacttggtaaggatgttcagcgtggtggcgaagccattgaaaaaactgctaaataaatggaatgaaaaaatttgaacagcttcgggggatagttgcaccgctggatcgtgcaaatattgatacagacgcgatcattcccaagcaatttctgaaatcaatcaagcgttcaggttttggccagaacctgttcgatgaatggcgttatcttgattatggtgaaccgggaaaagatgctgcatcgcgtcaacttaatccggatttcatacttaaccaatcacgctatcaaggggctaaaattcttgttacacgcgataactttggctgtggatccagcagagaacacgctccctgggctttgcaggattacggcttcgctgtaattattgcgccgagttttgctgatattttttacaataactgcttcaagattggtctgttgccaattgtactggagtcacctattgttgacagattgatcagggatgctctgacagtggatggttatcaactggaaattaatctggaagcacaaaccgtgatggctctatccggtgagacttactggtttgaagttgatcatttccgtaaacattgcttacttaacgggttggatgagattggcttaactctgcagcatgccgacagaatcagaaaatttgagataaatcgaagaaatgagcagccctggctatttttgtaacaagaaatgaaggcggttgagtgtatgaaaattgcattattggcaggggatggtattggccctgaaattgtggcacaagccgagcgcgtgctgctttattttaaacaagaaggattaaaaatcgagctggagcccggtttactgggtggttgtgcagtagatgcaataggagagccttttccggaggcaacacgtaaactgtctgttgaagccgatgctatattgcttggggcagtgggtggaattcaatacgacaatttgcctcgcgaaaaacggccagagcaagggctgctggctattcgtaagacacttggcctgttcgccaatctgcgaccgatagtactctatcccgagctggtaaatgcatcgactctgaaaccggagattgtgaccgggttagatattttgattgtacgtgaattaaccggtgatatttacttcggaaaaccgcgaggtatcgaatacagagatgggcagaaagtgggctttaatacaatgatttattctgaatcagaaatcaggcgtattgctcatgttgcatttcaggcagcacgcaggcgaagtggcagattatgctcggtagataaaatgaatgttctggaatgtacgcaattatggcgtgatgtggtaacagaaactgcacaatcatatccggatgttacgctttcgcatatgctggtggataatgcagcaatgcaactggtgcgtaatcctaaacaatttgatgtaatcgttacgggtaatatgtttggcgatattttgtcagatgaagcatccatgctgacaggttcaatcggaatgcttccatcagcctctctggatgaccgaaacaaaggtctgtatgaacctattcatggatccgcgccggatatagccggtaaaaatattgctaatccgcttgcgactattttgtccgcagcaatgatgctgcgctattcttttaatgaagagacagctgcatcacgaattgaaagggcggttcagaaaacactagaacaaagttatcgtactgaggatatttatgaaacaggcttaaggagaacaggcaccgtggaaatgggggatatggtcctggcaaatttgcaggcccagtgatttttcattttcgtttatgagcctgcctgttttgcatttcctctggtttttggataatacgccggatagcaagctgtcgagtacagcgcaatattaaaactattttttgtaaaaggctaagtgaattacatgaaacgggttgggtttgtcgggtggcggggtatggtgggttccgtgcttatgcaacggatgcgcgaggaagatgatttctcattaattgaacctatatttttttcaacttcccaggcgggtggggaaggtccggatattggtgggaatacagggcctctcaaagatgcttatgatattgctgcgctgcaggaaatggacattataatttcctgtcaagggggggattataccaacaatgtctttaagaaacttcgtgactcaggctggcggggttactggattgatgctgcttctgctctcaggatggatgatgatgccgttattattcttgatcctgtcaatcgttcggttatcgatgaagcgctaaacaaaggtgttaaaaactatattggtggtaattgtacggtcagcctgatgttaatggctgtgggtggcttgtttgatcaggacatggttgagtgggcgagcattatgacctatcaggcagcatcgggtgccggtgctcaaaatatgcgcgagctgttgcagcagatgggagaaacccacaatgttgcaaaagatttactggatgatcctacttccagtattttggatattgatcgtaaagttgttgaaaaaatgcgtaatgaagaatttcccgctcagaattttggtgttccgttggcaggcagtcttattccctggattgatcgcgaggtggcatacggacaaagtcgggaagaatggaaagggcaggctgaaaccaataaaattctcgggcatgctgatcacccggtgccagtcgatggaatttgtgtacgcgttggagccatgcgctgccatagtcaggcgctaacgatcaaactgaaaaaggacattcctctggaaagaattaaggaagtaattgctggatccaatgaatgggtgcgagtcatcccaaatgaaagggaggctactaccaaagaacttaccccagtggcggtaaccggaaaattggatatacatgtcggacgcatacgcaaattgaatatggggaatgaatatctttctgtttttactgtaggagatcagttattatggggcgccgcagaaccactgcgccggatgttgcgtattctgatcgaagaagacaaggctgcatagaatactaagaatttcatatttttctcaatctcggaccgtcttgctatagacaagatgaccttcgctttctgatatcgattgccatccatattttgtatcagagagttcgggtaacaatgaaggatatttgtgtgaagataattgatttcagagcaaaaggtatttctccaggcgttttatccaaagtgtttttgattggtatacttacatctgcctggatggtgcaggctgccggcttgggtaagttgaccgtaagctcatattttgggcaacctctcaatgcagaaatagctctggaatctgtaacagataaagagatcgattcgctatcagcccgacttgcttcgcccaagatttttcagaaaactggtgtcaatctagccccctatcatgcaacgttgtctgtatctgttgaaaagcgagccgatgggcacccctatatccgtataagctcatcacaggcaatcaacgagccgttcctcaatttgctcattgagcttagctcttcatcggggtatctgttacgtgaatataatgttctgcttgaccccgctgaaacacaaaaggcagcatccgctgagccggttgtgcaatccgataaagataagacaggaagtgttgccgcaacaactgtacccggaaagactcaattatccgttgagactactctccctcctgctcagacgggtggtatatatggcccggttattcgaggagataccctgagtagaattgcgcgacaagtatcgcctgacagcgttaatcttaaccaagtgctggttgcgttgtaccgtgccaatcgtgatgctttcctcgaaagaaacatgaatttgcttaaagtgggtgtcattctgcgtattcctgatgaaagcgagatctcgtctgttaccactaaagaagcttctcgtgaaattgctgtacagaaagaaagctggaacgattatcgacagaaaattgcagacctggctgataatttttctgaaaaatctgatctaaaacaatctcaaacagggaaaattacaactgtttccggagaatcttctgttatcggatccaataaatccgaggaagttttgattctctcaaaaggagagttacttagcgataaccatccgcttgctaaaaaggcagaagacagaactgcccagaattatttgtacatgatggaagaggatgcaattgcgaaagagcgcgccttgcaggaagcaaatgagcgagtggctattttggagcagaatgttgcgaaattgcagcgtctacttgaattgaaaggctcgactcttgagagcaaagccggaattgaactggagcatacgcagcatatacctgacctgcaggcaatttcaactccggccaaacaggctgatattgcagtcgttggggactcagctgaaactcttggttctgttgcaggagcttcagaaaattcaacttctccgattactattccggctcaatcagtcaagccggcttcattatctaagccacttcaacctgtcagtcctgaatctggtgaatcagatttaatggatacattgttgcaacatgtagataaaaacagcaaatgggctgccgcaggattgggggtattgctggtgattgcgttgggcgcatctttaattctccgaaaaagaaagcaattcggggacccggattgctctgacatatatgattatgccgagaaggacgataaatcgatgtcttcggggatggccaagatcacatctgttgatgaacatatagaaaaaccggacgaagaattgattcagcgtacggtcagtacatcagaatcgggtgatttcaatttgactgatactgctggcaatcaggccgatgtcgatcttgatttgttcttcggtggtaaacaggatgaaaaagcaaccaaacctcttttcttcactgcggattctgtcagtcagacttatgcggaaaatgaaacaacgctcgatgaatcgaatgagctggataatgagattaaaaccagcacgatagaacctgatccggctgaatgccagaagggggctcttattggtgccgaagaagatgttgaacgtaaagaagacgagacaagtaagcaatggatttttacatcttacgacgatgccctggaagaaaaatctgatcttgtgcaggcacaagatcatagtgaagtgcgtgcatcatcccatgatgcggaacatcaaattgattttgatctgaaattatctgaagaaaaggaatccaccaaagattctcagatgatggatgagttgccggaattaaattccaggctggcaaatattgatcttgatcttggagatgagcctggtgagaagccgcaagccgtcaatgaaagctctgaagttggtacagatatgcaatggcgggaagtcgcaaccaagcttgatctggccagagcctatctcgaaatggatgataacgaaggtgccagagatattctggaagaagtgttgcgtgagggtgatcacgaacaacaatctgccgcccgtttgatgctggacaaaatcagctgaagccagatacggatatagcctaccggaagctatcctgattgagtgctttcttgtattcccatatttgttgtgaaattattcatgaaggataaagtattcctttatgaagatctgtgaagatcgtcctgattctggaatatgatggccgtggctattgtggctggcaaaagcaacctgatcgcatttctgttcaatcccggctggaaagcgctttatcgcgcatagcaagcagtcagatacaagttgttgcggcaggacgaacagatgcaggtgtgcatgcattgtgtcaggtcgtacattttgaaacgcatgtcatccgccctttaacagcttgggtaagaggagctaatgcactactgccggatgatatttcagtattgtgggcttcggaagttaatgatgattttcatgcccgattcagcgcaaccgaacgtacttatctgtattatctgttgagtcggcctgcccgccctggaattttccagggaaaaacaggatggacccactattcgcttgatctcgaaaaaatgcagacggcagcaagattcctgattggtgagcatgatttcagtgcatttcgctcagcagaatgtcaggcaaaaaatgcgatacgaaagcttgtcaggctggatattagtcaaagtgaacaattttttgtttttgaattttgtgctaatgcgttcctgcatcatatggttcgaaatattcttggggcattgatttatattggccagggaaagtatccccctgaatggatacagatacttctggggaagcgtgaccgcacacttgctgcaccaacattttcaccggatggattgtatctggctggcgttcgatacgatgccagatggaatttgcctacttttaacgtaatccggccagagaatgttataaatatgattgcaagctttaaatattcacagaattgggctggtttgcgttaaaaggagatctggtgcgtattcgtgtaaaaatatgcggcattacccggttagaagatgcaatgacggctgtacaccatggggtggatgctatcggctttattttatggcctcagagtgaacgatatatttcaccagaggaagctggtcagattgtgagatacctgcctccatttgtgcaggctgtaggggtatttgtaaaccctgataaatcctgggtagaagtggccagtgcagcagctggacttgatcttttgcagtttcatggtgatgaatcgccggatttctgcagtcagtttcatttgccgtatatcaaggctgttcgtgtccgggacggattggatttgttacaatacgcgcagtgttatgaaggatccaaaggactgctactagatgcttatgctgagggaaaacccggtggaacaggtcacatattcgactggaagctgattccctcggggttgtcgttaccctggatactctcagggggtcttcattcagacaatgttgtcgatgcaattgaacagactcgtccattggcaattgacgtttcaagcggggttgaaattgctaatggcataaaagacgcagacaaaatttctgttttcatgcaaggagtaagatcttgtgaaaatgtatgatcttcccgataaacgtggccattttggtccgtacggtggtacgttcgtggctgaaaccctgatttcagccttggatgagctttgtaagcaatatgagtattatcgtggtgatgccgaatttcaaacggaattctttcgtgagcttaaacattatgttggccgccccagtcccatttatcatgccagacgttggtcggatcatctgggtggtgcacagattctactgaagcgtgaagatcttaaccatacaggtgcacataaaattaacaatacggttggccaggcgttgcttgcaaggcgtatggggaaaagtcgtatcatcgctgaaacgggtgccggtcagcatggagtagccagtgccactgtggccgcccgctatggtatggaatgtgtcgtgtacatgggttccgaggatgtcaagcgacaggcaaccaatgtttatcgtatgaagttgcttggggccacagtcataccggttgattcaggttcgcgcacacttaaagatgcattgaatgaagccatgcgtgactgggtgaccaatgttggtaacacctactatattattggtactgttgcgggaccgcatccttatccgatgatggtcagggattttcaggcggtaatcgggaatgaagccaggcaacagatgcaggaagaatatggtagacaaccagatgctctgattgcatgtgtaggcggcggttcaaatgccattggcctgttttatccttatattggggaagaaaacgttcgaatgattggtgtagaagccgcgggcaagggaatcgatacgcagaaacatgctgccaccctggtaacgggcaggccgggtgttttacatggtaatcgtacctatctgattcaggatgaaaatggccagatcatcgaaacacattcaatttctgctggcctggattacccgggagtaggaccggagcatgcatggcttaaggactgcggtcgtgccgaatatgtcgctataacagatggtgaggctttggctgcatttcatgctttatgtcgcttcgaagggatcatgccggctttggaatccagccacgctctggcttatgcagccaaacttgcgccaacactgagaaaagatcagctcctcctggtgaacctgtcaggtcgcggggacaaggatatggcaacagtggcacagcaatcaggtatttcgctttaaccgaatgtctgatagatctcattatattttgatttttcggattatctgttaaatgaatcgtattgaatctgttttttcccggctcaagtcacaagataaagctgcacttattccttttatcacggcaggtgaccctgactcagccacaacagtggcgctgatgcaccagctgacacgatccggggttgatttgattgagcttggagtacctttttctgatcccatggccgatgggcctaccatacagcgttcctcggagcgcgcactcaaacaccatatcagcctgaaagatgtacttgctatggtggcacaattcagaaaaatgaaccaaagcacaccgattgtcctgatgggttatgccaatccaattgaggccatggggtataaacgctttgtggaagaagcaagccgttccggggtagatggcgtcctggtagttgattatccaccagaggagagcgctgaatgggtgcgacacctgaaagatcagggcatcgatccaatttttttactatcacctacaaccccggaatcacgtgtcaagcatgttgcagaacttgcaaaaggatatgtttattatgtttctctaaaaggtgtaacgggtgcttcacaccttgatctgcaggatgtcagcagtaaattgtctcagcttcgtgcgcatatcaggattccgatcggggtgggttttggcatacgagacgaacagacagccaggagcatagctgagcgggcggatgctgtagttataggtagccgtattgtggaggaaatcgaacactcccaggcagctgatttgctggcaaatgtaggtgctctggtagaatcgttgcgacatgcaattgatgctagatccaatcactcttctgacatagggtagtgatatgagctggtttgaaagtatcattccccctaaaatcaagcgtaaggaaaacggcgaaaaaaaagctgtcccggaaggcttgtggagcaaatgtgcaagttgcgaagctgttctttactgcacggatctggccaaaaacctgaatgtttgccccaaatgtggtcaccataatcgtatttctgcgcgcaagcgtcttgagtttttactggatccacaagagcgccacgaacttggcatggatgtccttccacaagatcctttgaaatttcgtgacagcaagcgatatacggacagattgagtgatgcgcatgaagttaccaatgagactgattcactggtggtcatgcgaggcagtattaagtcgatcccggttgttgctgctgtttttgagtttggttttatgggcggatcgatgggttccgtagttggtgagcgctttgtacgtgccgtgaaagcctgtgtgacacatcatcttcctttcatctgctttagtgcgagtggaggggcacgtatgcaggagggtttgttttcgttgatgcagatggcaaagacaactgcagtactggagcagttaagtcgggagaaattaccatttatttctatactgacagaccccacaatggggggggtgtccgcaagttttgcatttattggcgatattgtgattgctgaaccaggtgcattgattggtttcgccggtccacgcgttattgagcagactgtgcgtcaaacattgcctgccggttttcagcgagcggaatttctgctggaacatggtgccattgatttaattattgatcgtcgtgaaatgcgtgatcgattagccaacctgtgtacattgctgatgcgtatcccggttcctgtttcaccacctgttatatcagctgattgaacctggttttttctgaaatttgctattaccttttgaataacggtggtgttaactaaaagggataatgtgaatctactacttgctgtcatggtgagcgtctcttttactttatttcttccggatcgatgatggatgtccgatcaatgactttagatgactggttgctctatcttgaaaaacttcatccaaaggcaattgatatgggtctggagcgggtgaagaaagtaagagatgctttgggattgatgcccaaatttcctgttattacggttgctggtacaaatggcaaaggctcagtttgtaccatactcgaatcgatacttggtcgtgcatcctaccgggtaggttgttatacatcaccacatttactgcattatggcgagcgaatacggattgatcagcgagcaattactgacgaggttttgtgtggtgtatttgctgagatagaatctgtacgtgaatcagtccaggttacgctgacttattttgaatttggtaccttggccgccatgctgatatttgtgcgggcgcaagtggatgtggccattctggaagtgggattaggcggccgtcttgatgcagttaatgtatttgatacggattgcgccatcctgaccagtatcgacctggatcacatggattatcttggatctactcgggaagccattggccaggaaaaaattggtatcttcaggccaaataaaccggcaatttgtactgaaccggatataccagccggtcttcttccaaaaatgaaggcgacgggagccttactatgttgcatcaacaaaaacttcggctatacacaggataatctgcaatggtgctatgaaggagtgcgccgctataacttgtcattgccagcgcttaaaggggaataccagctgcaaaatgcaagtgctgctctggcagcgctggaggctatggaaggaacattgcctgttccaatgaatgccatacgacgtggcctggctgaggcaaccctggcgggtagatttcagataatttcagcaaggcctgtgattattctggacgtggcgcataatccggcagccactcgcaaactactggctaatctggaagctatgccagtaaaaggatgtacttatgcaatcgtgggcatgctgaaagataaggatatggctggcacgatccgggtgctgaagaataatgtggatcagtggttgatagcaggtctggatgtggcaagaggcgcaacagggaatgaaatactaaaggcacttggagatgccggaatagcagaacaggagtgcgtacgtgtatttcagaatgtacagagtgcctatgtttacgcgcgtgaacatgccggtagtgatgatagaatatgcgtttttggatcgtttcataccgtcagctcgatattgaagaatcatggcgggacggtttcttaaaggtagacaggtataaaaaatgaccagtagcgtcaatgaagaagagatttccctgaggaagcgtgccagaaagcgcctgatcggtgctatcttgctcgttattgtgtcggtagtattcttgcccatgattcttgatgatgaacctcagcaagaacagcaggaaattgatattcagataccttccgaagagctgactgctgaagcttacccttggatgacaccggaaaatgcaacgtccgatgatgaggcagaagttccccgggaactagataaaccattacctttcagcgatcctgagcgttccgagaaaattgaaaatagtggatcgggtgatagtggtttcgatggaataccgattcctgccaggaagccggtgttggcaaaatcagccccagctattcaaggaaaaacttccgttgttcaggaaaaagtacctgtaagtgataatgtaaaaatacaagacggttcatttgtcattcagctgggtgcattctctgatgtttctaaagccagacagcaacagcaaaatcttgtctcaaacggggtaagggcatataccgaaacaatcaaggttggcagtaatgaaatgactcgtgtacggatcggaccttttcctacgcgagaagctgctgaagcagagcatgaacggttgaaaaaaattggattgagtggtgtagtgacaaccagatgacgattttcgactacattgttatcggaatcatatctttctcagctttattgagtgtcacgcgcggactggtacatgaaatcgtatcccttcttgcctggataattgccttctttgttgccagtcgttattcaataaatgccgcccccttgttatcagactggatcgtgaatgaatccattcgcatgttgacagctttcagtgtgatgttttttgttgttcttctggtaacaatgctcgcatccaggctgctatctgttctggtgaggggagtagggctgggcctgatagacagaatgctgggcgcgctgttcggaatcgtgcgtggattggtgatcatattgtttctgataacagcagccggctttactccacttccacaacaacccttctggcagcaggcggtattgagtgaacccctggaaataatggcggctgacgtaatcccctggttgccccaggatttcaggaatcttattggttttgccaagtaatttaagttcaggcttgactatattgaaatttcgtatcttgtaattaatacagatatgaactgctagttttacaagttttttaatccactttttcagcgagctcgctatgtgtggaattctaggtgtagtagcccgttcccccgccaatcagttgctctatgatggcctgttaatgctgcaacatcgtggccaggatgctgcaggtattgttaccgcgcaaggtaatagttttcatatgcacaaaaggttgggtatggtacgggatgtgttccgcacccggaatatgcgtgctctgccagggtatatgggaatcgggcatgttcgctatcccacgacagggtcatcaaattctcctgcggaagcacagcctttttatgtaaattccccatttggtattgtgctggcgcataacggcaacctgaccaatgcggatgtacttaatcaagagctgtttcttgcagatcgccgccacgtaaacacgcattctgattcggaagtgttgctgaatgtgctggcacatgaattgcaggagcgcgcgacaggttaccaacttgatctggctgaaattttctcggcagtttccggtgtacacgagcgttgtcagggtgcttatgcagtgattgcaatgattgccggttatggtttgctggcttttcgcgatccatgcgggatcaggccgctggtattcggatcagtggaaacgaatgctggtactgaatacatgattgcttctgaaagtgtggcgctggatacactgggttttcgtctgatccgggatgttgcacctggagaagctgtttttattgatatggaagggcatttctacagccatcagtgtgctgctcacgccagtctgaatccctgtatttttgaatatgtttatctggcccgtcccgattcaatgctggatagcatctcggtttatgagactcgtctcaatatgggcgtaaacctggcagataaaatcagcacctccatgcggcacctggatattgatgttgtaataccgattccggaatccagtcgtccaagtgccatgcagcttgccaatcgcctcgggatcagcttcagggaaggatttgtcaaaaatcgctatgtgggcagaacgtttattatgcccgggcagcagcagcgccggaaatcggttcggcagaaattaaatgccatcgaaattgaatttcgcggcaagaacgtactgctggttgatgattctattgtgcgtggcaccactagccgagagattgttcagatggcacgagaagcgggagcacttaaaatatactttgcttcggcagcgccaccagtacgtttccctaacgtatacggtatagatatgccgactcgccaggaattgattgcaacagatcgtaccgatgaggaaatatgtcgtgaaattggtgcggattatctgatctatcaaaatctggatgcacttaagcaagcggttgcccaggtcaatccgcgcatcacgaattttgaaacctcctgttttgatgggcattacattacaggcagtgtcactcaggagtatctttacagaattgaatcacagcgtaacagtctcgggttatcacaaggggagcgcactacccaacttgatttaaccctgctcccaatggattaatcatatagaaacgatcatgacaaatgaattagatctccaaacgctggctattcataccggcgtccatcgcagtcagtttaacgaacattcagaatcactctatctgacttcaagttttgtgtttgacagtgcagcccaggctgctgcacggttctcagggcaagaacccggtaatatctattcgcgctttactaacccgacagtaactgccatgcaggaacgcctagctgtgctggaaggggcggaagcctgtatcgcaactgctactggtatggcagcaattacgacctgcgtcatgggactactttcagctggtgatcatatcgttgcctcacgcagcctgtttggatctactgttggcttgttcaacaatatcctcagccgtttcaatattgaaactacctttgtttctgcaaccgatccgagtgaatggcaggcagcagccaaaccaaacaccaaactgttttttatggaaactccctccaatccactcacggaaatctccgatatcgctgcattggcagacattgccaaacggattggggtgtggctagcggttgacaacagtttttgtaccccggttgtgcaacaaccactgaagctgggtgcagatctggtcattcactcagcaacaaaatatctggacgggcagggcagaatcctgggaggggcaatactgggtaaacgtgatttgctgatggatagcggtatattcggtttcttgcgaacagccggcccggcgctaagcgcattcaatgcctggattattctgaaaggacttgaaacattaagtgtacgggtaaaagcacactctgatcatgcactggaagtcgcgcgctggctggaagcacatcctaatgtagcacgtgtgttttacccgggtctgccgtctcatccgcagcatacacttgcgatgcgccagcagaaaaccggtggcagcattgtgtcattcgaggcaaaaggcggcaaagaggctgcctggcgtattgtagatgctgctcagctcatgtcgattactgccaatcttggcgataccaaaagtacactgactcatcctgccactacaacgcatgggcgtatcagccaggaggcgcgcgcagctgccggcgtcagcgatggtctgctacgtattgcggttggcctggagtcaccggaagacatcaaggcagatctcgctcgaggattgcagtagactcgtaatttattacaactggcacacactattcttcttgaaaccggatacgactagcaataaattttgctaccggttttcactcactactactgtgatacctccaaaatcttgccatcatgattaatgattatcttgaaaggatactgaccgcgcatgtctatgacgttgcggttgaaacccggctggatccggcgccatcattatctgcccgtattcataaccgtgtgctgctcaaaagagaggatatgcagcaggttttttccttcaagctgcgtggtgcctataataaaatggctagattgcattctggtgtattgcagcaaggcgtggtcgctgcctcagcgggaaatcatgcgcaaggtgtagcactggcagcgcaaaagctgggctgctcagccacgatcgttatgccaaccaccacgccgcagatcaagatcaatgcagtaatggcgatgggtgctgcagtactgctgcagggggattcctataatgatgcctacgaatatgcgctgaatcttgccagggaaaagggggttgaattcattcatccttacgatgatccggatgtgatcgccgggcagggtacgattgccatggaaattttgcgtcagcatcccgggaaaatccatgcaatttttatcccgattggtgggggagggttgatttccggcattgctgcgtatgtgaaaagacttcgcccggatatccggataatcggagttgagccaacagattcaaatgccatgtatcgttctctgcaggcaggttattgtgttgagctctcgcaagtgggtttatttgcggatggtgtggctgttcgtcaggtgggacaggaaactttccggctgtgtcgtgagctggtggatgacatcctgctagtagattcggacgccatttgtgctgcaatcaaggatatatttgaggacacgcgctccattgtagaaccttccggtgcgctttcggttgccgggctaaaggtgtatgcgaaacaaaataacttgctgcacgaaaccctgattgcaatcgcatcaggagcaaacatgaattttgaccgactgcgccacgtttctgaacgggctgaactgggtgaacagcgtgaagcaatccttgcagtgacgattcctgaaaagcctggtagctttaaacagttttgtaatctggtgggcgcccgcaacatcacggaatttaactatcgctatgcggatcctcaaaaggcacatgtctttgtgggtatatcagtccgtaatcgcgaagaagcattgaatctgatccagatcctgcatgcaaataatttgcgtgcagaagatatgactgacaacgagatggcgaagctgcatatccgccacatggtgggtgggcattccagggaagtcagtcatgaagttctgtatcgatttgaatttccagatcgtccgggagcactcatgaattttctgaacaaaatgagtgatcgctggaatatcagtttgtttcattatcgtaatcatggcgctgatttcggccgtgtcctgatcggaatacaagttctcccacaggacaaagatgaatttatgcacttcctggatgatctgggttatgaatttgatgatgaaagcaataatcctgcctatcagtttttccttgcctgattttctgcctgcatctcctcctcgtttacgagcttcctgttcatggcaatagtatctttaaatgtgattggactaataccgccccgtatcgggtgttggtgcttgtccgcaatcattgaagcacctcacaactttaatcgctaaaaaattctggttcaaaacgctgataaagaaggtttttacaaatttcttctgatttttgtacctggaagacagcgactatcctattacactggaattatgtcatcataatattggcttttcagaatgtgctgaaataccaataagggcgattttgacagaagttttaccagagtaaggtctattaccggcatatgacaggttgtaacaaccccaacgatatgactgtactgcttcctataaccagatatctgcagatatttcgccgatcgtggctcccaggagctctatccgttctgtttctgttgattgctttgattatgctgcgtgttgatactcagcaagcgcgcaaccataccgcttcacttgaagttatcgggcgtattcataccagcatccagcatctggtcattatttcccgggaagcgttgcgtggaaatgagcaggcatttgttcaactgcgcaataacctcgatcagctgaatcattattcaaccctgttgcaatacgggggagagtatcagcgagaaactattcccgccgtagcagaactgctttctgtagacttatttaaatcctttcagaacacattgcgtacaaaggaaaatcaggctcgccaaattctggaaagtcgggaagtactaattaatctggcagaaattttaaaacgggttgatctggtcaataacagcttgcaaaagaagctgcaggatttttcagccgagctggcgcagtcagggcatgcatccagccaggcagtcgcggtcgaaactgtaaaaattcttgttcagtttattaccagtagtgtcagctctgtgatacagggcggatttcaggtatctggcacaacagatcaattaccgggagattccgaacagatcaccgggatgatccagactttaataaaaggccgggactggttgtattcaaccgttctgggcaatcaacttccctccgaaacgttgtctgagattcgtatccagtttaatgcactggaagatttgttgcgtgttgcccagaaattgacaccggaagcgaccggagcctggcatgcaatgcatgagacattttcagccagtgatagattatcgacactggtaggtcagattgaacaggcaatcatcgagcacaatagtagcgaaggtacatccattacggtgctgttttatctggctgtaatattaaccattttaagtggtctggtattcatccagatgttttctaccagtttgcgcaagcgaatccatcagggtgaacaagatgttgaaaccacgcagaaggcgatactgcacctgctcgatgaaatggagataccggcaggaggggatctgactgctcgcatgtccgtcaccgaaaatattaccggcacaattgccgattcaatcaacttgacgattgaggcgttgcaggagctggttaaaaaggtaaatcacgccagcgctcaggtgattgatgcctctcatcaggcagaacaaatttcatcagatttactggccgcgacacaggaacaggcacataaaattgaagatgcaacggttgctgtcctgggagttgctgaatcactggaagcagtatccgattcagcggaagaatgtgccaatgttgccaaacaaaccctgcatgcggcagaaaatggtgccaatgccgtacaggacgccatggccggcatgaatgaaatccgggtctacatccaggaaacttccaaacgtattaagcgtttaggagagagttcacaagaaattggtgaaattgttactctgatttcggatatcaccgagcaaaccaacatcctggcattgaatgcctccattcaggcaacaacggcaggtgaagctggcaagggattttctgttatcgctcaggaaatacagcgtctggccgagcattccgccgaagcgactcgacagatcagtacgctcatccgcaacatccggggagatgcgcaagacactatcattgcaatggagcgcagtacagcaagtgtggttgagggtacaaggcgtgccaatactacaggaagcgccctggaagaaatcgaaacaatctctaaacgcctggcgcaactggtcatcagaattaccgaagctacgcgcaaacaaacccgtgtttccaacaaggtggtcaaaaatatggaagatatcttatccatcacccagcaaaccacccgaggcactcagcagaatgctgactctatcaggcagatcgcagagcacgttacagacttgaagtcatcagttgccaatttcaaggtatgacagctctgtgcaaagctgccatctgcagcaaaccaaagccatccactatcaattttgggattaatagggccgcatcatgaatactgatactaggataaatatctcatctgttatggggatcagagaagccattgagcagatttttaccttgatccaccgccactttgattcttatgccacggatacggatgacaccaggcagattgaagaatgccggtattacatgcatcaactgaatggcatgcttgagatgctggagctgagtggggtggcgtttgtcgggatcagtgtggaagagctgctagcagctttacaggaacggaggattgaaccggacgcgcagactttggttgttgtccggcaggctatccgctccatttaccgttacctggatgcgctgatagatggtgaggtggacaatccggtcaagctttttccggtctaccgcaagatcatgcaagtgcaggggctggaagaaatctctgaaagtgatttgtttttcccggacatacgtgaatcgttacccctacaacctgtagagctggatctggatgatacttcccggcaagagacagccaaacaggcgcgtgcgcaattccagtcgggattgctaagctggctgaaaaatgctgatgacaagcagagtctgcagaaaatgattgaagcggtacgatcaatcgagaaactaccggctgctattgaacagcggaaattttggtggatctcttccggattcctggatagcctgcttcatcaggagcaggtcgttgacaagtcggtgcgcagattgtgcgggaagatcgagcaggaaatccggcatctgaacaaggaatcacacgttgtcgctgcccggttgacaagagagttgctttaccggatcgcacgcagccagccagtgagtgaacgcctccaggaaatcagtcgtgtctatgactggcagattcccttgtccacgattgataatcaggagcatcttgacgaatccatcatggatgaagaggcaactgcttcggatctgcagagcatgcgtgttctgctggaagacatcaatgatcagtggcgcaagttcaatgcagaagatcaggaaaatatttcatccttgctggcgttaactgaacagttaaaagtcctgatttccagggtaagttgtcctccgctggagaaactggcaggcgtcattcatggtgtcttgtcctatttgcgaatccgcccacagagcatgaatgagggaattgcactggatattgcctcatccctgctactgacagaaaatgccatcgataattttcatcgtttgtcgccggaatttccgtcacaggtcgatgcacttgccacccgtatacgtgcagttacgaccggcaagggagaggatatcgatttacctgatttgcccaatccggatcaggcaggccatctcacccaggagaaaaaattgttcaaacaggtggcgcaggaagtgctcgccaacctggcgcaagttgaagatatcctggatcgtttcttttttgaaccggaaatacgcaacgatctgccgcttttgcctgaattgttcaaccaaatcagcggtgtattgaatgtgcttgaacttgatcaagccagtacagtgctggattcatgtcgggctctcacggaaaaactgacagcatctgatcacctgatagatcaagctgagcagatgttgttggccgatgcgctgagcagtcttggtttttacattgaagcactcaggaattcccagtcggatgctgaggaaattcttgcaacgataatgcaacggcttggccagaagcctgccgggctaggtttatcaacagatattcgggaaatccctattgatttcgctgcggctgctgatcgtttatttgaaagtgatccggagcagctgattgatcccgagttattggcagtctttcttgatgaatccagtgatgtactggcaagcattgctgatcatttagagtcgtgttatgccaattacgcgaatcaggacgccctgacaactatccgacgcgatttccatacgctcaaaggtagtggtcgcatggtaaagctggaagcgctgagtgaagtggcatggcgtattgagcagcttatgaaccgctggctgagtgagcagaaaccggcaaccagcatacttctggatttgctggcagaaagtcacaggcagtttagcaactggtgcgccagcctgagaaaggatggcgcggtagagatcaaggctgaatacctgcttgatcagatcagagcgctgatgtatggcacggacgaacagccggatattgcggctacatcacttgcacccgaggtgttcgagcaggctccggagattgaaccactgctaacaatcaccgatgcactatctgacataaaaaccagagcagaaacggcaataagaattggcgatagcgaggtgccggcagatctcttcagaattttcatcaatgaagccagtactcatgttgctactctcaaacaggcatttaatctgcccggggatgatgccattttatcggttacacatgaatccatgctggcagctcatacgcttgccagtacatcacgcgcactggaattgggtttcatcgcacagatcggacaagcgctggagcgctggtttaaccggctgctgacgacttcaaacatgcccggacagcaagcattatcgtacatgacaactgcggtcaacttgctggatgatatgctggccacaattcgggaacatcaatttccttcggcggaaactgtgcaggccagcgcagaaatcacacatgaattgatgcgccttctggaagaagctcctgctatacaagcaacagaaacagagcagatggtggaaatggaggagatggcgccactcgaattggcagtggacgaagtgctggaggaagattcatctgcttcaatgtcagagactgagatttcgttgccggtttcatcacttcagcaggtgaaagatgcgtttgccgacctggatcaggaattgctggaagtatttcttgaagaagcacaagaactgcaatccgagattggcacaaatctgcggatatggcgtaaacaacctaatcagatgaatgcacgcaaggcagtattgcgtgccttgcataccttgaagggcagtgcccggattgctgatgcgcagcaagtgagtgatctggcgcatcagatggaaagtgatattgaatctctgtatgatcagacggcctccgcagcattgcttgatcagctggaaacacagttcgataccatttcggataaggttgagcagttgcgatcctctttacaacctgaatcgcagcctgccccggtaactgaagaagccgaggcacatccggaattgcttcctcccgcagtggaaactgtttctgcccttcctatatccacagcggatactgatcaacctttccgcaaaactacactgcgtgtcgatgcagaattgatagatcgcctgattaatgaatcaggcgagtcgagtatcattcgttcccgggttgaggcgcagctatatgatctggaacagtatttgcaggatctgggtgaaagtgttgatcgcatgcgtggccagttgcgtgaagttgaattgctggctgaaacccaaatgccagccagctcgctaccttccataactggtcagacagattttgatccgttggaactggatcgctttactcgctttcaggagttgacccggctgatggcggaaagcatggatgatgtagtcaccattcataaaagtttgcgtgaaatacagcgtgccgccacgatgacggtggatcagcaggcacatctgaatcgacagttacagcaggatctgctgcgtattcgtactattcctttcagccattattccgagcgcctttatcgcgccgtcaggcaggtgaccaaagataccggcaagcaggctaacctgattattcagggagatagcattgagtttgatcggggtgtgctggataaaatcagctcttccctggagcatctgctacgcaatgcgctggtacatggcatagaaactccggaagaacgtctgagcatcggcaaggcggaagcgggccagatcacactcgatctgcaccgggatggcaacgaaattgtcatggtgctgcaagatgacgggattgggttggatgcagaacgcattcgtgaaaaagcgcggcagcttgggttgggcagcccggaaaatgagcaggacgatgagcagtggtatccgctgatttttacgcatggcttttccacattggatggcgtgacggatatcgccgggcgcggggtaggactggatattgtcaggaacgagttgggcgaactgggcgggaacatcgcagtcacatccgagaaaaaccggggaaccacattcaccctgcgttttccagtgacattggccttaacacaagcgttaatggtcaaggcaggagatagcacttatgccatcccgatagcgattgtggcacatgtattggaaatgaatgcagaaacactcgggacggcttatcaggagcatcacctgatatggaacggcaatcgctttccactgggctatctgccgcacctgctgggggtgtcgcatacctttcctgaaatcagacgtagtaaccgtattgtgttattgcaaacggaacatgagcagctggccattcatgccgatgcattgatcgggcaatgtgaagtggtcatcaagaatatcggcccgcaactgtctaatgcacccggcattgaaggggcaacgatcacaggagatggcagcatcgtattgatcattaatccgatcaagttgctgcagcgcgagcaggtacgggagctgctatctgcaggaccaatgacgccagttgatgctgcagatattcatccttctgccaccgcaccggttgtcatgattgtggatgattcgctgacggtacgtaaagtcaccagccgactactggaacggcagggctatgaaatcctgattgccaaagatggcgtgggggcacttcagctgctgcgcgaaaccataccagccattatgctggttgatatcgaaatgccgcacatggatggctttgaactgatccgcgctgtccgtaacaacccggagttacaaaatatcccgatcatcatcatctcctcccgcacagcagagaaacaccggaaagtagcagaggaacttggcgtaaatgagtttatgggtaaaccctaccaggaagatgagttgttgcagcatattgaacgcctgattaaagaaggatgttaaccagtaaccactgctcatccggttcaggcatcaacttagcgcaacttcaaacccttgaatttaaatagctatgatttcattagaagaacttggtcttgcttaccgcaaagctaaagttgatctatattactcatctcatacctcactagacgcgatagcagattacgaggaaaatctgcacgccaacctgcaagcgctgctggaaaaaattcaaggtgaggatgaatcttggatcagcgtccccgacttccttggctcttggatacccgtacccaaatctatcgacatggcgagctggcggcaactccgcaaaggccagggcagcggtttgatttttgcctcgccagcatgtgagtggaaacatgcctgcaaggtgctggtcgataagaagatcgaacagctgatggatgccaacggtaatatcaccagcctgcgcaagcgtaatggtcagagcatcacactggcgtatgacaatctcaaccggctgctcagtcgcagctatccgaccactgcggacaatatcacctacacctacgacttactgggccgcacgacggctgccaacaaaaccggctataccatcggctatgtctatgacaatgccggacggctgaccagcactaccgccggcagcaagaccctcgcctaccagtatgatccggcaggcaaccgcacccggctcacctggccggagactgcgttctacgtcaccagcacctatgacgcgctcaaccgtccaaccgcgatcaaggaaaccggcacggtcaacctggccacttacgtctgggatgacctcagccgtcgtaccacagtaacgctgggtaacagtactaccaccagctatgcctacagcacccagagtgcactttccagcctcactcacaacctgacagggaccgcgcaggatcagacctacagctacacccgtaaccaggcacaggaaatcgcaagccaaagctggaccaatgacctataccagtggacgggttatgccaacggcaccaggaactacaccgccaatggcctcaaccagtacaccatcgctgccggcgctacgctcacgcatgacaccaaaggcaacctgaccggtgatggggtatggacctacacctacgacctcgacaaccagctgatcagtgccaataaaaccggctcgaccaacagcctggcgtatgatggcgcagggcggctgcgccagaccaccctggcgggcaccgtcaccggcctgacctacgacggcgtggagctggtggctgaatacaacagcggcggcacactcctgcgccgctatgtgcatggccccggcattgatgaaccgctggtgtggtatgaaggaacgactaccactgccaagacctggccgtaccaggatcaactgggcagtgttatcggtactgccaacagtgccggcaccagtaccgctatccacagctatggcccatttggtgaacccaataccactaccggtatccgtttccgctacactgtcaccggccagcagttcctcggctcactcaatctgtaccactacaagacacgtttctattcgcctgcactgggcagattcctgcagaccgatccgatcggcaccgcggatgatctcaatctgtatgcatacgtgggcaataacccgatcaatttcagtgatccgagcgggttgattgctgcagaagctcaaatgctgatgggtaaggtgggttcctggggaagggacaatgccggtacactcgcagagatcgggataggattgacacctgccggcgtctatgctgacatctgcactgcagcaacaggcagattaccgataaccggtgattccctctctggttgggaacgagctgcgatgctgatcccgggtgtctccgaaatcagaaatgcgggaagaattggagctactgtactcaaagatggtgcttaattatcaactagcaaagcacttgacttgatatggccattaagcgccttgttggcccaaactataaagagatcgcgtctggagtgttcaaatcatctgggactgaatacttagagatatacccgggcaagtagtaatccagccaatagcactgcgaccagtgtcagtatcaggctttgacgtttttgctgtgcgaccagttcggccagtctgtcttccagatttcgggcacgttgcttatcaaggttgtagtgcatcaggcggggaaactgcggtagcatcaccgcccagttggttgcttccttctgcaggtgagtaataagtccgcgcagcccgatttgctcggccatccagttttccaggaatggcttggcagttttccagagatcaagatccggatccagatcacgtcccagaccttcaatattaagcagtgttttctgaagcagaaccagttgtggctgaatttccacgttgaactgacgggaagcctgaaataagcgcagcaggacacgtccaaagtagatttccttcagaggtcgatcaaaaatcggttcacacacggcccggatagcggcttcgaaatcatctacgcgcgtatttctcggcgcccagccggcctcaatgtgcgtctctgccacgcggcgatagtcccggcgaaagaaagccaggaagttttgtgccagataatttttatcctgttcactcagcgtacccataatgccaaaatccacggcgatatagcggccatcgctcccgacaaagatattgccaggatgcatatcagcatggaaataaccatccctgaacacctgagtaaaaaagatctccactcccatgcgggcaagttgtggaacatcgattccctgtgtacgtaatatctctacacggctgatgggagtaccaatcatccgctccatcaccatgacttctggatgacagtaatcccaatacacttctggcacctgtagcaagggggaattgaggaaattacgccgtaactggctgcagttagcggcttcccggataagatcaagttcatcgtccagatgtcgggcaaactccgccactacttcgcgcaattttagtcgcttgccatctggccagatggattcaagcagccatgcaccggtttccatcaacgccacatcatgtgcaatgacgggggcgatggttggtcgcaagatcttgacagccgcttgtgtgccatcctgcagcacggcaaagtgcacctgggcaactgatgcgctggcaactggcttgatatcaaattcgagaaagacctcatttaccggctttctatagacggtttccagtatttttaccgcctgctccgaaggaaaaggcggcacccgatcctggagaaaagccagttcatcggcaaaatcctgggcaagcaaatccctgcgggtggatagcatctgcccaaacttgatggaaatgggccccagtgcttccagtgccaggcgcaatctgaccgcgcgtggctgtttgagttgagtgcgaaacggcaatagctgtgaaaataccttgagtgcgcgcaggtgaatctgctcgagtaggatttcatctagtccgaagcgataagcaatcaggataattttaaatagacggaaaaagcgcatgaagtgattggtggttcaataaagttaccagcaggcagggccggtggtatctgcacggattgcagaggcgagttgtgagcagcttccgatcattggccggtccgggacgaattttctacagcctgtgagagcggtgaaatcagcgtatcaattcgttcttcaagttgcgcaacccattgttgcagtaatgcaacctcggagccggtctggcaaaatcgtgagtggcttgccgttatcggctgttcctcagtaatgaattctcccagcgcccgcgacagattacgaatgcttcccagctgccagcgtaccagttcctgcccggtcaaagtcacgcggtgggcaaacacatctccaatgaccgagctcagattctcctcgatttcagcctgaaatatcttgcccatgtacagcaagatatttgccagcgccggatcgccacagacagtaatctcacggaacgcatcaatatcgccggaagcaaggcggggcgtaagttcgactggtacgtttaggatcactttggcgtgctcatcttcggttgccatcctgaaatgaccatcctgtgtaatcgtaacatacagacgaatcagggatccgatacggaaatatacagtttcattcacatgagattgtaattgctgccgtacctggttcgatttatcagccaggcgattcaggcagataatcaggggggtggtcagtatcgaggattgtgtgatcattaccgggaacaggttgtcaacatgctaactgcccacgcaaggtgggctcgcatgtcaccgcatgctcaggaacgcatccggcgattcgttaattacctagattatagcgtgattccgtaggtgagcagacggttgcatgattattacccaaccggttgacgatgacctcggacagggagagctgatcttgcagggcaagttcggaaagaatctcccatgcatgatgcgtcacactgatggttttatgcggctctgtatatctctgtcttttttccttgtgatctttgtgcatgctgatcactttcctaatttccatccactgggcttcattcaaccatttctgacaccacatgttgaaattgatcgaatcagccctggatgcaaggtattcctgttttgctgcgctgtgctgaggttttgttgtgccgaaccactcaggatctttactcaactgactgtcaataaaagtagtggctacttttctgtcttgttgtcggattatgtaggggtactctgccatttttactcttgattatcttgttgcgtgaatttcagaaatataagtaatgctttacagatgaggatattacaagggaataaagcctggttcaatgctgttgttgtatgcaattgctgcttatcaatctgcagaacgggtggaaatgaaagcagtttatgcgtttgttcgaaactacaggcttgttttgctgcggtaagctgttgcaaatttcagacaggagtcctcatgagtactgatctcgaacagttttaccagatattttttgaagaagcgggtgagttgctggcagagatggaaacacgtctacttaaactggatattttgtcacccgatccggaagatttgaacgcgatatttcgtgtggcgcattccatcaagggcggagcgggaacattcgggtttaccgatatgacaggacttacgcatgtgcttgaatcgctactcgacaagttgcgcaaggatgaactcaagttacgcgctgaaatggtggatacctttctgcgtgctggggatgtattaaaaaatcaactggatgggcaccggggcactggttccgccgatccggtagaagtggatgccgtcaaccgcaaactgaaagagttggtagcagatacggttagcaatagcgcaacgtccgcacccgaatcggtagaggaatcagccccccatacagtgaacactgctgaacaggccccaatgtctactgaatcagcatccgttgcaggaaatgtcaccacttaccggattgaatttggttgtgctgatcttggcaagtcagtaatggagaagctgttaattgatctggcgcggcaggggcagctgaaaaacctgagtgatccggataacgaagcaatatgcatattgcagcttgccacgactgacagtgaggaagatgtctgggaggcactggcgtttctggttgatcccgccaatttatctatcaaaatagataaaagcgcattacctgctgcagatgttcccggagcaacactggaatgccgacaggagcagcagcagacggttgagactatatcagaacaacaggatatgcagcttggtgaagctgtatcctctccaactactgctaattcagccactcagaaaccccaactgcctgccaaaaaagcagtagtcccaccgcaacataagccatccgctgatcacgctggatccgctagcggtgaatcttcctccatccgtgttggtgttgagaaagtggatcaaatgatcaatctggtgggagagttggttatcacccaggccatgctggcgcaaactgcgagccagatcgatccggttatttttgaaaaactgctcaatggcctgaatcagctcgaacgcaatacccgtgatctgcaggaagccgtcatgtcgattcgcatgatgcccatcagttttgtattcagtcgttttccccgggtggtaagagatgtagcctccaagcttggcaagcaggtcgatctcaaaaccttgggtgaaggtaccgagctggataaaggattgattgaaaaaatcactgatccgttgacccatctgatccgtaacagcctggatcacggtatcgaaacaccagaaaaaagaaaagcgctgggtaaacctgctcacggcacgatcacactgcgtgcatcgcaccagggtggcagtgttgttatagaggtgatggatgacggcgcagggcttaaccgggaaaaaattctggataaggctcgcagccgggggctggcgattagcgagaacatgaccgatcaggatgtctggatgctgatttttgaagctggtttttccacggcagaagttgtgacagatgtttccggtcggggtgtgggtatggatgtcgtcaaacgcaatatcgagggtcttggtggccgggttgaaattgactcaataaccgggcaaagaacgaagatttcaattcgtttgccgctgacgctcgctatcctggacggattatcggtatcggtaggggatcagctgtttattatcccgctgacctatatcaccgaatcactcaaaccggctgcagaagatattcgcaccatacgaggccagggtcgggtggtggaggtgcgcggcgagtacctgccggtgattgctctgcatgaaattttcggcctggaaccggaagtgcatgagatccatgaaggcattctggtcatccttgatgctgaaggaaacaaggccgccatgtttgtcgatacgctggttgggcaacaccaggtggtgatcaaaagtctggaaagcaattatcgtcgcgtacagggcgtttcaggcgcaaccatcatgggtgatggtagtgtcgctctgatactggatgctgtggggctggtcaatgtcacgaagcagagaatgatccatgcagcgtaataaattgatcaaacctctgtgggagaagccgttagagccgatacctattgcacattactgaggagcaaaccatgttgttgacacaagccacggctactaccactgctgcaggcgaatcacctgactcgatccgggatctttcatgcagtgaatttctgatattccggctgggaaaagaggaatacggtatcgagattctgaaagtccaggaaattcgcgggtatgacgccattacccgtatcgccaacgcacccgaatttatcaagggtgttatcaatctgcgcggcgtgatcgtaccgatcgttgatatgcgcatcaaattcaatttgggtgcagcccattatgaccagttcactgtggtgattatcctgaatttgtccgggcgaattatcggcatcgtggtggatggcgtatccgatgtgatcaacctggatacagagaatttgcgccctaccccagaattcggcggagtaatcgataccgaatacatcatcggacttggcactatggaagagcgcatgttgattctggtggatatcgaaaaattaatgagcagttcggaaatgggtctgctggaaccggcaggcaaatagctttgtgaatagtcgcgtgtattagtggctatggcgatgagcacagtattttaaaagttaagttactttatttatcgggagcaaaaatgttgcagaacatgacgattaaatcacggctgatttttgtgattggcctgctgtctctgttgctgatcagtgtgggggcagtcggtctgtatggcttaaatcaatccaaagcacagctggaaacgatttatcaggaccgggtggtggtgcttggtcatttttcagaaattctggacaaactgcaacaagtacgtatgcatgcgttactggctggcaactcgcgtgatactgctgttgccaggcaacgagcaggacaggtgattgaagaagattccggcatcagtgatctctggcaaaaattcagccagacctatctgattccggaagaacaatcgctggccaatcgcttcaccgagcaatggagggcttatcaggctgcacgcaatcagacgcttaatcatgctgttaatggcaattttgatgcggcaatggagaatacccttcaggacgccggccccaaatatgaatcagtgcacgacacactgatgcagttaatcgagctgcaggaaaatgtcaccgcgcaggagtatgaacagctgcaggcgaattcttccaaaatgattatgaccatgttcctgctggcggcactgggaatcctgttagccggcgtaatcggttttgtgctgattcgtactatcagccgttctatcgatcaggccgtgcaagtagcagatggtattgccaacggtcatctggatcagcatatcgaagtgaccggccatgatgaaatttccgtgttgctgaaatcgatgtgcaagatggtggaagtactgaatagctttgtagctgctcagcaaaaaatgcaacaacagcatgaagccggtgcaattagctaccggattcctgccggtaaatttccgggcagctacggtgaaatcgccagtgcagtcaatgatctggcggcagcacatattgccgtcaatatgcgagtggtggaagttgtttcacgttacgcgcagggtgatctgtcagtagatatggatcgattacctggtgaaaaggcaaaagtgactgaagcggtagacaaggttaaaggcagcctgcaagcggttaacaccgaaatcaggaatctggtggaaggtgcagtggcaggtgatttctcccgtcgtggcaatgcagataaatatcaatatgagttccagagcatggtgaacaatctgaaccggttgatgcagacttgtgaaaccagcctggaggacgttattcggattatggatgccctggcagatggcgatctgacccagaaaattacccgtgagtaccagggtatgttcgctcgcatgaaggatgactcgaatgtcaccgtgggacagttggcaagcattgtcaggcagatcaaggaagccgccggactgatcaccaccgcttcgaaagagattgctgacggtaacacggatctttcgcagcgtactgaagagcaggccgccaatttggaagaaactgccgccagcatggaagagttgacctcaaccgtcaggcagaatgcggacaatgctcgccaggctaaccagctcgccgcttctgcatctgatgtggcaatgaagggaggcaaagttgtcggtgaagtggtacagaccatgagtgcgattaacgatagttccaagaagattgtcgacattattagcgtgatcgacggcattgcttttcagactaatattctggcgctgaatgcagcggtggaagccgcccgtgccggcgaacagggacgcggatttgcggtagtcgcgaccgaagtgcgcacactggcacagcgctcagcagcggctgccagggaaatcaaggatctgatcagtaattcggtgcacaaggttgaggatggtacccaactggtggatcaggctggtaaaacaatggaagaagtggtgctgtcagttaagcgtgtaactgacatcatgggtgaaatctcagctgcctctcaggaacagagccaggggatcgaacaagtgaatcaggcgattacacagatggatgaaatcacccagcaaaatgccgcactggtggaacaggcagcagcagcttctgaatccatgcgtgagcaggcagagcaattatcacgtgctgtggctgtattcaaactggagcagggattttcatccagtcatgcaggtaatgccctattgactgagcgacgcagcccgaaccgggcaactaacgttgagcggttaccacaagccaaaaatcagcgaaaaacggctgctgcaagtcctgccgtcccagcctcaactggcacggatggtgattgggaagaattttgaaatggggaacaaaacgtctgtctttataaacacaaaggtgagaagcgacctcttcctgccgcattgtattcgcagtcgtgatgacggtgatgaatctgtaatgctgcatgaataaaacaaccttttgaggaagcacgatcatgagagtcaatctgccggttaccaacgttgaacacgaaatgcgggatggcgaatttctcgtttccaagaccacgcccaagggagtgattacctatatcaatgaaccgttcgtcaggatgagcggctttactgagcaggagctgattgggcaggcgcacaatattattcgccatccggatatgccgccggaggcgtttgtcgatttctgggacatgctcaaacagggcaggccatggagtggtatggtcaagaaccggaatcaagatggcggttattactgggtctttgccaacgccacgcctgtcaaagagcatggcaaggtgaccggccatatgtcggtacgcagtaagccctcacgtgatcagattcaggccgccgagacactgtatcgtcaaatgcgtgaaggcacagcaaaagtacggattgttgctggaaaagtcattgccgatactcccctgggatggctacgtgaaaaatttcgccatctcagcctgaagacccggattatcggagccggtatcgtgccactgctagtgatggcaggatcggcctggttgatgatacaagatcaattcagtctggcttttgccggaatggggctgagcgcctgcctggcggtcgggatggggatgtggttgtatcactgcattcgccagccgctggataccatgattcatcatctggaaaagatggcgcagggggattacaccacccaaatcacgattgagcgggatgatgaaatcgggaagctgactgaagcgcttaaatccatgcaaattcgtgcaggaatcgatttcaccgaaaccaagcggatgaatgttgaaaatttgcgcgtacgtaatgcgctggatattgctacttctgcaatcatgattgccaataacagtgggatgatcattttcatgaaccggatggtgcgggaaatccttgccaaagaggaggatgaagcggaagtgcgcaaatccctgcaaagccgattgaaagctctggccagtcagcagcagattgataacgtcaggatcggagagcggacatattcactggtattgatgccagttaccagtgaatccggagaacgagtgggttcagtagttgagtggcgtgatcgtactcaggagttaacgattgaaagggagattatggatatcgttcaggcaggtgtggcaggggatttcagcaaacgcctgaccttgatcggcaaggagggattcttcaggcaactggccgaaggtatcaaccggttgatggaaagtacctcccagggattggatgaattggcatctatactggaagccatggcggaaggcgatttgacccagaaaattacccgtgattatcagggaatgctgggtagattgaaggatgattcgaattcaaccgtcactcaactgaccggtattgtcgcccagatcaaggaggcggtcggcctgattggcaccgcatcgaaagaaattgcggatggcaacacggatctttcgcagcgaactgagcaacaagccgccaatctggagaagacagccgccagcatggatgaattgacttcaaccgtgaagcagaatgcgagcaatgcacaccaggccaaccagcttgctgcctctgcttccagtgtggcagtgaagggaggacaggttgtcagtgaagtggtgcagaccatgagcgagatcaacgacagttcgaagaagattgttgacattatcagtgtgatcgatggtatcgctttccagaccaatatcctggcgctgaatgcagcggtggaagccgctcgtgctggcgagcaggggcgggggtttgcggtagttgcgactgaagtgcgcacgctggcgcaacgttcggcggctgcagccaaggagattaaggagctgatcaataactcggtacttaaggtagaagatggtactcagcaggtggatcaggctggcaagacgatggaagaaatcgtgcaatcggtcaaacacgtgactgacatcatgggcgagatttcagccgcttctcaggagcagagtcagggtatcgaacaagtgaatcaggcaatttcacagatggatgaaatcacgcaacagaatgcagcgctggtggaacaggcggcggcagcttccgaatcgatgcgtgagcaggcggaacagttatcgcgcgctgtggctgtattcaaactagaacagagctctttatccagtcaggcaagtaatcagccattcgttgaacgacgtggccctaaccgtgcaaccaacgttgagcggctatctcggatcaaaaaacctcaggccggaaaccagaaaaaagtggctgccaagggccatattgcatcgatacccaccggcacgggcggggaatgggaagagttctgaaatagaacacaacgcccgtctttgcgaatatgaaggtgaggaagcaatctccctcccgctgtctttgcgaggcgaatggctgaaacaatctagtagcaaggggataagggcactggaacactactggccgcattgtattcgcagtcgcgatgacaaaatcacttcgcaatgataagggaagaaagaaatgatgcatgaacacaaagcaccgtctttgcgagcgccgcagcccagtgaacataattcacgcgaatatgcattctctgcacgcgatttcgaatgtataaagaaaatgatttatgcgcgtgctggcattgcgctggccgagaatcgtcaggagatggtctatacccgtttgtcgcgacgtttgcgtgcaaccggcctgaaaaacttcagtgattacctggaacaactggaaagagacagcgaggacgtggaatgggaatccttcgttaatgcgctgacaaccaatctgactgctttttttcgggaaacacatcattttccaatattggctgagcatgtcaaaacgcggcaacccggacagaccgtaaagctctggtgcagtgcagcttccactggggaggaggcttattcgatggccatgacgatggtggaaacctttggttccctgaagccccccgtgcgtatcctcgccaccgatattgataccgaggtgctggctgccgcacgtgaaggtgtttattctctggacaggctggaatccatgtcacctgaaagaatcaggcggttctttctcaagggcaagaaccatacttccggatatgcccgggtcaggcaggaattgcgcgacatgattactttcagacagctcaatctgctggatgccaggtggcctatgcacgggccattcaatgcaattttctgtcgtaatgtcatgatttatttcgacaagccgacgcaataccagattttgcagaaatttgtgcctttactgaatcgtgatggattgctgttcatgggccattcggaggtatttcaacacgcttctgatctgatcaaactcattgatagaactgtctacaagccggttatcaaataacaacagagcggagctaggggtatgcatatctttgcagcaaaaacagatccgatgaattgccacgcaaccctatcctgccatggttgatcctcagtttgcttcaaatttctattttgatcagcgtttaaatattgatgcggtcaagctgttacccggggagtactttgtaaccacccgagagatggtgttgagtacagtactgggttcctgtgtttctgcttgtatctatgaccagcagagcaggataggtggcatgaatcattttatgctgccaagcagtgaaaatagcagcggattcccaattgaatgtgcacgttttggcggttatgcaatgggtatcctgattcgggaattgcttaaaaatggtgcgcgcaaacaaaatctggttgccaaggtatttggtggtggcaatgttcaaccggccatggttacttcggcgattggctcacaaaacgccagatttgtaaaaaaatatctggccgagtacgagattcccattctggcgggagatctggaggggttttatccacgcaaactgcatttttttcccaaaagtggccgggtattactaaagaaactgcacgtatcgcataacgataccattgccaagcgtgagaaacattacagccggttactgctatccacagtaaaaccgggaatatagacgaattctcctgaatattgaggggtacccatgaaaaaaatcagtgtgcttgttatcgatgattctgccttgattcgtaaattactggccgagatcatcaatagccaatcggatatggaagtaatcggggcagcaccggatccactggtagcgcgtgaaatgatccggacattgaatccggatgtgctgacattggatgtggaaatgcccaaaatggacgggctggaatttctggaaaaactgatgcggttgcggcccatgccggtagtgatggtttctacgctgaccgaatgtggctcagaaacgactttccgcgcacttgaactaggcgcaatcgattttgttgccaagcccaaaatggatattcgccatggcctcgaagcttatggtagcgagattgccagcaaaattcgcattgccagcacagcacgtatccgtcgcctggagcctggcgctgctgcgagtggtagagctttacagattccgcgccatcatagtatctcaaccgaaaagctgattattatcggtgcatctacgggcggtaccgaagccatcaaggatgtgctgattcattttccgccggattgtccaggtattctgattgcccagcacatgccggaaggatttacccgttctttcgctgaacggctggatcggctctgcagaatccgggtaacggaatccgaaggaggggagcgtgttttaccgggccatgcctatattgcgccgggccattctcatctcctgctgaaaaagagtggagccaattatattaccgagctgagtcaggcagatccggtcaaccgccatcgcccatccgtggatgtactgtttcagtctgctgcacagtgcgctgggaagaatgcggttggtgtgattctgacaggcatgggcaaggatggtgcagtaggaatgctggcaatgcatcatgcaggtgcctataacctggcacaggatgaagccagttgcgtggtgttcggtatgccccgagaagcaattgctgttggtgcgactgatgaagtggtgcccttgcaggatatggcctcacacatcctggcaaaactgactggtacagtcaggcaagctgttcgtatctgatgttattcaaggtgtttagctaaaagaaagttttttatttgtttatactagctcaccgaaacgtacatacaagataatcaatagtaagccaattacattgcgctccagccccttaccaacgagcgttaggccacttcttacaacacgccgaaactgggaaccataaatgcttcaaaccctgatagcccccatggcagcacacgtcgcactcgcagctaccctctactttcttcttactattgcgcgggctccggtcgtatggggaatcagccgtggtgctgatggcagcaacccttgggcagccttggagcctcgtatcagcgccaatttgtccagccagtttgagtggcctgttttctttcatgttgcttgcttgatattttttcaaatacagccggaccttattgctgttgtacttgcatggatctttgttggtggcagagtgttacacagtgctgtccaaatcttcacccgcaatattcggctcagaggcatcgtatttacggtcaacttcattgccgttctcggcctctggctcgttgccgttctgactgttggcaacgggtcggtgatctaacaactcattccagccatgatgatcagcgtagtattccttatacttattttcaataaattcagtgaacccttgctccagtgaccagtgggggaaaatgcatccccatgactaccagctgagtagtgagcagaaaagacagaaataatttaactctgactaacatggaatggtgcagtggccgaagtatctggctatgcgtttgctgctgcaaattccagaatctgtttatcacgcccgatcccggcaactgcaatggttattccatttttctgataacgcaccagacagtcacgagcggctatatcaccgtcgatttcaatcgcatcccatgattgggcatggccagcgtaattgatagtcaggtcgtaatgtacgctccagaaaaatggcacgtcctgaaattttttgttggcacccagtagattttcagctaccacttgcccttgtcgttctgctaccacccaatgttcgatacgtaacgcctgaccgcttgctttatcgcgccagcgggccacatcacctgcagcataaatttccggcacgttggtttgcagatactcgtccaccaggatacctttgtcaacgttgaggccggctgattcagctagtgtggtacgtggtcgcacacccacaccaagaataacgagttcggcagtcagcttgtctccattacttaatgtcactgattcaggttcaatggtcgtcagagatgtttccgtgtgaaatgtcacaccgtgtgcttcatgcaggctgcggatgaaattacccagctcggaacccagtacattttgcagcggactctgatcgagtgacacgacatgcacggcgagcccgcgtgcgcgcaaagcggcggccacttccagaccaatgaatcctgagccaagtactacgactgtcctggcgttttttgcatattcaatgatgcgacggctatcggaaaaagaacgcagggtaaatacatgtgcgccgtcctgaccgggaatgggtagccggatgggctccgctccggtggccaggacaagacgatcgaatgaaatactgcgatcatcttttgtagttatctgatggttggcggtatcgatatgttgcactacggtaccgagttgcagatcaatgtgattgtctttatagaagtcatcgggtcgcaaaggcatccattcttcaggcgccgtaccggccagataatctttggacaaattaggacggtcacaaggtgcgtcggtatcctcacttagtatagtgaggtgcccctgatagccgcgtcgtcgcaacatttcagcacaggaaaatcctgctgcaccacctcccacaatgacaatgtttttaggttgatcagctgctgcaattatcggttcgggttgtggtacaggagagattatattacgaacaaaaatacgctccccatcgcgctcgactttccagcaaggcagtggatcaaaagcaggtgcaccgagtgcctcgccgctacgcagtgaaaaacaagcgtgatgccaagggcaacgtattgttgcaccgacaaccagaccttcttccaaagggccaccgtaatgcgtgcaatgggcgccaattgccatgatttcattaccagtacgtaccagtattatggattcatcaccgacctgaccgcgcaatagctgttgatcaccaaaatcagccaaggtaatcccttgggtcagatcgaatcccatgttttctgttgtatctgaagacatcacaagcctcctttcaaaagtgtggatgtaaaacaatttagataagtatggcatatgagacctaacaggtaaaaaggcagatcggaaaaaatcgaagagtagggctgaatattgctggtaatttaggatttcagatcccagatcccagatcccagatcccagatctttactggtagacagtaattttaaagaacgaggattggtaaccattttttcacacactcgtccatgttgccaaaccagtataattaatgcttttttaatttctcaagaggaattccgatgcataccggtactacccttacccaatttatcattgaagatcagcgccacattgcgggtgcaagcggtgatttcaccgcgctactgaacgatatcgtgaccgccatcaagaccatttccaacgcggtaaacaaaggtgcactgattggtgtcatgggggcgctggatacggaaaatgtccagggtgaaacacaaaagaagctggatgtgatcaccaacgaaattatgattcgccataatgaatgggccggtcatctggcaggtatggcttcggaagaaatggacgatgtttatttgatcccgaaccggtatccacttggcaagtatctgctggtattcgatccgttggatggctctagcaacgttgatatcaatatttcggttgggaccattttctcgattctgcgcgcaccggtacccggacaggctgccagtatggaagattttttacagcctggcaccaagcaagtctgtgccggctatgccttgtatggttcttccaccatgctggtgctgactacgggtcatggtgtcaacggctttacactggatcgcgatatcggtgaatttgtgctgacccatccaggcatgaagattcctgctgacaccagggaatttgctattaacgcatctaatcagcgcttctgggaggaaccggtgcagcggtacgtatcagaatgcctggcaggcagtactggcccgcgcaatcgtgattttaatatgcgttgggtggcttcgatggtggcggaagtgcatcgtattcttacccgtggtggtatttttatgtatccgcgcgacaccaaggatccaagcaagcctggccgattacgcctgatgtatgaagccagcccgatgagttttatcgttgagcaggcaggtggtttgtctacaaccggctacgaacgcattctggatatctcgccagagaatttgcaccagcgcgtgcccgtgattctgggatcaaagaacgaagttgaggtggtgctgggatatcacaaagcctgacaatacctgatcgcccgggggaagcctatatctcgtcttatccccggttgtgcggccgggtataatcgatctccggccctttcgggacgatccgggttggattgatcatcgagtgactgtaatagtagtgagttttgatatgcccgaaatttgtggtactggcgatacctggcatttggtataacgcacgcaggtagttggataaattcggataatcctcgattcgctgtttgttgagtttaaaatggctgtaatacacgctgtcaaagcggataagggtagtaaatagccgccagtcggcttcggtcagctgatcacccgcgaggtagcgacatttacttagtatgttatcaattttatccagtctggcgaaaacctggttgtaagccttttcataagctgactgctcggtggcaaaaccggctctgtaaacaccattgttgaaatcccggtacaccacttcattaattgcatcaatttcattgcgtaacgcctcaggataaaaatccagatcattgccagttattgcatcaaatgcgctattgaacatgcggatgatttcagacgattcattgctgacgatcatgttgcgttgcttgtcccataataccggtacagtaacccggccggtgtaatccggtttgacgtgaatatagagctggtacagatattgaatatttgctatgggattgtcctgggagacttcactgaatgtccacccatgtttcagcatcttggggtcaacaacggtaacgccgatatgtttttccagatctttcaggagacgaaaaatcagggtgcggtgcgcccacgggcaggctaacgatacgaataaatgatagcgtcctgattcagcagcaaaaccaccgtctccggataggccgggttgtccatctgccgtgacccagttgcgatattgagcatgctcgcgcacaaattctccattttcagaggtgtaccactggtcatgccatgtgccatcaattaaaagtcccactaattatttctccggtttgttaggaaacattgcttgcagagtgtgatcaagtgaatacttgcctgcaccgtgcagcaggatacaaatgcttattaccattaagataagggagtattcgtagccactgtttgtgatgaagaaaccgtttgtccaatgtacaacaaccatcgcaaccagcatgatcagtgcggttcccaacgctgccgggcgagtcagcatacccagcaacagtgccaagcctccaaaaaactcgcccgaacctgccagcaatgccatcaaataacccgggctgaggccgattgaatccatccattggcccgtggcttccagaccgtaaccaccaaaccagccaaacagtttctgcacaccgtgtgccataaatgttccgcctgttgttacacgcagcagcagtattgccaaatcagttttatcatgtgttttcaagatggctgaaatcttcatttgcgatctcctgttagtcgtcttgctgttaactacttcgatgcattgcgatgggccttttgccatgtgctgggagtattgctatcggggctgagatttagcacagtgatttgtaatgataacaagataagtttttttcaagcgaattggttattaagtggctggtatgactgcaatatagccggtttattcatgcgtcttctggaaaatgctggaacggtattcgttgtcgcatgggtttatggtcattctcagtagcaggcttgattggatgttgggaattcaagatctaacacaatttcgctgttaccgaacgattttgcagattcagcgacatatacagtaattttgtacgcggacttttcttaaccgtaaactctaatggccaatctcatccggccgcccttcgagcctgtacggagtttccgtacaggcttttttcatgctgtaccctaccggacacagccactgattgcgctgctattcacagtgagggacatttaccattgtattcctgcgggtctagctttgcgtcacacaacctgaatttcctgcttcatgttgcgagtcatgcgtagtacatagaacaattcacttttatcccagggggtgaagcgtggcagctgaaagaggtcgctattctgccgggcagctccccatgctgttgaaacggcagcttcaaacccggcttctttaatcatttttatgtgtgcaggtagatagtcttttcccggcttgccatttgggtaggcaaacaggcgtactggcgcgccaatgattgcttcaagccttaccttgccttccgttatttccatatgagcagtcgtatcatcaatgctcgcaagtatcggatgggtgacggtgtggccgcctatttccattcctgcatcgtgtaaccgtttgacttgtgccgaagtcatcatgagattatctggtaattcggctgaaataatggtgctaagtttttctacctgagaagcccttgtttcatgagacagatatttcagcttgcctatcagaaaagttaaagctttcctcttttgttcaagcgtggtaattacatgaatacccagattgattgaacttaggtcaagtttatcccctttggcaaggcgtactgattcgatgacagtatcgttccacattcttccgccatcaagaaaaccagaagcaacgaaaaaagtggcggataccccatattgctggagaagagggagtgctatttcagcattatctgcgtagccgtcgtcaaatgtgatacaggcggcacaactgggcagggtgccgctgcgcaacctgtttactgcctcggataagggcagaacattaaagttattaaccaggtagttcaagcctgtttcaaacgtctttatcccgccgctgccaagcagaagatcaggttcgggtaaaacacgatgatgaataacaatagataactttgcgtttttgccggcaggtgaaaacagtgagggcagtattttcatgggaaacgtatttgtattttggtccaacctctttgataagggatctcggaataagcaaggatacaggcaattctgctgtatgaggtcagtgtcagcagtcattttccatgctatttaagggatttacagtatctcgggggtcattacggctcgcaggataatactttctcgctcatctttttgcttgcaactgaaccaccagacagagccctttcgtacactaaaacccgtttcatccccttttaacaggagagaggctatttctcccagcgttggttgatgccccactaccagtacagtgccttctgcctcaggccaggcaattgcattaagcactttgtacggagtggcaccagttcctacttgatcgctagtttcaaaacgggtagtcagtgccgaggcggtttgctgggtgcgtttggccgggctgactatgatgtgtgtatctggtggcaatttagatttcagccatccagccattttttgtgcctgtttcaaacctttttcagttaattcacgtgctgcatcaggaatacgatcttctgcttcagcatggcgccataaaatcagatccaaggttacactccttttgaataaaccagctcgggtattgtgttgattgaaatgatgtaaagccgacggtattgccgttatttaatcgcattcaggtgattttttcaaaaagtgtgccagtgagtgcggtaaatcccatggcaagtgccccccagaaaaccacgcgtgtagcacctttcaatatacttgctcttccaagataagcagccagtgtgcccagggcagtcaaggaaagaagggaggtggctgtcacaacagggataatctgtgatgcaggagcaatgatggttgccaggagcggcatggatgccccgagagtaaacatgcctgccgaggtgagagcggcgagaataggatttgcattgatgtgctcatgcaggcccaattcatctctgaggtgagcgcccagcgcatcatgtgccatcagctgtctggccacctccttggccagctcgggcttaacacctctcccgatgtaaatatctgtcagctcctggatctcataattgatatcccggataagatgatactgttcaagtgcgatatctgctttttctgtgtctgcctgggagcttacagaaacgtattctcctgcagccatggacatggcgccggcaacgagacctgctacgcctgccagcagaatatcctcagtacccgcatgcgcagatgctacaccaataatcaggctagctgtggaaacgataccatcgttggcgcccagtaccgccgcccgtagccagccggttcgatgcgagtagtgagtgttatcgtacgtcatagctatctgttttggtgatctgaaattaaagcttccttcagaatgttttttagccagcgggagatatcaatcagttcctggtcacatacagcgtgcgcaatcggatattcatgccagtcaacagagtaatggtaatcgcgcagcaactgtagcgaagattgggctaatttaacagggacaacaggatcataactgccatgagccatgaatatgggagtcaattgattggctacatgtgcctcctgtctgatctcgtgaacaagaggaagatatcctgacagaaccataatgccagccagcttgtcggggtggcgcaaacctacgtgcagcgccatagcagcgccctgcgagaacccggcaaggataatgtgactggacggaatacctctctggttttcatgttcgatcaatgctacgattgcgcgttgtgatctgtacaacccggctttatcttcctgcttaataaaatcagtgtgctggatgtcataccacgctctcattgtatggccaccattgatggtgacgggttgtagaggagcatgcgggaataaaaaacgaattggggtcgctggtaaatcaagtgtttgtacaacaggtacaaagtcattgccatcggcccccaatccgtgcatccacaagacggtatataaaggattcgatccggttgcgatatcgattgcgggaagctgaagcaggctgtcagacataggggtacgtgaaattgacgtggttggctggtagcgataaatttatcgggttcaatattatcattgatgaggaggcgtatgaaacgcagagattttttcaagttggttggtacaggcgctgcagcagctgttttggctccgtctgtttcgcgagcttccgcgttaccgttgaatcaggcgaaatggcgcggctatcaattaacgtaccagattactctgcccgccgcaggcaaggttgcaaagctatggctgccgttgccggatacaaatgatacgatttatcagtttacacaaggaagtaattggagcggaaaagcgactgcttctgcattttatatgttacccggtacctcttccccggtattttttgcaacctggcaaaagggtgaagaacgggcggtcaaggtgagcagtattgtcaaaacagcctatcgcactgctgatctgagcttttaccaggctcctgccaaagtttcaattccccagaatatcaaacgctatctgcagcctaccagccagattccgttggataacgctgtgaaaaaaatggcacattccgtgactagccaggctaatgcccatactcctttgcaacaggcgcgcgccatttatgactggataattaataatgttacctatgacaacagtgtgcgcgggcagggcagaggggatatacggagcatgctatccggagcaagtcttagtggaaaatgcgcggacatccattcactttttgtcgggcttgcacgcgcttccggcattccagcgagaatccagtacgggatccgcatcggtgaatcctctcttaacaaaaatcttgggaaatccggtgatatcagtacttcccagcattgtcaggcagagttttatctttccggatttggttgggttccagtggatccgtctgatgtggcgaaagtcatggcactggaatctctgccgaacaaccatgactcgatcagtcagctaagagaaaaattgtttggatcctgggaaatgaactgggtggcgttcaacgatggtgaaaatgtggatctgggcaaggcatgtgcagccggcaagctgccattcttcctctatccacatgctgaaattgacgggcgacaacaagatagcctggagccggaatccttttcctacaaaattacttcggcaacgctggtgggtaccggcgccaaactgtaactcggttatagcctgataattaccctgcaaggagggcgtttatcaggcatcggtaagcaatggctgtgctactgaacttggaaaaagaacatggctggcagctgtttatacagcaagagtagcttcttctgagtcactgctgtacgcataacctcacttttgtgagatttttacgcaatatgtagagtatcgccgcatagcatcagttagtcatttgaaaaacgtccttctgttacttcacgaataattcctgcgcgaatcgtaaaatcaccaaaatgctcgtcaggcaatcgttctgtcgcatagtgacgaagtacttcatcaagcgcttcaagaattgcggcctcgccgatattttcacgataaaggcgattgaggcgctggccgtgaaaaccgccacccagataaagattgtatttacccggtgcgcggccggtaagtccaatttccgcaatgaaagggcggctgcacccgttaggacatcctgtcattctgagcgtaattggctcatcttgcagattgtaccgagtgagaattccttcaatcttcgtaatcaaagtaggcagataacgttcactgtctgccattgccaagccacaggttggaaaagcgacacacgccatcgaattcagacgcagcacgctgtgttcattaaaagcaatcagtcccgattccaccagtaatgcttctatcttcggtttgtcggcagtggcaacgttggcaatcatgagattttgattgggagtcaggcgaaagtgccctttgtgaacatgtgcaatccgtgcaattttgtcgagcgtatcgcggttgagccggccgttctcaataaacaacgtgaaatgatgatagccatcatccgattctacccagccatagatatctgcattggatgtgaagtggtaagggcgggcgggttcgagcaatccggcacgatcttcgattgccagtttgatccagtccagtcctttatcatcgattgtgtatttaaagcgtgcacgtgaccggtcagcgcgattgccatagtcgcgctgaactcccatgacagcttcggtaacagaaataagtctgtctggcgtaatgaagccaataactgatgcggtgcgcggataggtatgcggtaccttatcggtacgccccattccaccgccgattgctatattgaatcccgctatttttccatctttacccacgattgcgatataacccagatcctgagcataaatatcaatatcattattgggcgggatcacaaatccaatcttgaacttacggggcatataggttcgcccgtagaatggttcttccggttcagatgaagcaatacgttcttcaccataccagatttcatgatagcccctggtcttgggaatgacatgattacttactgtttttgccagtgctgctagttctgcctgcagagccggaaattgaggattaaccgtagccattacaccgcgtgaatcatctccgcatgcagcaactgtatcgagtaatacttcatgaagaccacgaataaccggaacaatattgtgcttgagcacccaatgaaactggaaagtctgtctggtggtcatgcgtaacgtttcattaccgtgcgcacaggcaagctctgaaatcttcagccagcgttcggttgtgcagataccccccggcaaacgcacacggatcatgaactgaaaagcgggttccagtttttggcgacggcgttcatcacgaacatcccggtcatcttgttgataaataccgtgaaacttcatcagcttgatatcgtcgcctggtacagcagatgtaatacggtcaagtagtccaagtgcgattgtgccacgcaggtattcacttccagccttcagtgcctcatccgggcttaggcgctcaagtggttgggaaatatcgcagctgcgatcagtgggagggagtgtgtctgccatttctattctcaataaacgtcgcgctgatagcgcccatcgcgttgcaggttgcgaagatactcttctgcttcttcgcgctgaacgcttgcttgttcttcgattacggtgaccaatgtattgtggacatcaggcgccaggcgtaacgcatctccacatatataaatatgtgcaccttcttccaaccaagcatagacatcgtgtgcatgttcatgaatgcggtgctgaacataagttttctctgcgttatctcgtgagaaagcgacatccatttttgtcagaatgctattttttaaccagtcctgccactcagtctgataaagaaaatctacacggaaattgcgttctccgaaaaataaccatgaacggccaccgccatttgcttcgcgttcttgcataaaggcacggtaaggtgccacaccggtaccagcgccgatcatgatgatgggttcgccgttgggtggcaggcggaagtatggattactctgaatgtagaccggtaatatggaatcagcgtttgcacgatcagcaaggtgactggatgcaacacctgaacgaatttctccatgcagcttataacgtactggcgcgacagtgatatgtgcctcatcagggcaaattgccaggctggaggaaatagagtagaggcgcggttgcagagggcgcaatccgtcgataaaacgctgtggatcaagaccttttagcggaaaagcgcgaataatatcaataatatgatgctcatgaaggaatgccgcacgttcgacattatccattgcagtaaaaatatcggttgtgccagtcaattcaccccagtgatcaagaaaacgcagtgttgctgtggtaatttcgaataatttgctaagcgcttcaaagagtgttgttacctgaccctttacggtcagcgatgtgcctggattcatgtcgagcgtggtcagtagtgcctcaaccatcacaggatcgttgttcgccacgatgcccaacgcatcgcccggctcataggttaaagcggaatcagcaagtgatatttcgatgtggtgtgtttcccgggtagagccgcgacccgagagaacaatgttgtcaatgacagttgcagggaaggggtttcgtttaccgtaagctgaattatcagcttgctgagtacttcctgttgtctctagttgtgatgcggcggatgatgtcgccgctcttttctcggcggtgagtagcgccagtatattgctactccatgcagcagccagttcttcataatccacatcacagtcaatgcgtggctgcagccgttttgcgcccagttcctcgaaacgctcatcaagacgtttgccggcgccacaaaaatgttcatagctcatgtcgcccagcgcaagtatggcgtaacgtagttcaggtagtgctggcgccttgcggctttcgattaattcaaaaaactccattccagactgaggtgggtctccttctccatgggtggaggtgatgatcagaagatcctgctcttctttgagtttgcgaactttgtaatcagctatgtcaaccaatgtcgggttgagtccttgttcaatagccagtgctgccaaacggattgccagttcggtgctgttaccggtttcactgatatgaaggattgtaagtgaacgagctgcaactggttctgcttgtactactgctgtggaaatgcgtgtatctggagattgagccgcagtagtacccttgtgtaacaaggctgacccaatgccagcaaagtaaccgctgatccaatacgcatgttcaggtgtaagagaagagcttagtgcttcgacaagacgccactgttctgcagtcagagcggctcctgagaattgtgataccgtcattttattttatattttggaagtttttcacacgtagaaatacgtagaaatgagatatccagctggtggttgaaattttgtagatatggcaaatcaattaaaaacccgtttacgcctgtttcagctttgctgttacagcactctttaaataaagagtgcaagcatagcaactatttttataattcaaaagaatattaaattaattatatatcgtattttgttatatgaagtatatctggatggccaaagaaattaataatactaattaattataaaataatagggagcgtgagctatcctggctcccggtcggaaatttattcttttatggtgctagtgctcgcttattcagctttattgttgcgggtgttgcaggctgtcaggcggaacgtgtatttcagcaatatttatgttgtggtgccgcctctaatttccgaagaatatactgaaattttaaggggcggagtctaccagaaagcgttctagtcatcaatccggacagggtgggagcctttttgtctatgccaattgttactaccaatagcagttagttttcaggatttctgagcagcctattgatcgtttctgtatcaagatgtgtcgcaaacatctcaataaaatcgtaaatgtagtggcggatgtagctgttgcgacagataccgatgcgagtagtactgggttcaaacagatgtgcggcatcaatggcccgcaactttttatcgcgagccggatcaaaggccatctttgccagaatgcctacgcccaaaccgatttctacataggttttgattacatccgcgtcaagtgctgtcagtaccacgttgggctttagtcctctagattcaaatgcctgattgattttggatcgaccggtaaaagcaaaatcgtaggtaatgattgtgtattgagcgatggattcaagcgttaactccttaagttggagtagtggatgctgaggtggaacgacgacacaacgattccattcataacaaggcaacataacgagttcgtcgaataattcgatggcttcggttgcgatagccaaatcggcttcaccagatgaaacccaggtggatatttctatagggcttccctgtcgcaaggataatctgatttttgggtggcgttcgataaagcgcttgattacaggagggagcacatatcgtgcttgtgtgtgagtagtcgcaataacaaatgtaccgctctccttatcattaaattcatttccaatttttttcaggttatctgcgtcctgcagcattcgttgggcagtttccaggatcgcaagccctggctgagtaatactggtaagacgtttaccgtggcgtgtaaaaatctcgactcccaactcttgttccaatagctggatttgtcgactgaccccgggttgtgaagtatgcagagcattcgcagccttggataaattcagcttttgttttgcaatttcacgaaggtatctcaattgctggagtttcatttatataacaaaatataatatataattaatttaatattcttttatattataaatattattgttatgcttgcatatatatttaaagagcaatgtaaaaatgaggtcatttgtgttgtttgtgtatcattcgaagctatgacaagtagcgtagcgtaaggattcacatcgggttggcgtgcttatatagattttttatggatatgcgtttgtcaggtaaaataacgctttattaatatggatgagcaaacattgcaacagaaggttgagcagttacacagtttgttaggtaatatccagcgggattattctcccgctgtatttgccaacagttttggtgctgaagatatggtattgactgatgtaatcgctcgccatcatccggaaattggcatatttacgcttgataccggacgtcttccacaggaaacttatgatctgatacaaaagacgaaggagcgttatggtgtttccatccatgcttattttcctgattcatcgtctgttgagaactatgtgacgcaatatggcccaaatgggttttatgaaagtatcgatctgcgaaaacgttgttgctatatacgaaaagttgaaccgctaaagcgtgctttggctggaaagcgtgcctggattacaggaatgcgtcgcgagcaatcaaccacccgggaggagctgaagttatcagtatttgataacattcacggtatacataaatttaatcccttgtgcgactggactgagaaggatgtatggaactatataaagcagcacaatattccctacaatgcgttgcatgaccaattttatcccagcatcggctgtgctccatgtactcgggcaataactcccggggaagatattcgatccgggcgttggtggtgggaaaacccagactctaaagaatgtggtttacatactacaaaagtagaaacataagttaatgttcttaaatcaaaataaaatgaatcaacggtcatattttacacatttggatgccttggaaagcgaggctatccatatcatgcgagaagttgcggcagagtgtgccaatccggtactgttgttttcagggggcaaggattcggttgttctgctgagactggctgaaaaagcctttcgcccgagccattttccttttccgttgatgcatatcgatacgggccataattttccggaagtaattgaatttcgggattatcgggccaaacaattgggagaacgcctgattgtacgcagcatggaggattctattcagcgtggcagggtcatattgcgatccaaaaaccaaagccgcaatccttttcaggcagttactttactggacgccatttcagaattcgggtttgatgcctgcattggcggtgctcgcagagatgaggaaaaagcacgtgcgaaagaacgtattttttcgtttcgggatgagttcggtcaatgggatccaaagaatcagcgcccagaattatggagtctctataatgcgcgaactcaccctggagaaaacatcagggttttccctatcagtaactggacagaattggatatatggcaatatatcggccgggaacagctggaaattccatctatctactatgctcatgagagagatgtaattatgcgaaatagtagtctgctgccggtgtcgtacctggttcagcccgaggcgggggaaagtgtacaacatatgatggtgcgattccgtacggttggtgatatgagctgtacctgtccggtcgcttctcaggccaggggtgtcgaggaaatcatcgtggaaacagcattaacacgaattactgagcgcggggcaacacgtatggatgatcgcacttctgaggcatcaatggagttgcgtaaacgggaaggttatttctaggacagtgttctgaaataacacccggttttaattttttatcttcataggtttttctaggacatggctgctgttgaaaatattgaacccgatcatgccgagctgctgcgatttattagtgcaggcagtgtagatgatggtaaaagcacgctgataggtcgtttgctgcatgattcaaaatccatcttcgaagatcagttgagtgctgttaccaaaacctctaacaaacgcgggatggaaaaaattgatctctcgctttttactgacggattgcaagcagagcgggagcagggaatcactattgatgtggcgtatcgttatttcaatacacccaagcgtaagtttattattgcggacacaccaggccatgagcaatatacgcgtaatatggtaacgggtgcttctactgccaatcttgcaattgttcttatcgatgcgcgcaagggagttttgacacaatcccggcggcacgcctaccttgccagtctggttggcattcctcatctggttgtggcaattaataaaatggatctggttggctattcccaggaaatcttcaagcagatttgtgctgaatttgctgtgtttttacaagggctggggtttcgttccattgaatatataccaatatctgcgctacttggagatatggtcgtggaacgtggtgacaaccttgactggtattcgggcaagccattattggattatctggaatccattaatatagaacacgatatcaacgtactggattttcgctttccggtacagtgggtatgtcgtccgcaaacggaagaaatgcatgatttccgtgggtatacgggtcgaatcgaatccggaacaatacgcgtgggggatgcagtaacagtattaccatccggattaacatcccgcatcaaagaaattcttttatataacgacagctttgaaaccgcttttgcgccacaatccgtcatcttgaccattgaagatcatctggatatctcgcgtggagatatgctaatcaatggtggagagccgcctcaagttaccagggagtttgatgccatgctctgctggttatccgaacaagcatttgaccccgatcgtaaatatattatcaagcataccactcgtatcgttaaaggattaatcacccgaattgactatcgagttgatataaatacaatgcatcaagagccagttaacattttgacaatgaatgatattgctagaattggaatgagggtacagcaaccactcgtcattgatgcatatgccaaaaatcggggaaccggttgttttattctgattgatgaagtcagcaataatactgtggcagccggcatgatttgtatccgagaaagctgattacattttctaaaccgaaaattattccagtcaataaatacctgccatctgtttattcctatttttgtattagaaaaatatcctggatatttgactaaaatatatgattgattctcaatcaatgcacaattattcctcaataatatctgaccccaggcttgtccttgaatttggcatgtcctttccggaactgtatgaacgagttggcctggttaaactagatcagatattcctgagttttcttggagaaggtgatcccagattatgtgatcggctgattcaggcacgaaagcattcagggcaactgtcacccaaggatgaatccgctttgctgattgaagtggctccctggctggaagactttgttgcgatattgtttggcattaaaagtgaggttaacaccttagctgcgcgacatcatgaactggcacccctttatttctgtaaacgtcagtttgtacagcggcgtgccaaaaccaaggtgagtgatgagatattgcaaacactgaatggcctggagctggaacgaaagttggtggaagaatttggccagcctttttcggagcttatttttgcatctcatgttgctcactggatgacggatgaagcaaattattcggtacagcttgagcttgcgttgcattatgccgcttgggcgttgcgtacatctgcagggcaagtgcatactcatcagggtattttattcaaatctccgcgtaaactggatccgaaacatctgctgtcattggagagtgatgattgcaatggatatatgatgcaccgtcttgatcatgttcggtatcgtgaaggtttttcactgacagatcatggaaccgatttgacaggcgctctggatgaggcgaactattgtatctggtgtcacgaacaaggcaaggattcctgttcaaaaggattcttgcaaaaatcaaaagaaattccagaagtaaaaacctttaaaagaaatgatctgggggtgttacttgccggctgtccgctggaagagcgtatttcagaatttcacaagcttaaaacccagggggttgcgattggcagtttggccatgatcgtgctggacaatccgatgtgtgcaggaaccgggcaccgtatctgtaacgattgcatgaaatcatgcatttatcagaaacaggatcccgtcaatattccccaggctgaaacacgcacacttaaggatgtactcgaattaccttggggatttgagatttacagcttgctaacgcgctggaatccgcttaatttgcacagaccctatcccaaagcggcaacaggcaagaaagtgctggtggttggtatggggccggcaggctacacattgtcacatcatcttatgaatgatggccataccgtagtgggtgtggatggattaaaaatagagcctttatcagccaatatctctggaatagatataaaaggcgagcgtaattcttttatgccgatttacgatgtcaagcagttaagcgaagatctagatgaacgattgcctgccgggtttggtggtgtagctgaatatggtattacagtacgttgggataagaatttccttaaactgatccgtttattactggaacgtcgttcagaatttgctcttttcggtggggtgcgctttggaggcacgctgactgtcgatgatgcatggcagctaggatttgatcatattgcactagcagcaggcgctggacgtccaactattttgaatatacccaacggattagctcgaggcgtgcgagctgcatctgacttcctgatggcgcttcagctaacgggagctgcccagagcaattctatcgccaacatgcagttgcgtttaccggtggtcgtgatagggggtggattgacagcaatcgatgctgcaacagaagcgctggcttattaccccattcaggtagaaaaattcctgaagcgctatgaaatattggcagcagtacaaggagaggctgtaatacgcgctagttgggacattgaagagtgtgaaattgctgaagaatttatgagtcacgcacgagccatccgtaatgagaaagctcaggcgggacaggaaaatcgcgaacctcgtgttgcggcattgctgcaatcctggggtggcgctatagttgcttatcgaaaacgattgatcgacagtccttcctatacgctgaatcatgaagaagtagagaaagcgttggaggagggtatctattttgccgaaggcctgactccattgaggattgatattgatcaatgggagcatgttcaatctatctgttttgttgttcaggcagtggatgaggagggtaattggtataaagtgagggaggtagttcaacctgctcgaacaatattagtggccgctggaacccagccgaatactgttctggcacgtgaagactcacagtatttcaaactgaatggacactattttgcttcttatgatgaacaaggtcagcctgtagatgtcattaaaggtaatcccaagcctgagacgcccgcggtattattgagccactctagtgatggacgttttatcagtttctttggtgacctgcatccatcttattcaggtaatgtggttaaagcaatgtcaagtgccaaacaagggtatccagtggtcagccgagtgcttgctcagattgatcccgtatcagtacaaaccgcttctcaatttttcattgaaattggagatgagttgcgcgctaccgtgcataaggtggaacgcctgacaccaaacatcatagaagttgtcgttcatgcacctttggctgctcgtcattttcgccctgggcaattttatcgttttcaaaattatgctttatttgcaagaagttctgagcaaacccgtttggctatggaaggaattgcccttacaggcgcttcagttgatacctcgaaaggtttggtatcattgatcgcactggaaatgggtggatctgcaaatttgtgctcgttacttcaacctggtgagccggttattttgatgggtccaaccggaacaccaacggaaattgaatccaatgaaactgttatattggttggtggcgggctaggtaatgcagtattgttctcgattggtgctgctgcccgggttgctggttgtaaagtattgtattttgcaggctacaaaaaattggctgaccgctacaaagtggcagaaatagaagcggcagccgataccattgtttggtgcagcgacgaatcaccaggattccaaccttctcgtccaggcgatttgagttatgtgggtaatattgtgcaggcaatggttgcttatgccaatggtgagctgggtcacacaccgatttccatgcaggctgccgaccgtattatagcaatcggctccgatcgcatgatggcagcagttgctgctgcacggcatcagcaactggcaccttatcttaaagccggacactttgcagtgggatcgattaattccccgatgcagtgcatgatgaaggaaatctgcgcgcaatgcctgcaacctcaaaagaatcccgagacaggcgagatttcatacgttttttcctgctttaatcaagatcagccattggatctggtcgatttcagtggattagcttcacgtttgcgtctgaatagtgtgcaggaaaaactgacaagtcgctggattggacattgtctgcaacacagtaataatcatgcatcttagtcagatatcatgaatgctgccaaaatcaatctgttttaaattgatttagaatttgatattaaattgaatgagtgtgatggatttttctgtggttgtcagtacgacaatttttgattaatgaattaataaaataacaagggagaacatccatgcacataggcatacctgccgaaacgcgtgcaggagaaacacgcgtggcggctacgccagaaaccgtcaagaaattggttgccaagggactgcatactgttctggtgcaggcaggagcgggcataaacgccagcatccctgattccgcataccaggaagcaggtgcagtaatcgtctccggtgcttcgcagttatatgaccaatcccagatcatactgaaggttcggggccctgaagccagcgaactggttcatatgaaaaaagatgcgatactgattggtttgcttgcacctcatcttgcagaggaaattgagatagtagcccggcatggtgtcactgcattcgcgatggaaaaactaccccgtatatcacgagcccaaagtatggatgtgctgtcttctcaggccaatattggtggttacaaagcagttattctggctgctaatgtataccagagattttttcccatgctgatgacggcagccggtacggttaaagccgcacgtatgttaattctaggagctggtgtggctgggttgcaggcgattgcaacagccaaacgcctgggtgcagtgattgaagcatttgatgtgaggccagcagtcaaagagcaggtagaaagcttgggagccaagtttgtggaagttccattgacggatgaggaaaaagctaaagcagagactgctggcggatacgcggctgaaatgtcggaggattacaagcgtcggcagagcaatctgattcatgaacgtgctgctgctgcagatattatcattacaactgctttgattccgggtcgcccggctcccatcctgattagtgaagaaacagtcaaggcgatgaagcccggctcggtaatagtggatatggccgttgaagcaggtggaaattgtccgttatcagagcttggcaaaactgtagttaaacacggcgtgcatttggttggcatagcaaatctcccgggattggtggcgacagacgccagtgcgttatatgcacgtaatctgttaaatttcctgaatctaatactggatacacagactggcgagcttaaaatagatcgcgaagacgagattgtcaaaggaagcctggtctgtacggctggagaaattataggtaaatcataaaagtcggttgtattgtttacacataaaatttatgaatctctatgaggaaaacacatgattggagaaattgatccaacgatcattaacctgacagtatttgtcctggcagtttttgttggctaccatgtggtgtggaatgtgacacctgctcttcatacccccttgatgtcagtaacaaatgcaatttccagtatcattctggtcggagcaatgttggcagcgggctcagctgaagcggactggggggcgtggttaggggctgcagccgtggtcttggcatccatcaatgtattcggtggatttctcgttacccagcgtatgctggaaatgtttaagaaaaaagataaaaaaggacaagcctaaatgtctgttaacttcatcgcgctggcctatctggtagcggctgtattttttattctttcactcaagggattaagttcgcccactgctgcacgtcgtggcaatctacttggtatgttggggatgggtattgctgtaagtacaaccctgaccattactggaaactgggtgctgattttaagctgtattgctgtgggtgcaatcatcggttcaattgtggcacagcgtattcagatgactgcaatgcctgaactcattgcgttcatgcattcgcttgttggacttgctgcggtatttattgcaattgccgctgtcaataatccggtttcattcggtttgccggaaatattacctgctggtaataaacttgagctttttctggggactttcatcggtgccatgacgtggtctggatccgttattgctttccttaagttatccgggcgcatgagtggcgcaccgattatctttagtggccagcatatggttaatttgttgctggcaattgtcatgatcagttttggcttgtggtttttctttagtgaaacaacgaactggactgcattttctacaatgacagcggttgccttcctgttgggttttctcattattattccaatcggtggtgcagacatgccggttgtgatttccatgttgaactcatattcgggatgggctgcagcaggaattggtttttcgcttgggaacccgatgttgattatcgccggatctctggtaggtagctctggcgcaattctctcttacattatgtgtaaggccatgaaccgaccatttctttctgtgattcttggtggttttggtagtgatggaggaagccagagtgctagcgatggggcacagaaaacctaccgtagcggtagtgcagatgatgctgcatttttgctggggaattcggacagcgttattatcattcccggatatgggctggccgtggcacgtgctcagcatgccgttaaagaattagcattggcattgcataaaaaaggaatcaatattcgttttgccattcatcctgtcgcaggtcgtatgcctggccatatgaatgtactgcttgcagaggctgagattccctatgagatggttcaggaaatggaagagatcaacagtgatttcccgaataccgatgtcgtactggtattaggcgcaaatgacgtagtcaatccggcagcaaatgttccaggaagtcctatttacggaatgccaatcctggaggcatataaggcacgtacagtaatggttgtcaaacgcagtatggctgctggctatgcgggcttggacaatgatctcttttatatggataagaccatgatggtatttggtgatgccaagaaagtcgtggaagatatggttaaagcactttaattaagtcgtagtgttattactctaatagcccgatagctgtttctcagatttatttctggaatccagccactctcgggctgttttttgtgctgatgtaagttgtactctactgagtgaacgcatggctttatcgcgtgccaatgctgcctgctctataccagctgcagcagccagattgaaccatacataacttttttcactatccatttctacgccttggccaatttgataaagcaggccgagttcatactgcgcaagaggatgattttgttcggcagccaatatgaaccattttgaagcttcagagaagtcttgaagtgttcctttaccagtcagatatagtaaacctagttgatattgggcgtcagcgctgccttttctggctttttcaaggaaaaggctaatcgtatagaatcgattgtcactgaggtttggtacagaatgagattcttcacttctgatcgattcaagattaattttctctccgcgcgcaattgcctcagatagcgttggtttcgttgatgcaataactgatggagattgaggagaacttcgaagtaattctgcagaagccgcttgtggttgagattgcaggttatttcttatggattcgtcagtagaaaacccaatccagattaatgttcccagcagaaatatactaccgacacttattgcagccacaaaacaagtatcattatttcgaccccagaagcgtgccttgcagtcacgacagcgatagggagaaagtaataagtttgaaggagtacgctcacctggcctgaaacgggatttatgcgtccggttactaccacactgagtacaattaatagtcataatactataagtactaagttagaaatacagatattaataaaatagcaagttagacttgtattctatcagcacatttctaattttgatcagtaatagacaatatgcagacgattgcatacagaagcagcactggctgaatctaactggttaggttggacccagccacatattcttaccctgatacaggaggtgtgttgcttccgactctcgatgccttgttgttctcagttataaaacaaccctgcagacgcatatttgacggcaggccagatgacaagctattaaatctggctctgcagccagttctgaaggccaatattttgaattacgtcttgctgtgtttccagccagtcgatatgctcttctgtatcttccagaatttctttaaaaatttcacgtgagacataatcctgtgctgtttcacaagcggctatcgcacttatgagagtttcccgacctgcacgctccagctcaagatcacaagtgatacattcttgtgcattttcaccgatcattaatttcccaagttcttgtaaattaggcaagccctcaagaaaaagaatgcgctcaattaattgatccgcatgcttcatttcttcaatagattcttggtattcatactcaccgagcttgttaaatccccagtttttatacatgcgagcatgaagaaaatattgattgatagcagtcaattcgagctgtagctgacgatttaaccagcgaattatatcggcattacctttcatgattttctctctccggatgattagcctgcaagcttcagtaagtcaaaaggactttaggagggtcttgcagtagtttgttgagaaagctcctggttcaataccttatccaaggttaccttggcgtggcaagcacaaataccacattgaccggtaacgcccaagcagctccttagatcacgcatccttacggcaccttgttttacggcctcgtgaatgtcgcgttcagttattcccttacatacgcaaatatacatgaaagataacttttgtcgaataattttcagaaaacacggggtatactcaattgattacagttgcaacaaccctaatcagtaatgagaataattcttaaaattatattcatctttgaaaattttgcaactggtaatttttaatccccctgcataactgttcctattggtcaaagaacccttaaaatggagagatataaatatctgatcaaatttgcaagatgtggatgagttttgaattgatcgagttggcacgtcgtttgaagcaagatagagcattgatgaagattgataggttggttgactgaaaacagctacggtcgggtttaggtggtttatataaatgtaaatgggatcaatcaccgccagtagcgggcaagaatcatttgataccctgatgatgcttaaatgttgggcatgagaaaaagttattcaggcgcacactgttgaccttttcgactgtggactgtggtgtacatgtttaaaatgggctaccaatggtgagtgtttcccggtgactacccgaaataggaaacggtttacgcgtattctccaaatggaaaaaacctgacgtcgatggcatctgtgacaaccgcggacattaccgaccgcaagggcgctattgctacattgacgccaggcacacaccgactgtccagcgtattgagcatctttgcggattctggctacacagctcaaccacctatcgaggtagtcaggttgtgtttaggtgaggtgatcacggtgcagattgccaggagaagtgaaccgcacacttttgcggtcattctcaggcgctggattgtggaataaactttttcatggctggaaaaataccggcgattatggaagaactgcgagcgcaaactcaataccagcttgcaatttatccacctggcacttttagcactattgccccagaagagcataaacaggttctcatgacgtttccataaccactggttgcccaggcttacaaaaacaaatcactttcagcccgacaaacgcatcagcaaaaaacgccaaatatcgttgagcggtgttttagcattgccaaacgcttatccggaatgaagcatgccagctacttcagcacgataaaaatcaacgcccatatcatcatgaaatgtattggtatgaatctgaaaaaagtagccaacaaaatttttattaatgatccatcagcaggaaaaacctgtcctgttacagcataaaggggggatcccctgaaaaatgaggaagacttctctttttcccagaatcaatcggcaaaaaccacttcagccaaatctctttccccgctcttctgtagaatttcaggggtatgcagggatcttttatatatttgtgtaaaaatgttggctactctgtaacgggggtagtaaaactttactgccaggagtgtgcgagcagcaaataacatagggcgatgtgatttttatgatttttcatcgataaattgcttttgctcagtgagcatagcttcaatgatgcttttatatttatttctaattttgtatgaatctacatttatgtattcccgccttattctggccagataattcgcaagtagatatttaccgtcacctggaattgtcggcattggaaacaatgcttgcaaaaagcttctgtactgaagatccaggacactccgtagaatcttggctatgcgaggtttttaatgtacaaaaacagcatgactggcccgttgctcccatagtgctgcagttggatagaggatgtgctgaatttagagataattattggttacgcgttgacccagttcatctccggattaaaaacaaccatatacttttgggcgataaccacattttgaatatttccctaaaggaggcaatttcatttaccgatagtattaatgagctaatttcagatgatggtttgaccctgctgccccttcattctgaccgttggtatctgcagtgtagtgaaatacctgagctgcgaacatttctcttgagtgaggtggttggtcaaaatataaataatcttctacctcacgggaatgatagttcgatctggaacagcagaatcaatgaaatacaaatgcttttatatgagcatccgttaaatcagataagagaagcccagggagatctggtggtcaatagtgtatgggcatggggaggaggcgttatgccccaaaaagtgcatacaccctataccagaatttggagcaatcacatccttgtttctgctctggcagaaatgggaaaaattgtgtgtcataatttgccggaagataccggcgagttactgcgatactctgatgattcaggtgaacaattggtatttctggataatctccataaatacgccaattacagggatgcattcaattggagaaatgaattgatgaaaattgagcagagctggttcgctccattacttcaggcactgaaaaaaaagcaaataacacagttaaagcttacagctatcagtgaacattcaaccagaagtttcacgttgacacctggtagcttttggaaattttgggcttcagtacgtccgtttggatcttatagttagttgtggtcagtttgggggaattaaatttttttaacgagactttcctcatagctatgtatatccactcaaaaatcaatacgattaaaccttttttgccgacggctgtaacaatggttgttgccggtttattgatcgcgctggattattccatgctctctatcgagccacatatcattgtagggctatgggtaattctggtaacagcaatcctgattacaattattcagattgtgcatgctgaaaaaatattttcaatacaatttgcacagttgactgctcaaaaagaacgtcttgccaatgaaataaaatatcgaatctgggccgaaaaaacttcttcggagaataaagctaagctacaaattgtagatgagaattttccggtcatgctagcttactttaatccggagcagcaatgccgctatcacaatcgggcttttcgtcaatggttcggattaaggtctgaacaaatagaaaatcgatttttgcatgagtttctcagtggatcattttatacccatatcaagcatgaagttggacgcgtattatctggcgaaacggtgcaaaatcaacaagttcagctacttataaatcaatctgcctgtttggttaccgcccatttaataccgcatttcgattctggcggaaaggttatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactataggtaatcggattttatactctttatacacctcggtttatgaagaaagatgaactgtctctggagagttttaaagaaaaatctgtatctgagaatgagcaatcgtggaaaagaaagcttacccaacactcaggtggagatgcaacacatcaaccggcacaagtatctatagactcatccagccgtattatcctggctatcgagcaagaggagttccgtcttttttgtcagagaatactgccggttaaacctagtcagaatgctacaacctactacgaaatccttattcgtatggcagaggaagagtctaatcttattcccccgggcgcgtttctcccgcttgtcgaaaaacacaacctgatgccgcgtctggacggatgggtcgtgaagaaaattatccaatacctttcaaaaaagaatgttagtactgaaatttcattttgtataaatttatctaacagcacacttaagaatccggcgtttgctgatcacgttcaagatctcctgaagaacgccaaagtaccgcctgataaattatgttttgaaatagaagcatttgatgttatagctaattttcaaaatacagtactattcgtaaagaaaatacagcaattagggtgcctggtttcattatgcagcttcaatcatgaccgtacatcatttaatttgctgaagtacatcagggcagattttttaaagatagatggcagcatagtttgcaacattttacgtgatgcggaagatctgaaaaaaattgaaaatatcaacaaatttgcgcgtgctctgaagatcaggacaataggagagctggtagaaacacaagctattctggaaaaactcgcagaaattgggatcgattatgctcaaggatttgctgtcgggcagccgcatccgattgaaaccatcagtcgctccgctatcaacttaccatgagttgcaagtatattaattactgtgccaacacttgatatgcttcttgatatttttctactgtttgcatgagaatttcagccgggatagcaggagcaggtggggttttgttccagccagtttgttccagccagtcgcgaataaactgtttgtcataactgggtggggttttaccaggctgatagccttcagcaggccagaaacgagaggagtccggggttagtgcttcatcgatcaggtaaagctgatcgttatcatccaggccaaattcaaacttggtatcagcgataatgatatttcgtgtcaatgcatagtcagctgcagcactgtaaagcgcaattgcatatttgctgacaactgaagcaagcggtgctcccaatatttgttcacaagaagcatatgaaatattctcatcatgtgatcctgcttctgccttagttgatggtgtaaaaattgcaccatcaggaattttgtcagcctctcgtaacccctcaggcagggtaacgccacaaatggtgccgctgtgctgataatctctccagccagaaccagaaatataaccgcgtacaattgcctcgacagggagtggcttcaattttttaacaacaaaagcgcggtctgtaacctgatctcgctctccaggcagaataacggattcaggtggtatgtcggtaaggtggttggggataatgtgagctagtttctcgaaccagaaacgggaaatttttgtcagaatcttaccttttcccgggatcggggttggtaatattacatcaaaagcagaaatgcgatctgtttgtataatcagtaggttattttcatctaccacataaatatcccgtacctttccccggtgtagcagggggaggcttgttatattggtttcaaacagcgtcgcagttgtcatagttgattgatggggagcttatttctggtgtgttgtattaggattgaagatcatgcctgatatgctgagcttgcagaaaagcttcttcagttgagtctgctagtacagtgaaatgccccattttcctgcctggttttgcttcacgtttaccgtacaaatgcagcttggcttgtgagtgacgtaatatctggttccaggcaggttcatcattttgccataagtccccgagtatattaatcattacagcagcctgtacctgttttgtgctgccgtgtggaagcccacacaatacgcgaacttgttgctcaaattgtgaggtgatacaggcatcaagcgaataatgtccgctgttgtgcggacgtggtgcaatttcattaaccagaacctgatcattattcagaacaaagaattctacacacagaacgccaatataattcagccttatagccacttgtctggcaatttcacaagcttcttcaataatcttgtcagataacccggctggtacaatgcttgtatcaaggatacctttcacatgcctgttttccgggacaggaaagaaagtaatgcgattgtgattatcgcgagcaaggataacggaaatttcatgggcaagcggtaatcgtttttccagtacgcagggcctgcttcccaaatcagcaaatcgttccggcaaaatatccgtgttttcaatttgaatttgtcccttaccatcataaccaaattgactgattttaagtatacaggggaataaggatgcatcaattttccgggatatatctttttcgctacgaatagcgacgaaaggcacaactggaaaaccgttttccataagaaattgtttctcaaggatacggttttgtgcgattgagacactttcggcattagggctgactatgcagcgttgcgccagatagcgtagtgcctgagcggggacattttcaaattcgatggtgaccgcggcacaagtcgatcctaattcatccagcgcccgataatccagataatctgcttgcagatggcgttcggcaatgttcgcggcaggactttctgcggccggatcaagtacagttactcggtaacccatttgttgtgctgccatggtgaacattcttcccagttgaccgccacccagcatgcccagcatggtgcctggtcttatatacatgattcagggagagtcattgcagcaacggaatccgcctgatccttgcgaaactgatcaagtttctcggccaacacggtatctttcccggccagcatggcaacagcaaacagcgcagcattcaccgccccggcttcgccgatagcgaaagtggcaaccggtatccctttgggcatttgtacaatggataggagtgaatcaataccctgtaagtgttttgaagtgactggaacaccaagaacgggcagtgtggttttggcagcaatcatccctggcaggtgagctgcaccacctgcaccggcgataatacatttgattccacggtcacgagccgtctcggcataatcaaacatcctgtcgggtgtgcggtgcgctgagacaattatggtttcgtgcggggtagagaatttcttcaaaatatttgcagcatgctgcatgatatgccaatcgctgctgctgcccattacaacactgactactggacgatccacttgaaagacctttacaaaaatccggaataactcgaaatacacctaggcatggtgaaagtggcaataataaactagaatagcttgtcagcctgcaagttttaagagcaaatcccgtttgctgtataagcccagcagggcagattcagcagttttactggcctaatactcaaagtctaatgaattttcagcgaggacagaaaagagaagaacctgagatcaatctcgttcctatgattgatgtgctagtggtaatcctcatttttctggtaattactactacctattcaaaattttcagagctggaaataacgttgccacaagcggctattattgaagaagatcacgtatcggatgctccaaggatgatagatatatcggtcagtgttgcgggagactatacgattaaccatagtccaataaaatttaccagcattgaaagtttgcgagatgctttgcgatcagctgcccataaccaggacaacccgatcatcgtaatcagtgcggatgcaaaagctacccatcagtcagttatcacgattatggaggctgcaagaacagctggatacaaccaggtgactttcgctacagaggttacaggtgccagccaataatatttttattaacaatatcaatcgtatgatttcattattcaaatttttattcagaaataaaggagagaaaatgagtaccagtctggataatttttcaaaagcagcacaatcgggtgatacatatgtgttgccccctcttccttatgcagataatgcgcttgaaccagttatttctgcacatacattaagttttcattacggcaagcaccataaaggctatgtagataatctgaataaactcgttatgggcactccatttgccggacaatcactggaacagattattatggccacagctggccatgctgataaaatcgggattttcaataatgcagctcaggtctggaaccacatgttttactggaacagcctcagccctaatggaggtggtgaaccaccggcggcattaaaacaaaaaattgaagaagcgtttggcagtgtggaagcctttaaacaggaatttgccactgctgcaattacacaatttggtagtggctgggcctggctcgcgcaagagggaacaaagttaactattattaagacaagtaacgctgactcgcctttgacgcgtagcattcgccctctgttgacgattgatgtatgggagcatgcttactatttggatttccagaatcgtcgacctgattatgtcaatacagtaattgataaattgattaattgggaatttgctgcggcgaatctcgcataacgactattgatgccggatatcaccatagctctttccaaggggcgaatctttgaggatactattccgtttctggaagctgccggcattatcccgcaggatgatccggatacttcccgtaaactgatcattgagaccaaccgtcccgatgtcagactcgttatggtgcgggctacagatgtgccaacctatgtacagtatggcgctgctgatttgggcgtggccgggaaagatgtgctgctggagcatgatggagtcgggctgtatcagcccctggatctaaaaatcgcccgctgtcatatgatggttgcagtgcgagacggctatgattatgcttcggcagtttttcagggcgcgcgcttgcgtgtggctaccaaatatgtaaaaaccgcgcgtagccattttgctgcaaaagggatgcatgtcgatctgatcaaattatatggttcaatggagcttgccccgcttgttgacttggcggatgcaattgttgatctggtttcgactggcggaacactcaaagcaaatcgtttgcaagccgtcgaggaaattatgccaatctcagctcgcctgatcgtaaatcaggcggcgctgaagctgaaaaatcccacaatacaacctttgttagaagcgtttaatgcagcaatccccgcaaatgtgtagtcctctcaactcttaattactatgattcaaatcaggcggctgtcgtcctcagatattgatttccaagaagaacttagatcactattgagttttgagatatctcttgatgacgagattgatcggatagtgattcatatcctgaatcagatcaggaaatacggagatgaagcgttacttgagctgacacgccggttcgataatctagatataactcggattgatcaggttgaattacctcggaatcaatggaaatctgctctggaagccttgagtcgtgatcaacgcgaggcactggaacaggctgcttcccgtatacgtctctaccatgaaaaacagctagcccagtcatgggattatgttgagccagacggcacacgactgggacagaaaattactgcgctggatcgtgtcgggctctatgtgcccggtggcaaggcagcctacccatcatcagtgctgatgaacgcaattcctgcccgggtagccggtgtcaatgaactgattatggtaaccccaacaccaggaggagaaaaaaatccgctggtactggcggcagctgcaatctgcgaagtagatcgtgtttttactattgggggggcacaggcaattgctgccttggcttatggcacggcaaccattccgaaagtagataaaattgttggtccgggcaatgcctatgtggcaacggcaaagcggcatgtattcggggaggttggaattgatatgctggcagggccgtcggaaattctggttatttgcgacggaaagaccgaccctgactggattgcgatggatctgttttcgcaggcagaacatgacgagcaggcacaatcaattctactttgcccagatgaaacttttttggatgcagtagcagaaagtatagccagattaatcaatacactgccacgccgggaggttattcgtacctcattggagaatcgtggtgcattgatcaaagtgcgtgatctggaggaagcctgtctgattgcaaaccagattgcacctgaacatttggagttatccgttgatcagccagaacaatgggtagacagtattcggcacgctggcgcaattttccttgggcgatatacctgtgaggcactgggagattattgtgctggccccaaccatgtacttcccacttccggtacggctcgtttttcctctccactgggtgtttatgatttccagaagcgtaccagcctgattcaagtttcagccgagggagcatccaggttaggcaagattgcatctattctggcaaagggggaggggcttgaggcacacgccagatctgctgagttccgttatcgatagatcacaagtccaaatgtctgtgatcaatctgtctgcatgattctattgcttatatgaacggtcatgattgatcagcaattcgatattgtcattgttggaggcggtccggttggaatggccctggcattagcattgcgtgaacataagctctcgattttgctgcttgaagcacgtgagttaccagaagaagtggacgatccgcgaccgctagctctttcatatggtagccgtttaattctgcaacacctgggtatttggaaaaatctgacacaacctacgccaattaccacaattcatatttcgaatttcggtcattttggccataccgtgcttacgcctgatgatgcaggagttccagcactgggctatgtggtcaattatcataacctttaccataccatgggtcgatccgtgcgagattatggtgtcgtataccgaacaaatgcgctggttacgaccatacagacaggtcaacaacaaacccggataacataccggcaaaatgagacagaaaaacagattcaagccaaattactggtgctggcggatggtggaaaacttgcggagcagattgatggcatccgttatcgtgttcatgattaccggcatacggcgattgtggctaacgtcaaaaccgaatcgtcccgaccaggaacagcttttgaacgttttaccctgaacgggccattggctctgctgccatctggcgataaatatgcgttggtatggacaatgccgactgccgaagcaaaaaaaatactgaggcttgatgacagactgtttctgctgcatttacacgaacaatttggagatcgtctgggtaattttattcacgcaggtaagcgatcaagtttcccactgatactcaaacatgcgtcaacaattatcggccatcggtcagtaataataggcaatgctgcacaaacactccatccggttgccgggcagggctttaatcttggattgagagacgcatgggagctggccagtgaaattagtcacatcccttctggtgcacctggtgagccaggatcaagcagaatgctgtctgtctatagcaaacggcgccagcgtgacaagcatatgggcagagtgtttacggattccctgataaaactgtttacagccgatttgccactgatacaaacttgcaacggaataggattgactgttctggattgtttgccgcccgcaaaacgcctggttgcacggcaaatgatattcggtacaaaaaactgattactagaataagcgaaacacgctggtgtgctataaaaatctgataatccagttccggattaaaatttggatctgatttttcaataattttcattaacagccaaaaccagctagcagctatggaatttttcttctgacgtttttaacctggttttacctgtttatgcaaattggttcctatacgcttaaaaataaattgattgttgcccccatggcaggagtgacagatcgacctttccgacaattgtgcaagcggatgggcgctgcgatggcggtgtctgaaatgatttccagtaactccctgttatatggctctgaaaaaaccctgcgccgtgctcgtcatgaaggagaggtgaaaccagtttcggtacagattgcaggcgctgatccagccatgatggcacaagctgcgcgccacaacgcggatcatggtgccgaaatcattgatatcaacatggggtgtccagccaaaaaaatatgcaatgtcatggcaggatcagctctgctgaaagatgaagatctggtcagcaaaattcttggggcagtcgtgcaggctgtggatattccagttaccctgaaaatcagaaccggctgggatacgcagcataaaaatgcagttgcagttgcccgaattgctgaaagtgcaggtatccaagcactggctatacacgggcgtacacgtgcttgtgcctatcgggggcaggctgagtatgacactatcgcgaccgtcaaagcagccatcaatattcctgtgattgccaatggcgatatcaatacaccggagaaagttagagaagtacttgaatacacgggagtggatgctgtcatgataggtcgtgctgcccagggtagaccttggatttttcgggaaatcaatcattatctggcaacaggcaactttttacctttacctgaagtagctgaaatccatcgtgttttgattgaccatctgcaagagctttatcagttctacggtgaatattcaggcgtgcgaatcgcccgcaaacatatctcctggtatacccgtgggttggcaggttctgctgtttttcgccatgccatgaaccggcttgcatcggttgaggaacaattggcagccacccatcagtttttccatgagcaggctgatcggagccaaacacttacctatattgacgaagagatccttgaggcatgactgttattaatgaaaatgaaattgcactctgtgttcgtaaagcagtagaggcttactttcgtgatctggagggtgaaaaaccatgccctatttatgaaatagtgatacgtagtgtagaaaaaccattaatagaagttgccatgcatcatgcacaaggcaatcaaagcaaggcggctgaactacttggcatcaatcgtaataccttgcgtaaccggctaaccaaacatcagatcggataattttttcaaatgagtattaaacaagcactcatcagtgtttcagacaaaacaggcgtggttgagctggcctcagctctgcatcaactcgatattatgattctttcaaccggcgggactgcaaaattgctgcaggaagcgagtattcccgtcatagaagtgagcgactatactggcttccctgaaatgctggatggacgggttaagacgctgcatcccaaggtacacgcagggatccttgccaggatggatttgcctgcacatcagcaggcaatggcacaggcacagattccagcgattgatctgatagtggttaatctgtatccgtttaccagtacaatcgcccggcaagactgtacagttgaagaggcaatcgagaacattgatatcggtggtcctactatgatccgggcagctgccaagaattttcagcgggttaccgttgtgaccgacccgcaggattatgaaccactactggaacaaatacgatcaaataatggatcagttgatcatgattatcgtttcaagttagcgcaaaaggctttttcgcatactgcacgctacgatggggcaatcagcaattatttgacggcactggaatcctcaaccggccagcgcaaaccatttccggatcaattcaatctcagtttcacattaacgcaatctttgcgttatggagaaaatcctcatcagcaggcagcgttttatcgtgatgcagcagatataacaggcagcctggcagactataaccagctccaggggaaggcactgtcctataacaatattgctgataccgatgcggcattagcatgtgtcagaactttcgataaacccgcctgcgttatcattaagcatgccaatccttgtggcgtcgccattgctgataatccgcttgctgcttacaagaaagcatttactgccgacccggtatcagcctttggcggcattatcgcgattaatcgcgcagtcgaagctgatctggctaaagcagtgttgcaacaatttgtggaagtgattattgcaccggaattcagcatggaagccagacaacttctggcaggaaaatccaatattcgggtactgaccgtttcattgggcgcgcatggcaatctgtatgatctgaagcgtgtggatggtggtttactggttcaaacaccggacgatcttaatctcacggctaatcagttacgagtggtgacacaagtaaagccaacggatgcacaaattgaggattgcctatttgcatggcgagtggcaaagtttgtcaaatccaacaccattgtattttgtagcaatggccaaacacttggcattggtgccggacagatgagtcgggtggacagtgcccgtattgcttcaattaaggcagaacaggttcatcttgatttgcatggatctgtcgttgcatcggatgcattttttccgtttcgggatggcctggatgtgctcgcccaggcaggtgccaaggctgtcatccaaccaggtggcagtattcgcgatgaagaggtcattgctgctgccaacgaacaagggatagccatgatctttactggtgtcagacatttcagacattagcagattacgtttcttttttgcttcccgtcaacttgtacccttaaattctattcagatagtcagatgaaattacttgtggtcggcagtggcggcagagagcatgctctggcatggaaactggctcaatctccattggtcaagaaggtttttgtcgcacctggcaatgccggaacagcactggaagccagattggaaaatgttccggtaacttctatttctgatttgctggcatttgcccggcaggaaaaaattgatttgactatagtaggtccagaagcgccattgacggatggtatcgttgatatctttcaggctgcggggctgaaaatattcggcccaacccaaaatgccgcacagctggaaggctccaaaagctttgccaaagcattcatgcttggccatggtattccaaccgctgccggtgaaacatttagcgatgctgctgctgcccatcactatctcgatcagcatattttgcctgttgtcatcaaggctgacgggttggcagccggcaagggtgtgattgtcgcgcagacatgggatgaagcacatgcagctgtcgattccatgctggtagataataaattaggggctgcaggggcacatatcttgatcgaagaatatctggaaggggaggaagccagctttattgtcttgtcggatggacagaatgttgtgcctctggctaccagtcaggaccacaagcgtttgttggataatgataaagggccaaacacgggtggcatgggtgcctattctccggcatcggttattactcctggcctgcatgaaaaaataatgcgggaagtcatcatgcccgtgatcgaagggatggcacaacaatcacaaccttataccggatttctttatgcgggattgatgatttcatctcagggtgatatcagagtgctagaatttaactgtcgcttaggtgatccggaaacccaagccatcatgctgcgactgaaaactgatttattttctttgctggatcatgcgatcaatggcacactggataaagtcaatgttgagtgggatcctagagttgcattatgtgtcgtgatggcggcacaaggctatcctgatagcccacggaaaaatgatgttattcacggcttggatgtaatgatggcgaatcaggatgcggatgataaatttcatatttttcatgccggaactactgcaagtagcggaaatccagagaaaatcctgactgccgggggacgggtgttgggagtgactgctttaggtgaagacatccagcaggcacgggcgcgcgcttatgccattgcaaagagcattcatttcgatggctgtcagatgcgccgggatattgggtataggggattaagaaatgaatgatacaacaacaaaattgttgctggccgcatcgtttgcgttgctgctatctgcttgttcctctaatgaaatctaccacaataacttcagcagttgtgtggtgacagctcaaaaatcatgtgaatcttattctattcaacagcacaacaaggaaacaaatcaggaatatttgctcggttttgtcgaaattgatgatcaggggcaacttcgtaaccgtgcacaaatgcaggcactgctgaatgtgttgtacgcactagcttcaaaagaaagcctgttaatcaatgtttttgttcatggctggcatcataatgccagtccaggtgataccaatgtagaaagtttcaaacacagtctggccgagctaagtaaggttgagaatcaactgcatcattctggcagaacgccgcgcaaagtcgtgggtgtttatgtcggctggcgcggagaatcaattgatgtaccgttggtaaaagatgctactttctgggatcgcaagaatacggcccatgaagtgggatatcttggtatgactgaactgttattgcgattggaagagatccgtaatgtcaagaatactcaggagccaccggtaaaaagtcgtcttgtggtcataggccatagccttggtggagccgcagtttatagtgccaccgcccagattctcgccgatcgctttgtcaacagcgctggcaacaagaactatgtcggtaatgcggaagggtttggggatcttgtggtcttgctcaatccagcctttgaagcgctcaaatatgcacctctttatgatctggcacaggcacgctgcagctatttccagaatcaaccgccacggttggttgttttgacttctgaagctgattatgcgaccaaatatgcttttcctgccggccggattttctcaaccctctttgaaactcacggcacaatcaatcgtaatgattgcaacctgccactctcctatagcgaaggcgctgcagatcgccagacagttggccatttcgaatctctgcaaagccatgaattacatcccatcagcgcaggcatggagccggcttataatcaagccaaaatgatctgggagagtcagctaccagaaggatcactacaatttggcagaacagaattgacaagtctgaggcgcacagtaattcacaatccctacctgaatgtaaaagtcgataagcaactgattgcgggccataacgatatgtttcgccccgagatcatggaattcattcgcatgttgattgttgtgtctactgcagaataaaacgctccccggaagcctgcatgcagcaagtatcgtatgcagctttatccatcagaatccagaaaatatcagaaagagcctctgctacagtgcctgaaattgctgttcgtactggtcggctttggatagatcgcctgctttcctggctgcttgtgctgcaagtgagatcccattacgacgattgggtgtgcgttgcaatgaggtttccagttcctttagtgctgcttccggttgattcattgtcagcaataactctccgagtaactcacgagctggaataatagagccgggtgtgacattatctttttcagttgaatcttccagatcagctgacgcacgcatcagttgcaatgcttcttcagatcgattttttgcggctgcaatccaggcagcaacagccagtcgctgaatttcaatttgaccagcagtgtaatcctgatgtactgcatgatcgtgatcacgcaatgtctccaatcgtttcaggcttttttctgcctcaattatattgccaattctggcggcacccattcctttagaacctgtttacgatcttttgagtagtagcgccaggaaggccagatgaatgaactgcaagctggtattgagcttacgctcgcagtttttccataaccttcggctcttctccagccaggcaaagctgcgctcgacgatccagcgtttgggtatgactgcaaaagtgtgcagttcactgcgcttggcaatctgcaccgtaacaagttttcctagaatttctcgcgcgccttcggcaaacggctctccagtatagccgctatcgcacagcaggctttgaacctgccccagactctgcttgcagcgttttagagcttgcaatgctcctttgcggtcagtcacttccgccgtcgtcaccgcaatggcatgcggcaagccctgggtatcgacggcgatatggcgcttgatacccgataccttcttgccggcgtcataacccttctggccagccgtgtccgtatttttcacgctctgcgcatccacgatcaagaacgtgctgcaagcgttgcgcccccgtttctcgcgggccgcgccaacctgatttttttaatgcctgctccaacacactcacgccgtgctgatcgggctcactccatttgcgccaatgagcatacacgctctgccatttgggaaactcaccgggcaggaatctccattggcaaccggtgcgcagcaggtacagcacagcgcagaatacctcatacagatccactgtcgtgggcttggtgctgcgtcgcacgctgcgcaatagcggctctatctcggcaaacttctctctgctgatatcactggcatattttgttctcttcatctgcacattatcaaggatagcagaaagatcgtaaacaggttcttagtaaagtgggtaagcgcttcacaccagccgaattgctgccacggaaaatccgttggatgaacacttagtttggtcgctgcatgccaatcaccgcgttcagcaacaaaacgtgctggaatagcggcaaaggcataggcgattgtggtgttatgcggatgcgcctgatcagttgccaatatctcctgcataattgcacgtgctttttctgtttcacccaattgtaaataagcgtacaacagaaaatccttagcgtgaatgtcgtccccgtaattgccagacgtgtgttcctgtgaagcctggtgcgctgccagattggattgcaccacatccgaccatagacccaggcgaacaaagatatgggatgacatgtgtagagcatgcggtacggtgggtgcaatatccatatatgcccgcgcagcatcgagtccgaattctgccagctcagggtaatcgctactgtggatgatgtagtgagcgacaccagggtgttgcggttcatccttcaagacacgttgcagtaactgtaacgcctgtttttgcctgacgaaagttttatcgtctggcgagacatttgaaatcagtgctaatgcgtaaaataatgtagcttcattatcgtctggaaattgttcagtaatacgcttcatggcctgctcatacgccagttttcgcgagctgtaatcacgatcatcatcctttgctggatagatggtagcaatcgcatccagataggctttttcccgatccgttttgattggtaatgactgtgcttgtgcaagggcgttacgtgcccgttgtacttcttctgttgtgggggtggtcgcccataattgctgataaagactcattgcgacaccccaatgccccatggcgcaatcgggatcaatggtggcgactcgctggaaagctttttcggcttcgtcataccagactgtcaacagaatggtgattatcatcagcgatcgctgatccgatccacagcaaaattgcaaaggtaaaaacacgcctaaatgttgtcatcatatatctccaaaaatagttttgtccgacaaagataaacaattggaatggaatgacatcaaacagcagccagaaaatgtgttacttcatccagatcacgagtgcgtttcattggcggcagactttgccagattcgtttgccatagggtttggatatcagacgcggatcacaaatcatcaataccccccgatcatactcatcccgtattaaccgaccagcaccctgttttaaattgataatagtatgtggcagctggtattccataaacgcattacgaccttcctgcgtatatttctcgatgcgggcagataataccggatcatctggtgaggcaaaaggtagccggtcaatgattaccagtgaaagtgcgcggccgcgtacatccacaccttcccagaaagattggctgcccaccaggacagcattgcccagtttacgaaattgattcaggagggcagagcgggtttcttctccttgcagtaataacggatattcgagttgctcctgctcgaacgcatcctgcagtaactcatggatctgctgcatgttgcgcaaactggtgcataaaatgaatgctcgcccacggctggccttaatcaccggcaacactgcctggatgatgctctcggtgtaattcggtgtatttggatcaggtaactgagtcggaacataaagcagtgcctgattagggaaatcaaacgggctatcccagctggcggttttggcttcagccagccccatcattcgattgtaatgggaaaaatcctttttgactgatagcgtagcagaggtaaagatccatgcacgtgctgtggtattgagctgcctgctgaatatttctgcgatagataaaggcgtggtattgaattgcaagctttggctgtaggtctcaatccagctgataattttgccggattcggattgctcgtgccattgtctgattttgttcagaatagcttgtgctcgcagccagcagttttgtaattcttgagaacgaacagcctgggtttcaagcaaatcagccagttgtaccagtttttcctgtagtacttgccgcgcctcactgaatccaggccgctgtgcggcggttgcgaaggagaggcgcgcatgcttttcagtgattgtcggtaggatatccagtgcagctttttctgccgcagccagcgcatcaaacaatggtgtaaattcccgcgcaacgagtagagcctcggtatggatatcacgcaccagagtcactatctggccagtgctgattgattcaccaaaaaacaggctggccacttccggtaactgatgtgcttcatcaaatatcacggtattacaagcgggcagtaactcggacaatccttcatcacgcagcatgacatccgcaaagaacaggtgatgattaacgacaatcatatctgccaacaatgcatgtttgcgcgcttccataacaaagcattgtcggtaatgcggacaatctgatcccagacagttttcccgcgtggaagtaacatgctgccagatggccgcctgttctggtaccttatccagcccgcttttatcaccgtggctgctggtattggcataccgtttaatcagattgagatgttttacttcagtacggttagcaaagtgagcgtgatccgaattcaatgtgcgttcaagatgataatggcagatataattggcacgtccctttaatagtgcaaccgttaccgggactttcagcgcagcacgtatagttgggatatcacgctggaaaagctgatcctgcaatgtcttggtaccggtggataaaataacttttcctcccgacaataacgccggcaccaggtaggcaaaggtttttcctgtgcctgtacccgcttcggcaaccagaatttcctggttctctattgcgtgtgcgatagcttgtgccatctccagctgctgggtgcgtgagcgatagtctggtatattgcgggcgagcaagccattagatgaaaaaatggtgctcaattcaggcatcaaatcggacattggaacaatcgagttatacaaagaattaatcaaaatatgtggaaatgtccttctttgacgtatttcctgctttaaagtgtaactgtgtttttacctggatatatccaaaatcaccagcaaccagacctttgttccgattatccacccgggataattaccggataatggtgcctttattaaaagacatccagaaaaaatccatttaagtcctggtcctgaatgagtcttctgtcaaaattacatttaatactgtacatctgcttgttgctgctgccgcttcgattcgtgaatgcggagcaattatccggatcaggcgaatctcaaccggttcatattgaagcagatcggatcgatgggcattatcagcaggaaattgaggcaaccggcaatgtgcggatgcgtcgtggtgatcagacattatcagccgatcacgttaaatattatcaggatacagaagatgtggaggtgaaaggtaatgcgctgcttgagcgccctgacgatacgctatggggtaccttcctgcagatgaatctacagaccgatattggcgagttgcgtgatcctcgctacgctctcaagggtggaaatgggcggggcagcgggagcctgctgctactagaaggagaaaatcagtacagaatcaagaaagcgcgttataccacttgtccggaagataatcatgactggtacattttggcggatgatctggaaatagataatgaaaaaaaagtaggaactgcacgccatgcttcaatccggttcaaggatgtgccgattctttacctaccgtggatgaacttttccttcagcaaggaacgaaaaaccggctttctgtcgcctattatgggtaacacaagtagaagcggagtcgaagtatcagttcctttttactggaatattgcacccaattatgatgccacgattacgccgcgcctcatgagcaggcgtggtgtcatgctggataacgagtttcgctacatcggacagggactcggtggccgtttacagtttgattatttgccgaatgatctggtaaccgatacaacgcgctatggcttacagtttaatcactcccaatttcttggatctgggtggtttggggcgttgaactacaaccgggtatctgatcacaattatttccgggatctgggtaacaatattctgtttacttctcaagtcaacctgctgcaacaggcaacggcaagttatttcagtgaactgggccgcaatggcatgctcacattcagtacacttatgcaacaatttcagacagttcaggaccccagggcgcctattatttcacccttcaaaatcctgccacgattcacactgaacgcggtgaaaagtaatgtctatggtctggatttcgaccttgccagcagttttacgcacttttctcacccgacattaccgcatggtttacgttttacagcattccccagtgttgctttgccactagaaaactcctttggtttcattcggccacgggtggggctgcactacacaaaatatgatttgaatacaccagcctttccaggcacaaatgataagcatcttgaccgatctgtgccgatattcagcctggatagcggcgtggtactggagcgtgatatgacattagggggtgggaattttattcaaaccctggagccacgcgttttttatacctatattccatacagagaacagcggctgttacccaactttgattcggcagaaatggactttagttttgcccagctgttcatggaaaaaaggtttagtggtgaagatcgaatcaatgatgccaatgaaattacgctggcaatgagttcacgcctgattcattcagcgaccggtaatgaacgcctgcgcttttctgtagggcaaagaattcgtttcagcgatcgccgggtcttgctaacctcaccccaggtcacaagggcaggatccgattttattgcagaactttccggtagtcttgcacagcatgtcaagactgacgcagggatacagcttaaccagaataacctgctgatagaaaaaattcgtaccggcatcagctataacccggccccaggtcaggttataaacgctggctatcgttttaccagggatgttctggaacaggttgacttgtctactcagtggcctttcctgaaaagatggcagggctttgccgctatcaattattctttgaaaaatgacaagctgcttgccggcctgctaggtcttgaatataacgcctgctgctggtcactgcgcctggtagccagccgctttacgacggcaacacaaaaaacctcaaccaatattttcgttcaactggaattgaacgatttaatgagaatcggtaccaatccgatacgtgtgctgcaacagagtattccaggttacgtaaggacagacttgcaatgatccgattaagccagtttatacagtcaaagtttggaaagttcgcattgatcggagcttttaccactatgtgggtggtaaatatttctgcacaaaatttccatcccgggaacgacatcaagccaattgatcgtattgtggctgtggttaatgaggaagtgatcacccagcaggaaactaatgagctgctgcaaaatacaatccagcaattgcagaaacagaatatacagttgcctagcatggaggttctggagaaacagttattggaacgcctgatcatcaaacgaatacaactgcaacgcgccaaggaagtcgggttatctgttagtgacaacgatcttgatcaaaccttgcgccggattgttcaagataaccaccttaccatggatgagttccggcaggtgcttttgcaggaaggaactaatttaagcctattccgggatgaaattcgcgatgaaattttgatgtcccgactgaaagaacaggaaataaacagccgtgtcaatgtaaccgagagtgaaatcgataactttctggaaaatcaggctaactcaccggcggctaacgaagagtatcgcatcgcgcatatcttggtgcagacttcagaacagatggatgaggcacagatcgatacacgccacaaacgtgccgaggcagcctatgaagatcttaggcagggcatcagttttgcacaggtatctgctgaatattccgatgcaacggatgcgatgcagggaggtgagctgggctggcgcccacttggccagataggttcaccctttgctgaattgctgttgcaaatgcaaccgggagagattactcctgtggtacgcagcccgattgggtttcatattcttaagttgctcgaacgccgacaacaggaaaagtcggtaacaatcattgaacagacgcatgcacagcatattttaatcaaggtcagtgaaataatttctgaagaagacgcacaccagctaattgatcaaatcatggaacgcattcataacggggcagattttatggagatggccaaggcgcattcggaagatgccagtgcatctgccgggggagatctgggttgggtttctccaggagataccgtgcctgaatttgaacaagcgatgaatgcattgctgccagggcaaatcagccaacccgtgcgcacatcttttggctggcatctgatcaaggtcattgagcggcgctcacaagatgtaagcgagcagaaacagcgtgaaacagcgcgcaagactatccatgcacgcaaggcagatgccgttgcgcaggaatggttgcagcagctcagagatcaggcctatgtggaatataaagttgaaggcatctgagcgaatgtatgacaatgatgaagtgatcttttttacagataggcttgatttactggctggatcttcaatatgacaattgcttccatcccaagattggtggtaaccgccggtgaacccgctggtatcggcccggatttaagtgtacaagttgcacaacaggatctgccttatcaactgacagttatcgccgatcgcaacgtattggaacagcgtgcagaaaaactgagattacctttgcaggtattggaagttgattcgatagacgattttccttgcctgccgccacataaagcggggtgcgtacatgtactgcatgtacccgtcaaaaacccggtggtaacaggtcagctggatgttggcaatgcagcttatgtactgacaacgttacagttggcggtagcagcctgcagcacccgcaaggccgatgccatagtcacggcgccggtacataaaggtattatcagtgaatcaggcattccattctccgggcatactgaatatctgtcagagctgacaaacagccatgccgttatgatgctggccggtggcggtatgcgcgttacccttgccacaacccatttgccgcttaaagatgttcctgctgcgattacgcctgagcgactggaacaaaagttgcgtattattcatcatgatctggtcacacggtttgtaattaaaaatccgtgcattgccgtggcaggactgaatcctcacgctggagaatccggacatcttggtcgtgaggaaatcgacattattattccagtactgacaaaactgcgtaacgaagggatgagtctgttgggcccgttgccggcagatactctgtttaatcctcccaaactcaaggaatatgactgcatctttgccatgtatcacgatcagggattgccgacactcaaacatgccagttttggccatggtgtgaatatcagcctgggaatgcccattattcgcacatcagtggatcatggtacggcgctggagctggccggaactggacaagccgatcctggcagcatgtatgctgccattgaaatggcgttgacgctcgtcaggaacaccagaaacaactctctgcaggcaaaccaacaatctgagagctaaaacatgcggcatattccccgcaagcgttttggccagcattttctggttgatcatcacatcattgccgagatcattcacatcatttatccactaccaggcgatcgaatgattgaaatcgggcccggattgggtgcattaacccagcctttgctgaataatctggacacgctgcaagccattgagctcgaccgggatatcgttgattatctatcccgaaattatgctgagaagctggtcattcataatgtcgatgctctgaaatttgatttttctgtgctgggagaggggctgcgaattgttgggaatctgccttacaatatttccacgccactattgtttcatctgtcccgattcagcaatctgattatcgatatgcacttcatgttgcagcttgaagtagtggagcgcatggtggcacagccttccacgccggattacgggcgtttgtcgctgatgctgcaaaacaggttcgaaatggaacaaatgctgatcgtccccgcagaagcgtttaatccacctccgcgagtccagtctgccattgtatgtatgcgcccaagagcggtaccggttattccatttgagctggaaaaactgtttggtgaactggtcttggccgcattttctcaacggcgtaaaacactgcgtaatacactgcgccattatctgactatcgaggattttaaccagctgaagattgatccggggctgcgggcagaaaatttatcgcttgagcaatattcagcaattactcgccacatccacaaaatcagataagagtggtttgcttatctttatgttcatgttcaagcagccactccttgcgatggataccgcctccgtaccctgttagtttgccgttggcgccaataacgcgatgacaaggaataataatggaaatgggattgcgaccgtttgccatccctaccgcacgtgcggttttgggcagattgacgtgctcagcaatatccttgtagctgactgttttgccataaggaatggaggctaatgcctgccagaccttttcctgaaagggggtgccggttgctttcaatggcagatcaaattcatgcagctctccagagaaataagcatttaattgggcaatagcttctttgaaagggatagcatctgcattctgtagccagccatctttcatgccggatagcagcttctgagcttccttttccatatataacccagtaagaaattcaccatcactcgtgagcaacaacggatcaatgggactttccatagtgatgtaataattcattgcttgctctccttgtaggattatcatgtaatcagactatacttaatagcgctattttctcattctcctgcacactgatgccataagtgaatcgcaccatatgcacgccaaggttgccatttttcagtacgacgcaacagttcggccggtttttccatccgcaatccgcgtaacagaccgagatctgaagctggaaatgcattggagtcccccagtgcccgtattgcaatgtattgagcagtccaggggccaatccccggcagttccagtagttgttcgattattttgtttcgatcgattgactcaggtttcagtgcgccattcacgatagtttgtgcaaatcgctgaatagtcagagctcgccgcccagtcagaccaatattgatgagggctgcagagaagtgtcggcaatgagctctgcaggcgggctgccttgacagttatctgttgccccagtattgcgcgtagacccagttcaaaaatatctaatgttccggggatacgcagaccgggatgattggcaatcagtggctttaatacgtcgtcatttcccagatgagcttcgattattgctggactagcgtccaaatcaaatagacggcgtagatacatttgcaaccggataaggcaaggtaatagagaccgtgaggcttgcacatatatctgatggcgcttcgtgtcctgttttgcagtaacccagccctgacacccatcaagatttactattcgcagatagttgccattctgtatctgactcaagcgtagattaccgcgactacagagaaaacggattaaggcattccatgccagcggtgggcgataactcagccgcaacaaaatggtagtttcctcgttgaccggatatttcttgcgtagggataatggatttaatcggtatctggatgtaaaggtatcgctaaaatggagaacacttggaaaaccacaggtgtgcgctatatcatttatttccagagttgtatccgtgagtaattgtttagccagcaacagacgctgggttgtttccagctcagtcgcgtttacgccatattcacgttcaacgatctggtggaattgatatgactgcagcccaagctcatccatcaatgtttcgatattattgtgcatcaataatcccatccggattcgttctgctgtcgactgaacctcgtatccgattccacttgttctgagattgcctggtacaagttcaggccgacaacgcaaacaaggacggtaaccatcctgctccgcacgtgctgcgctagaataaaatgtacaccaatctacttgtggcaaacgtgctcgacaaacgggacggcaataaatccgtgtagtggatacacctacaaaaaacaaaccatcagaattagtgtcgcgcgcctgaagtgccgcataacaacgtacagaatccaaaggacgtatgttcacgagagggctgccatgaagaaagttgcgggagcaagaaacgtattattccctttttccagattcatttctttaatttaacataatgtaaattatacgaaataggatgctcatgctcgcagcatgaaaacacacaaggaaacgcgttatgtcaaatcaaaaaacccgctacggcggtctgttctgtgtgcttatcaacagttccttttcaagctggctcgtcaaggctatggaacgacttggtttcagcagtttttgggtcaatttcttcctgtggttgccgtgtcgactggccatgtttgaaatcaaacttgagtatggttctctggagaacttcgttaaccgttcttcatcattaccacgagaccgagagcaaccgcctgaacgaggagcgtagcgaccgagtgaagagcagttgctctcgggtcgagaaaatactttacgtcccagtaacacataaagttagtctcatttcgcgcacattttgttcattccaaaaacactctgaaatgcgcttctgtattgagtttcagcgttatgcgtatgttctatttgctattgcgcacggtttcaatgggtttgaggcctttcggggggaattccgatgacatattttagcgttcaggaagtagccgattttcatggaatcactactcagcgtgtccgccgtttgctgtctgaaggtcggatcaagggattcaaggattctcgcaatatctggcagattctatccccccctgacattcggccgccccgtgaatcaggtttccatcgtttccgtctcaaatttcacaaggggggtagacatgcgtaaacgtcgttacaaacgcaagcattacaagcccgtgaattacgacaccatccgggaaacaaggctgctggcgggtcttacccggcaacaggttgccgatatgcttcgggtttcactgcgttctgttcagtactgggaacgcggccgggttcacatgccttatgccgcgttccggcttcttcgcatcatgacgggctatgagttgcccggtgactggaaaggctggatgttactgcgtaacaaactgatttctcctgaaggcaaaacctttactcccggtgatctctaccctctcaactggatgatcgacaaggctcgcatgtgggacaaggaataccgtcgtcgtgtcagttctggatcaactgcgctggtaccgtttgcgttacccggtaatgcgtggcgcggctggacgtgtcatgacggccgtttgctctctcccgatggtatggcgtttacgcctgttcacctcaatttccttgcgtccatggttgaccggatctgcggggagatctcttcagttccggtcacggtcatccaggatgatgcatcatgaacgatttgtgccgctggatgccgcgaggagcgagaggtgttgggatgatgaaaatcgcttaaatagcgttttaagccctttctgtggccagcagaaaatatcgagaccttcggcgacatccgagcttgcgaggaagagaccgaagcagcgtagatttttcgtcgcgggttacgccgtaacgtttcgggattgctaccgctcgccccccatccacccccttacaaaacggggtttcggggtttgcgtgaaaatctttccatctctttttctggatatcttttcaaccatcaactattctttaaatcatgaatgcaaatttttcacacgctatttttcctctgaatttttctcccggaaattttgtaattgtgcaagccattgattttattgcttgtaaattatacgaaattaaataagctttttgcagataaagacaattagatacggttcatggctatgacaattcctctttgatgggtttgtttgggccagtgtgcgcttatcatagataatgctcatcaccagatcaactggagttcgaagctaaggatgtttcaagtaggctggtgtgttttccaaagattccgaagtcgaattgaaccaggcaagcttctgacgaagcttgaccacttctcccacaatgatgagtgttggcggtctcaatgggtttttctgaatgattgttggcaacgttgcaagtgtgccggtgagaacacactgattgggggttgtaccctgctgaataatagcagctggtgtcgtttttggcagaccatgagcaatcaactgccggcataactcggagacgcccagcaatcccatgtagacgacaatcgtctggttaggacgcgcgagcgctgaccagtcaagctgtacagtgttgtctttcagatgtccggttacaaaaacgcaggaatgcgcgtaatcccggtgggtcaaagggatacctgcataactagccacaccggatgcggctgtaattccgggaacaacctggaatgggatctgatgttgtgacaaagtttcgatttcctcgccccctcgtccaaaaataaaaggatcgccaccttttaaccgcagcacacgtttaccttcttgcgccagcttgatcaacaggttattgattgatgtctgcggcaaagtatgtcgattacgctccttaccggcatagatacggtcagcatcctgtctgaccatatccaaaatggccggagcaaccagccgatcataaatcaccacgtctgcctgctgcatcaggcgcatagcgcggaaagtcaacagatccgggtctcccggccctgctcccaccagataaacttccccgatcggaggttgatccacactattattcaaggtttctaataaataatcctgggcagcctgatccttgccggcaaataccatttctgcaaacggcccttgaagcattttttcccaaaagaagcgacgattttcctgacgagaaaaatgctgcctgacttgcccacgaaattgcgcagcataagttgccagtcgaccataagcagcggggattaatgcttccagtcgtgcacgcaacagccttgccagtactggagaactgccaccgcttgataccgcaacgataatcggagagcgatccaaaatggaaggcatgataaaggtgcataaatccggattatcgacaacgtttactggaatacctgctttccgggctgcaaccgagacagcctggttggttgctcgatcatgcgtagcggcaataaccagcaccctatcctgcaagtgatccgggcggaaggtttcagcgttatacgagattgaagggaattgctgcaataaaccagtaaattcagcattaattgtgggggaaacgacatggatgtgcgcccctgctcgcagtagcaacttcgccttgcgggctgcaacacctcctccgccaacaatcagacaatttcgctgtttaatgttgagaaaaactggaaaataatccatacagacaaaatggggtttaataaataaggagccgtctggcctgttaaaggttaatcagaacgatgtaataacctcttattccggaattacatatccggttcagtatctgtacttctgttactgctgatcatggatgtaccggttattgaactctttcccgcttatacagttcctcaatggtcatactcatgccagcttcaccaccgaatactgtgccgagtgtcttgttctggagatgtttgatattgaaatcgtagaattcctttttaagtgggaaatatcttacttcctcaatcaattgctgcgcgtgttgcatgtaaaagataacaaattcctttatttccggtttatttgctgattttgcatttacataaataaagagaggacgcgataatggctggtaacttccattttgtacggtaagcatggaaggcagaacaccgccagcaccattatcaatcgccacaactttcaatttcttctgattttcgatgtagtaggcaaagccaaagaaacctaatgcatttaaatcgctcgccacaccctgaacgagtacattatcatcttccgaggcagtaaaatctccacgactggattttgccttaccgaccacggcttcggtgaaatagtcgaatgtacctgaatcagctcctgcgccgaaaagtttgattctggcatcaggccaggccgggttgatttgattccagttaagtatcttttcttgcgcggcaggctcccacattttttttaactcggcaattgttatggatttaatccagttattcctggggttgaccgccaccgttaatgcatcaaaagcaattggcatctcaatgtactgcacaccattctgccgacattgtcccatttcagaagacaggatcgggcgagatgcattcacaatatcaatttcccctctgcagaattttttgaatcccccgccagtaccggagataccggcagtaaccatagtggctccttttttggcaatctgaaagtcctcagaaacagcttctgtaatcgggaaaacagtactcgatccatctatcttgacaagcgatctagcttgaatatgcccactgattccactcagaaggataagggtcgtaattaaaaatccggctctactactggatttcgataaaaactgttgcatgatagtcaccttgatgttcaagaattaaagaaaagatatctgacctgtataccttatgactctaacttcaggtattcaccaaagataaacaagatatattacagccttgtgatgatagcttagtacccagcaactgaagcaacggcctgttgctgaattgttccagcaattttctcagcccagtattcaatctgttgagggtcttttccttccaccatcaccctgattaacggttcagttccagaagcacgcagcaaaatacgcccatgatttcccagtgcctgttccgcctcatttttgcatgtctctactgcttgatcattctgaaaatcaaaatctctggaaatctttacattgattaaccgttgaggaaagaaagtaacatcatgcatcaagtcggcaaacattaaacccgtgtcacgtaatgcgtacaaaacctggagggctgaaataattccgtcacctgtcgtatgtttatcacggcaaataatatggccggaattctcggcacccaagtaccagccattttgttgcagcaattcagacacataacgatctccgacatttgcccgggcaaatggaatcccgatccgctcaaaagcttgctcaacagccagattggtcatgagtgttccaactactccaccttgtagtacaccgcgctgttgtcgatgtttagcgataatgtaggccagactgtcaccatcgtatactaccccttctccacttaccatcagcactcggtcgccatcgccatctacagcaataccaaaatctgcaccgtgttgcaaaactgcaccttgcagcgtcttgatatgggttgcaccacattcatgattaatgttgaatccgtccggatttgcatgaatagttacaacatcagcgcccagttcatgcattacatgcccggcgacctggtaatctgcaccattggcacaatcaaccacgattttccagcctcgtaaatcaagctgattaggaaaagtacttttacaaaattcaatatatcggccttcttcatccttgagacgttgtactctacctaatttgatagaaggtgctgtttctataggaaaatccagttcagcttcgatttgaagttccatgctatcaggtagttttgagccttcagaagagaaaaatttaatgccgttatcataaaacggattatgtgaggcagaaataaccgctccagcctgaatgcgtagcgctcgcacaaggtaggctacagcaggggttggtaatggcccggatagcagaacatctacccctgccgctgaaaaaccggcctccagcgcagattccagcatgtatccggatatgcgtgtatcttttccaatcaagatggttggtcgtttatctgcagccagtttccaatcggacgccagcaatactttgccaacagcataccccagacgcaggaagaattcgggcgtgatcggaaattcccctacctttccacgaatgccatctgtaccaaaatattttttcttcatatcagtgtcgcttccctgttgaattccaaatcaaagcatttaaccggattcacaatatcacaatcagcatcccacagacgcgagcgtctgatagatcaacagcaaccagctactcaatcgtcatatttatattatatgggccttgttactgattaccgtacaaccaactattggccgggtgacgggtatatcagaaaacccggatgaatacgatccattgccgcaaacactgaaaatgcatcacgggtcgccttgacatcatgcacccgtacaattctggcaccttgtcccactgccagaagagcggctgccacactggcatacacacgattatcaactggactgcccgtaatcattcccagcattgatttacgtgaaatgccggccataacaggtagatccatagcaatgaattgattcagatggtgtaacaaggcgagattgtgctccagtgttttaccaaagccaaaaccgggatcaataatgattcgctcacgcgcaatcccggctgatactgccaatgcaacatgttgtttcagaaaagccatgacctcggcaaccacatccgaatactgcggatcaagctgcattgtctccggccgtccttgcatatgcatgagacaagccatcacagagctgtccgcaacaacttccagtgcaccaggagcttgcagcgcattggtatcattgataagaacaaccccggcattaatagcggcttgcatcacttccggtttggaagtatcaaccgaaactggaatattcatattcagcgcaaattctatgacgggcatgactcgtgacagttcttcatccgattcaacagatcgactcccaggacgggtagattcacccccgatatcaaggatatctgcaccttcctgagccaggcgattcacttgttcaatcgctttcccagttgtatcaaaacagccgccatcagaaaaagaatcgggcgtgacattgatcacccccatgatcagcggacggttttcttgaagaatcctttgcagtttattcacttggataagaaaaaatggcctgtacgttttatttcccgtacaggccattaattaagaatgctacagtttttctaggcttctactttttgagcaggtgcttcttctgttgttgcaggctcactttcgggttgttttacctcgccgcttgtgctggttgaacctttatcctgccgtggagaagaagaaggtgattgcggcggacgcggtgggcgaccttccataatatctttaatctggtcgctgtctatcgtctcccattcaagcaatgcttgtgtcatcgcctcgattttatccttattctcctcgatgatcttgcgcgcaagtgcatattgctcatcaacgatccgacgaatctcggcatcgaccattttcatggttgcttcactcagattcctgtgcgtagtaactgaacgcccaaggaacacctctccctcattttcaccatacaccataggtcccagcgtatcggacataccccattgcgtcaccatcttgcgggcggtatctgttgcccgttcaaagtcattagaagcgccggttgtcatctggttcatgaacacttcctctgcaatacggccgccaaacatgacagcaattgtctgcaaaatctgatcgcgatccatgctgtaacgatcttcagcaggaagctgcatagttacacctagtgcacgtccgcgcgggataattgaaaccttgtgaaccggatcagttttaggcagcaaataagccactaccgcatgccccgattcgtgataagcagtattgcgccgctcgttttcgggcataacaacggaacgacgttctgcacccatcaaaatcttgtcttttgcgcgttcaaagtcatccatatcaaccagacgtttattggctcgtgcagcaaacaaggcggcctcattgaccaggttggccaaatcagctcctgacataccaggtgtaccccttgccaagatactggctttcacatcaggggatataggaactttgcgcatatgtaccagcaaaatctgttcccgaccgcgaatatccggcagcgggacaacaacctgtctatcgaatcgacctggacgcagcaaagcaggatccagtacatctgggcggttggtggcagcaataacaattacacccatattgccttcaaagccatccatttcaaccagcaattggttcaacgtctgttcgcgttcatcatttccacctcccagacctgcgccacgctgacggccgactgcatcaatctcgtcaatgaagataatgcagggtgcatgttttttcgcctgctcaaacatatctctcactctggaggcaccgacaccgacaaacatttcgacgaaatccgaaccggaaatactgaaaaatggtacttttgcttcaccggcaatggcgcgggcaagcagcgttttacctgttcccggattaccacacattagtacaccgcgaggaatacgaccacccagtttctggaatcgggaaggatctctcaaaaactcgaccaactcggcaacttcttctttggcttcttcacaaccagccacatccgcaaaagtcacgttgttactcttatgatcaagcatcctggctttacttttcccgaatgagaaagcaccgccgctacgaccgcccccttgcatctggcgcatgaaaaagatccagacagcaattaacagcaacatcgggaaccatgacacaaggatgctcatcagcatggaaggctcttcttccggcttagcttccacagccactccagcctttagaagatcacttaccagccacggatcggaaggtgaatggacaataaacgagcggccatctgttttcgcacctctcaaagtacgaccgtcgattactaccttggcaatcctgccttggtgcatttcactgataaattgtgaatattccatgggaggctgtgatggttgtcgggtggagaactgattgaagactgtcatcaataccaatgcaatcaccagccagatagccatgttcttaatcaaattattcatattagctcctcaattttgcttctcgacgaaaccgaatttttgaaacgctgcggtttatctgtatcatctgttaccgcagtctatcagattattttttccagtcccagcaaatataactctttactccgatctcgcgaagcctttggtttcctgatgacgacttttgcaaaatcagcctgcattaattgtcggaatgcctcaaaatcactcccctgaaatactttgacaagaaaattttcaccggggttcaaatgttcgcgacagaacatcaaagcaagttctgccagatacatgccgtgagcctgatcactgacacgaataccggtaagattgggtgacatatcggaaattacaaggtctgcccgtttcccatccagaactttctccagtgcggccagaacaccattttcacgaaaatcgccttgaatgaatgtcgcgccaggtaagggttgcatatccagcatatccagcgcaaaaacctttccggtcggcccgacagattcgagtgccacttgtgaccagctgccaggcgacgctcccagatcgacaaccgtcattcccggtgaaaaaagtgcatcgcgctcggcgatttcctgtaatttgtaggccgcacgcgaacgataaccttcgtggttagccttacggacaaagttatcgttgatatgcgcttttatccaggctctgctggttctggcagatttcatcaggtaaaatccagtgttttgaggaaggttgtaatgcttgaacttgatatggctctgcgccggcagcttacggccagtgcgcaccacctgaatccggtagtaacgattggcaaggatggcctggcagaaagtgttattagtgagctcgatcggagtcttttgaagcatgaacttatcaagattaaagtgcttgaaggcgaccgggaccagagaacttctctgctggagaaaatttgcctttctttaaatgctgcgcctatcaagcagatcggtaagattttgattatataccggatcaacccggataaaaaaaacgtcgagaccacggctttgggcatatccaagtctggctttaaaccaaaacgcaaacccaagcctgcgcaacgaatgaagaaagccctaccgagaaaataaacagccgaagaaactgattgctatttctctcggacaagattccctaatacttagtgatctggtataactcagaccagtttacgcatatggagatgcttatgagcacaaaactggaactgccgattcaggaatttaccaccccctatccggtcaccgcgcgcgaggatagctcaattgatgagttactggatatcgtcaagaatctcaaggtacgccacattcccattatgtcgaatggaaaaatcacgggcatcgtcagcgatcgggatctcaaaatcgtttcggcattgagtgcccgtgaaaagttcctggtccgagcagatgatctaatgacgcccgatcccgtgacttttcagggcaacacctccatcgaggatgtgattctggagatgtcagagaaaaaaatcggcagcgttctggtggcagatgaaaagggagatctgcagggtatattcacagtaactgatgcactggatgttctgattgagatattacgaggcagaaaatgacgcaggttcgtgatctgatgacgcctatgcctcaaaccataggcttcgatatttcagtggaaaaagctctggagataatgaaagaatgtgcctgccatcatctccccgtactggatggtggaaaactggttggcgtattgagtgacagagatctgtcaatggccagacatgactcaaatgatgttaaagccgaacatcttgtcaaggatctcatgagtgatgcacccatcgtaatcgaaccttctgccgaaattaataccgctatccggacaatgctagataacaaaatcaacagtcttattgtcagagtagaaggaaaccagccgtggggtatccttacttcaactgatcttttgcgccacatcgtagaaaaaacctaaagcaaaccacgccgacaagccttggaggaaataaagaatatctactttattttctctagcagagctattaagtataaaaatcaagccaataatttcagaaacatacttccagcttccggtttatcacaaaccacatcagcccttactgacaaggactcgacttactcgcttctatagaaattcagcgaaatggacgacttagaaagcgcgacccagccaacccgaaacgccagggtatttcttttgccctggagataccaatacgcggcccggtaataactgttaccggagttgtggccggcagaagctgaaacggaggaatatcaaccggcatgccactatgcgccatagtaattccgagcgcctgacaaagccgcccgggacctgcgcagagcaaacgtacattatccagtccgcgtcgtttccgcatagtatccaatcctcctgccagcggctccagtgcgcggatcagcaccccggcaccgtggcctggcggacaacacacaatattgaagcaccaatgtatgccgtaagagcgatagacatacgcatggcacggtggcccgaacattacctgattgcgcggcgttattccaccaaaacaatgtgaagcaggatcctcatgatcataagcctccacctccacaatccgaccacctacaccattcagcataagcgtcacgcctatcaaggaacgcgccacttcagcagagggagctgagaaatcaatatcaagagatgaaaccagattcatacacgacaaactttcaataaaattagagcaactgttcgatatcaccaaccagaaattccggcttatcaactggcgcataacgtttaaccactttcccggttctatctaccagaaacttggtgaaattccatttgatgcccttggaacccagcacaccaggtttttcattcttcagatattggtagagcggatgggtattggtgccatttacctcaatctttgcaaataaaggaaagctgatgttgtaaccagatgagcaaaattcctgaatttcacgttcattacccggttcctggcggccaaattggttacagggaaaagcaagtacaaccagcccctgatccttgtatcgtcgatataacgcttccaaactctgatactgaggtgtaaaaccacatttactggccgtgttcactatcagcaagactttacccttataatcgctgagcagtttattctgcccatcaatcgtttttataccatagtcatagatatccatcgctatttataatgctactcagaaattatcatgattagaaaaaatcccacgggtgatcagccgatcgtccacaaaagtgcttttgttgatcccactgccattctctgtggacgtgttgtcgtacatgaaaatgtgtttatcgggtcatacgttgtcattcgagcggatgaggtggatgaaaccggaaatatggaacccattacaataggtgcgcattccaatattcaggatggcgtagttattcactccaaatcgggcgcagcagttactatcggggaacgcacctcaattgcccaccgggcaattgtacacgggccttgtactgtcggccccggagtgttcattggatttaacagtgtactgttcaactgcacaatcggtgaaggatgtgtcgttcgccacaattcagtcgttgatggctgcaatctgccaccaggcttttatgttccttccacacaacgcatcgggccaaaaaccgacctagcttccatcaaaaaagtaacccccaaagcatcaaaattttccgaggatgtcgccagaaccaacaaaatacccttgtacaagggtataagcgtattcagaatgaactttagggaacttcggacaatccgcagcataaattgatcatcacccagatgctgctcatactccctcttttattttaatatcgctcaaatacagcttatgaaaaaatccatattgattaccggttgctccagtggcattggctattgcgttgcgcatggattgcaggcgcgcggttaccgtgtttttgccaccgcccgcagacaagaaagtgtggacatgttgcttgctgagggattagaaagtttccaacttgatctgaacgattccagctcaattcgacgcgctgttgaagaaaccctgaatcgcagtaatggccaattgtatgcattatttaacaatggtgcatatggcctgcctggggcggttgaagatctcagtcgggaagccatgcgcgcccaatttgaaaccaatttttttggttgggtggagctgaccaatctgatattgcccgtcatgcgcaagcaggaacagggtcgtatcatacaaaacagctccatacttggctttgctgccatgccgttccgaggcgcgtacaacgcctccaaatttgcagtcgaaggctggagcgataccttacggctggaactgagagggagcaatatttttgtcagcctgatcgaaccagggccaattgccacgaaattccgtgccaatgcaatgaaggcgtttgaacgctacatcgatatcgagcacagtattcaccgcgagaaatacctcattgttcaggaccggctgaacaagcagggacccactgtccctttcactctgcctccagaagccgtattgaaaaaggtgatctgcatacttgaatcacgtacccctgatgcccgctattacgttacctttccgacccacatgtttggccttctcaagcgcatcttgcccgtttctgtactggataaattattggctaaggccgggcacaagcatcagtaaagaaatatagtgttccaatatttccagacacatagttagattcttttcaagaattatgcataatgaatgcctggtaatttatcgttgcagccgaagggcaaactattgatcggtatgctactggctcttccgaaaattgatgaaaattagaaatattctatgaccatcccttcctatcccctgctgtatcagctcaacgcccgcatcagacagtacgagctttcacgcgctgctatctcacctcccccactgaatgattggcctgatagtgaatgggatcggttagctgaactggggtttgactgggtatggctgcttggcgtatgggaaaccggaaaagctggccagcgtgtttcacgtacacagcctggttggcagaaaagctttaaggccgcctgcttaccggatttatccgagacagatatttgcggttcctgctttgccattacccgttatcaggtggccgacaggttgggaggaaacaaggcgctgcagcacctgcgccacaaactcaatgaacgcggattgcgcctcatgctcgatttcgttcctaatcacaccgcactggatcatccctggatgcagacacaccccgagttctacattaacgggacacgggaggatttacagcgcaatccacaaaactatgttgcacttgtatcgaattcatctggtaaagatcagcgaatttttgcctatggccgtgacccttactttgatggctggccagataccctgcaactggattacagcaatcctgccgtacaacaggcgatgcaagtagaactgctaaacattgccaagctgtgcgacggcgtacgttgtgatatggccatgctgctgttgccacaaatttttgaacgtacttggcagcgctccatcacctccttctggcctgccaccattcaggcagtccgcaaacaatttccgggcttcctttttctggctgaagtgtactgggatctggaatggatgctgcagcagcaaggatttgattacacttacgataaacgattatatgatcggctacttagccaagttcccaaacctgtgcacgaccatctcacagcagatatcacttatcagcgcaaactcgcccggttcctggagaatcacgatgagcagcgcgcggcaactgtttttccaccgactgtacatgaagcagcagccatgatcaattatctggcaccaggaatgcgtttttttcaggctggacagctggaaggcaagcgggtacatatcccgattcacttatgcagaagtccggttgagccgacagactccagactcagtcacttttatcaacaactgctgcagattctgaaaaatccggtgttacgacagggaaactgggtattgctggaatgcctgccggcccagaaagagaatgggacttggaataatttcatcgcgtaccgctggcagggagaaaacagtgactctctgctaatcatcgtcaactacgcacctcatccgagccaatgtctactggagtttgctgatttacaaccaagagaaaataccaggagctggcatgatctgatgaatccgagtgaatcgttaccagttcggatagaaaatattactcggctttttgttgacctgcccgcctggggttaccacattctggaaaagcaaccttaacctcaacctcaactcattcagtggaggcacgccgggagagatgcaatttatccactgtctgcatcaccagggaataaacggccggcaccaccactaatgtaagcagtgttgaggaaaccatgcccccgataactgcaacagcaagcgggcgattggtttcagcaccggcccccagccccatcgctgccggcagcagtgcgaggatgacagtcaacgaggtcatcagcactggccgcagccggatcggacaggcttccttaagagctgcatcaatagacttgccctgttcacgcagttgattggttaggtcaatcaacaggatggaattttttgccaccaggccgatcagcagcaccagcccgatcatagaaaagatgttgagtgaattgcccgtcaaccacaaggcaaaaataccgccaataatggcaagtggctgcgccaccataatgataagcggctgcagaaaggaattgaactgactggccagcaccatgtaaagcaaaatcagtgcaagcgtaaaaataaatacggtactcttcatcgtcttggccaattcttccgcctgcccggtaagttttaccgtataacccggcggcaataattcagtagcctgctgaaatacactatcggttgctttatccagcggcagtatagggttgatatagaacatcgccgcatattgcagatcaaagcgcccgattaacgcggcacccagggtatcccgaaattcagcaaccgcatccagtcttaccaattcattcccgttacttctcagataaatctttttcagatcgtccaactggctaaaccgatcttccttacctttaatccggatctcatagcgttgcccatccccgggatcatcgttgaatctggccacgtcaacaccaccggtaaacatattgattgccgtggcaatatcggttgcagatataccgagactggcagcacgtgtccggtctatattcacgatcagctgcggcaaatcaagatcaagatcaagatcaaccttgcccatccctggaattcttcccaaccgtagctgcatttccttagccagacgccccacttcctgcagattggagccagtcaaattaaattgtaatttttctgagcgttggccacgcacaatggaaatcggggcaggaaacgcccggacgccaggaattttatcgaaatgttctctcagttcacgcatcaacaccttctggctcatattacgggcgtttcgatcatacaagcgtacattgacaaaccctttattcacctggccatcctgcccggccccaatcattccaaaataactgataacctctgagggatacgttgccaacacacgctcgatcaacctgaggcgggaatcggtatagtcaatacttgaaccgagtggcgttctgaacgttattgtaaatacaccttcatccgtttctggagaaaattccttatctactttcccaaagaagaaaatactgctcaataccattatgatggtaagcacaatgactttccaacgatgctgtatggaaaacgtcagcagcaaaacataacgctgatccatgcgatcaaaccaactatccagccaataatagagacgaccatgtttccgatcgacacgcaaataacgtgaacacagcataggtgtcagcgttaatgaaacaagcagggaaatcagcacaccaaaggtaacaaccacagcaaatgacttgaagaatttgccgatgataccttccataaagattactggtgcaaagatacataccagcgccagcgtagctgccatgacagcgaataccacttcgtgactgcctctaatcgaggcagccaccacatccactttaccgtgccttgcctgatcgcgactcatatgccggaaaatattctccaacaccacgatggcatcatccaccaccaccccgatcagcaacaacaaggccagcagcgtcatagtattaaaagtaaaacccgagaaatacatgacagcaatggcacccatcagtgataccggaattgcagtcgcaataatcagcgttgaacgcactgaacgcagaaacaaccagacgatcagcgcagctagcaaggtaccttcgactagatgttcctgcagtgcatataccagctccttgataaaaatcgcatcactggaagaaatactgatacgcatcccgggcggcaagctcggattgatatcttctgccagccggcgctcaacttcatcgataatagcaaccgtgttggcatttgaaaccttgacaattcccagtcctagcgagggtagcccattgaatcgggccacttggcggtaatcagccagatcatccgcaatctctgcaatttccttcaatctgatcggagcaccttcacggtaagctacgatcagattgcccatatcttttaaattatgaaactctaaatccagcttgattaatctctccgtgtttttacctgtcaggaagccacccggtagctgaatatgctcgcgccgaaaagcattgatgacatcgctggcagccaggttataggtagccatacgctcgggcaaaacattgattcgtatcgtgcgatctcgccgccctcccagacgaacctcaccgacaccatcaatggtttccagttttttcttgatgacattaaatccatacagattaagttgctgtaaagtccgatcaccctgcagcgacagccacatcacaggctgtgcgttagtttcgattttgcgtacgattggcgggtcggtatcatctggcaaacgtttcagaatctggctgatatttgcctgcacctcgttataggcaacatcaatattcttatccagaacgaaggtgattgttgtcgttgagacactcggagaagagctggattgcacatgttcaataccgggaatggtattaatggcggtttcaataatgccggtaatactggcatcaacaatatcagggtttgctccaaccagtgtcgtagttaccgaaatgactggaaattcgatatatggccagcgatccattccaattcgctgataactgataacacctagcaataccagtaatcctgaaaccatccacgccagcacatggcgcttgatcgacagctctggcagcgtcatgaattcgcttgccccagtatttccctttgtatagtgaccttggtgccgtcggtaagaaaagctgcaccatccagtacgatctgctcacctgcttgtacgccatcaatgatttcaaccattccatcctgatttaatccggttcgcacgacacgctgttcaacctgctcgccattaatagcataaaccacctggcctgccggcctaagcactacactctgctccggcacaaccactacattctcacgcacgccaaggatgaccacaccactaacgcttgcacccgcgtgccaaccaggctggttctcaatatagacaagtgcatcaatcgcccgattgctaacaccaattgcaggcttcaattccctgatatgggaaataatttcagtatcagaggtaggtgtgctcagcctaacttcaagattcggtctgatatatgaagcaatactttccgggaatggcagatgtgcacgcaaatgctgattactgataatttgtagcaacggatcgccaaccttgacatagtctccctcaacaacggtctgggattcaatttttccatccattggcgaaaacaggcgtgtcttagatttattatgttcaattgtggccagacgggatttcgctccttccagctgccggcgcaatgctatttcctgagtcttgacatcatccaacacgatctgggaaataaaatttcgttctaccagccgggtattacgttcgactgaacgctgttggttttccagcaacgcctccagtcttgccacctcgctgagcgcttcacgtcgtagcagctgatgatccgccggatccaacaaagcaatttcctgtccttttttcacatgttgcccctggcgcaccaatactttaaggacacgcccagatacttccgccgcgatcgtgggatccattatgccctccagtgaaccaatggattcctctcgtacttctatagacacattcctggccgtagctacactgactgctggcgggttagctatttttataacctcttcctgcttaccacaagcagtaagcatcagcatcagaacgatacacaacagtttctctgccctactcaacaccacagtcaacgctctcctgtaatccacaaatggcaaccacgtgatctaccacatcaagattatcccagctgtaaatttaccggatcactcggtagataactgtctcacacacaatcagaatgtgtcccccgcaagaggtaaagaatcgaggaatattatcaaatatataccctctatcttcttaaaaataaaaagtcttttccttttcgtgagatttggaaacaaatgataaagctagagtgatagggcctgagcgattccaagttactaaaagcaacagaaccaactaataattgaaagtggaggtagattaagatgggttactacggaataagtcattcttatttcgagctatccccaccgaagaaaaaccagtgaggatagcgtaaaagcatacagcacagtggcaaatatcgccgctgtgcagttttcagaaagttagttcacaacaggcgtgagatgcacagctagtgcgactaatccagctaatagtaccaataaaaatacactggcaaatatcatgttcttggtggtgtcagtatcgctgcctttttccactgtactcatttttcgtaactcctttattgtatgaattagaaacgaaacaatgatgaactaaatttacatcctctttgttgattcaaatcaacaaagaggatgtaatcaaccaaaaatattgtagtggtctaatttgtccggacacctcgataggtgaaaaatccaccatccgagaagttttacatgaaaaagcaacgcaggcaatttgataccagcttcaaactagaaatcgtacgtatgattaaagaacaggggctgagcatatcccaaatcagtgaaagcatgagcatcggccagagcgccatccgtccaggtgacccaatatgaatcagaacaaagtgagaattctggcatcggcaatccgctgactgccgctcttgagcaaatacagcaccgcacaaaacaacctcgtacagatctattcgtcgagggctggtcttcctacgcgcgctctccagcaaggcttgataagctcgaattgttcacgactgatgtcgctcgggtaactttttctcatctcccgagtttctcatactcccagagattttgaacaggttcttagacataactatccaagattctgtcccattaacgaaagaaagctgatatctggttgattttatcaagcgtacagttggccttgatgcgactatcttgcagagcatagaattattcagaataagtcaggtagattcaactttgaagtgcaactttagccttttaattacctaaacaaccccacatttcatgcaaatgagcaggtgtcaccacattgccccccattttattttttattcacagcggagtaactggtcatcagattccgataattgggaatatatttggagaataaggagcccaaaccttcgacgtcgttgcgccagtcgcggtgcagctcacaagctacgccgaaccagctcatcatctgtgccccggccgcctgcatgcgcagccaagctgcatcacgggttacttcattaaaagtaccagaagcatcagtgactacgaatacttcataaccttcttcgattgcagacagtgctggaaaagcgacacatacttcagtgactactccagcaataataagttgcttgcgatctgtctttttaattgcattgacaaaatcttcattgtcccaggcattgatattaccaggacgcgcaacatatggtgcatcaggaaatatttcctttatttctggtaccagtggcccgtttggaccatcctcgaaactggttgtcaagattgtcggcaactgaaaatacttgccacaggcagttagtgctagcacgttatttttgaattcatttggtgagaaatcctgcaccagagaaattagccccgcttgatgatcgatcagtaataaaaccgcatcatctttggaaagtcgattgtatttaaaagtattattcatttctatgctccttgtgattggtatgacaagattttcaggaaagaggataaaaaatggtcgaccagggcctgttgagattcacctggcgttgatgacagcgggtacctgataaatggctgatgagaagctgcagtcggtcttgtcgctgcgtaaagcaatacgcttaaactctttgagttttcaaaagaaattttctatgggatggcgccatttgtatatctccggatcaatggccagaggatttttgcgtcgactcatctgagagatcaccatgtgacagtctcgctgctgtaacgcttgaatcaaccagtttgcatcaaacgctttgtctgccaacaaggcgtcaaaatctacgccagtgatcatctccttgacgcctttgatgtcatggcgctaacctggcaggagcacaaaccttaccagattgcccagcgcatcggtcagagccagtcactccaccgcgtgagcgatctatggcctgatttgaggccccccttttgcaccctgaccatgccgccgatgtaccttcacaatcgtggcatcaatcattgcgtactccatgtccggatgatcactgacggcattgaacaaacgtttgaatacacccgctttactccaatcccgaaaatgcttgaaaatcatgttccatttgccaaattcggctggtaagtcgcgccaggggctacctgtgcgtacaatccacaacatagcttctacaaactgatgattgttcgtgccactacgtcccggatcgcctgccttgcctaaacaatgaggcgccatctttgcccactgtgccctccatagagtgttcatacataaattgagtccaaataatccattagaaaccaacaaaagatacacaaaatttacgcataataggcaaatttgggtcgaggcataatccaccacatatactaaatgttgaatctcaacagaccctagtacaatgcatagaatcgatcactgataatttttccatctttccaatgttgaacggctacttgatcgaattttttgtgtccaaaatccctgtgtttatattcgaagtgccactcggtcattgtgacgttatccccaacagccgtcgatttgatttctgatttaagccacgcttcaacaccttcaaagaccgatgattctcgatctttggcttcttgtataccatttgctaccacgtcattcttttcaatcactacacaatcggcgtggtagtatttgtccatggattccagtatttcgccgttcagaaccatattatttaaatcattaagctttgattccaaattcattatttactcctttttgaataaaattaggtgaattcagctttgaagtacaaacgcttttgtaagaacctgttcaaaattttttaagcaaaagagccaagaatgccagatgaatgaattgcaagctggtattgagcttacgctcgcagttttttcacagctgtcgattcttctccagccaggcaaagctgcgctccaccacccagcgcttggggataacggtgaaggtatgcaattcactgcgtttggcaatctgcaccgtgacaagtttgtccagcatttctcgcacgccttcggcaaatggttctccggtatagccgctgtcgcacagcagattttggatctgccccaagctcggcctgcagtgctccaaggcttgcaacgcacctttgcggtcagtcacttccgccgttgtcaccacaatggcatgcggcaagccctgagtatagaccgcgacatggcgtttgatgcccgatacctttttgcctgcgtcataacccttttggctcgccgtgtccttcacgctctgcgcgtccacgatcaagaatgacgtgcaggcgttgcgcccctgtctggtacgaacctcgccaacctgatttttttaacgcccgctccagatcgtgaagtatgcatgcaccgtgcgccacttcggaaaaccgtccggcaacaggcgccactggcagccgctcttgagaaaatacagccccgcacaaaacacctcgtacagatccacggttcgcggacgtgtcttcttcctcgcaccctccaacaacaggcgcacctgctcgaattgttctcgactaatatcgctgggataatattttctcatccagagagtatctaccaaaaaagattttgaacaggttcttatcaatctgcaaagattcaaaaaaagctgggcagcaaaatcaataagcgtcagcagatgttaattatccctcgataaaaaacctgttttacttctctactttaacttgtgtggatgtaacaaaaatcagttcattaaaagtccggttcagggttttgctggtgaagttgtgcattttcatattctctacgaagcgaatatgttcccctttctcaactttggttgtcggcgccgcaatccagaatttcttgtcaccgtttgccagctccatataggtatatcccgctgtatcgatagatgagacaacaatgccctcatcagcaggaaacgtttcacctctggcaggtgcttctgcgtaagcagtagagatattaaggctgataagtgaagccgacaaaattacagcaaatagcgttttgaacatgttttttcctttccaaagttgaaaaatacgattctggcctatcaatcagaaccggaagttatattgtgcatagaacaaatcaggtgaaacaccgggacgctgatttttaacaaatgtaccggtaaaaaattttgaatagcccaacaaaatatcatggtgacgattgacatggaaattaaccacaaaatctatttcatctccgacatggctgcctgattgaccattaatatcccgtataaatcccatccctgctgcgttgtacagatagtcacgcttgtttgccagataaaaacggtgatactgcccggtgagtgatacccatggctgcggattcatcgaaaactgggcattgaagtcatggatattctgccgtcccacctgatccatatacccgaaataataatggccaaacgggaaaagctggttaaacgtattgctatatccatcacctgggtttttatctcctgaggcaaagtcatagcgtagccagaattgaggattcatcggcaaaggcaaatgataacctgccccggaagcaatagaaaaagcggaaatatcaagatgggaacgtctcccgaactgatacataccctccagttcgtagaggatgcgctcataatcacctgcccagcgcgcgccaatggtatgcagcaccgaatcaccttgtaacacattaccctgggtaatattggcaggagaaacagctctgttatcaatcaaattcaagtaatacagatcaagcacctggcctggaattgctttataagttccccacaaaccaacaaagttacgatccttatcccagttatcgaactgattaggctcggtcaccattggtcgcacccagaatgcatccaagttgaatgtcgggttttgccagaatgtttttatcccctggaatgtgcgacgggtatttgcccagtctagtgttgatatcaaccgctgcgatccgtatagcagttcctggcgccctactcgcagataggccgggccatccatgaattgccccagtttgacatctgcaaacagattgagcatatcagtatgattcttgtcgatagcaagcggcggcaaatccagccccagtgcgcgcgcatccagcatctcggcaaacaaccggaagcgatcctgataccaaagatcagcatgaagccgtgttcgtaacaaatgataattattgttggcttttgctggattcaggcggctgtcagtttcacgcatgtagcgataccagaagctgccaccgaaagacagtagccagtcatcacccagatgaatacgtttaactggatcaaaaaaatccttttcatgatctggttgttcaagatagcggaaatcaaaatcaaatgccggagttgttgtcagcgctgcaggcgggtgagggtcaaactgtggtttatcccgtctgttgccatcaaaccagtccagtaatgaaaaatagccggggcctgctggaggcttgccaaaaatcccagagcgaggtggtggtgttaccggaggggctttagaccaatcaatctgatgattttcagtaacggaacgctcgctggcaaacaccgggctgctcccgcttatacaaatgaggcaggcgatggttacctgcagaccagctctgattgtacccgatagtttatctataaatgattcagttaatttcttaatcaaactgttctgactaaggctgaggtcagtagcgtcagttatatacattctggaataattattatgagaaggaatgattaaaagtttcaggttgattattcttcgtatcgagctctgaaacatccgaaactaatttcctgacaaattttacacatattcattttggcaccgggataaaaaatttctcttagctatatttttctcaaacgtatcctcacacaactattaatgcgccacatcgctgaagaagaggtaatcaggcacttgcaccgactgctacacttggtttcccagaacgccggggttatctcgaattaggtagaatctgcttaaaactgtcaattaatttaataaggttaattattatgaccaataccaaccttaatcgtcgccggttcttgcaatatgccgcatctggaacacttgccgcagctatacctgggtttgcgtttacagaaagcgataaactcaataaaacacccaatagcgcattcaaggccgacgttgaaattgccctgacagcacaaatgaccgaggtctcaatcctgccgggagcaaatacccgtgttcttaaatataccggaaaattactgaaagggccttctggtacgcttaaagaactacccagctatctggggcctgtgctcaattttgaacaaggccagaaagtccgaatatttttttacaatcagataccagagccctgcgtaacgcattggcacggcatgcatgtaccgcaaattatggatggacatccgatgtatgcaatcaaccagggtgagcaatatgtatatgagtttgaagtgaaaaacccggctggtactaactggtatcattctcatacacatgaagtaactgctagacaagtgtatcagggtctcgccggactcattactatcacagacgagattgaacgcaaactggatctgccaagtgatgaatacgatattccgcttatcatccaggatcgaacttttacatccgggaatcaattgcattacgcactgaacatgcatcagcgtatgcaggggtttcttggcgataccatcttggcaaatggccggcgtaaccatgttattcccgtaaaaacgcgtgcctaccgtcttcgtatcctgaatggatcaaactccagaatctacaaactgggctggagtgacggctctccgcttaccatcatcggtacagatggtggattactggaaaaaccgcaaaccttcccctatatcatgcttgccccagcagaacgggtagagctatgggttgattttagcggtcgcaagcctggctctgagctggctctgcagactttatcctaccagggattttccatgcgcatgggaggtggaatgggcatgggaagtaatacgatggaccagggaaacaaaggtaccatcgtcaaatttgcaatcaccaaacaagtaagtgattcacccagattgcctgataccctggttcccatacaccgtttcactgcgaaggatgcttctaatccggatatcgtggtgccaattgccattggcatgcgtcgtatgaccttcaatctcaatggccgaacctttgacatgctggattatacgaaccaagaaaaaataccagtaaataccgtgcaaagaatccggatatccaatatcaatccgggtatcggagggggtgggggcatgggtggcgggatgcgcggtggtcggggaggaggaatgatggggatgataatggcgcagccgcacccgatccatcttcatggccagcaattccagattctgtcacgcaaacctggccatgctgacagtgcttacgctgcaattaaggatggatttatcaacagtggctggaaagatacagtgctggtgatgccaggagaggaagttgaaatcatcaagccatttacggactataccgggctatttctttatcactgtcataacctggaacatgaagatatgggtatgatgcgcaatttctttgtcagctgaatctgggttggtgttgagtacaggcatacaatttacctgtgccgtactatacgaataccatccaactaccggcagtcttcagattcaggaagatcagcgggcagagccagtatctggcaaacgcgccctgatccagtcacgccactgaatgaacaaatcatgatcaagcgcaccgataactgaacgacgccagggatagcttgcccagtaatcatcctcctccagcgtacaccgatggccacccgcctcctccagtatcaggcagccagcggcataatcccaaggtttctggccaccatgtaaatacagatcaaaataccccgctgcggtataacaccattccagcgtgcaagtgccatagtttctttgtgaggaataaggaggtttggcaacaatttccactgccagcttgcgattcagccgcttgaaatcaacattggcaatcgctttgtttaatggaattttacgtctggaaagaggtaaggctttgccattaagaaaagcacccttcccctgctcagcataaaacatttcatctgtcgccggattgtagacaacgcccagcacacttctgccccctcgcatcagcgccacagaaacagcaaaataaggcaagccattcatgaaattggaagttccatcaattggatcaatactccatatcccctcctggccggcttcccactgttccagttgttgcgattccggcatttcctcgccaatcatcgccacaggagaaatttcatataatctctccaataaacttccttgcgcagccagatccgcctcggtacaaaaactgccatctgctttatagatacgttcaacttgcagataacgcggaataatctccttgtgtgcaacctcccttactgccgtgatgacacgatccagcatgctcaatctgctcgccacttgattgaacaaccaatactggaaatttgttcttcaggcccatttccggttttcgccacctgaaccattgcctcgaacaaatcacggcgtgcatcatcaggtgctgcttccttgcgggaggcatccagtcgaccacgatactgcagctccagtttattgttgaagccaaaaaaatcaggcgtgcagactgctccgtatgctttagcagtttcctgggtttcatccattacataggggaacggataggcatattcccgggcaattttacccatgctctcaaatgaatcctccggataatctgccggatcgttagacatgatggcaattgtaccgatgccatgcccagcaagctctttgacgtctcgaatgatccggtcacgaacagcttttacataagggcaatggttgcatataaacatgaccaataacccattctcacccagcacagatgccaggttgtaacgcttaccgtccaccccgggaagatcaaaatctatcgccttccagccaaaatcacaaaccggtgtttcaagacttgccatctagccactcctttttcattaatcaatttcattcttacctatactatcataaaaatattttgttactttttctctcaagatatcaattcttttttatatgacagcacgcttttttcatactctccctattcatcccgatgccaaacaggttacgctaaacaacgataccagtcatcacgcagttcaggtactccgattaaaacagggagatccggtgatcctgttcgatggtacaggaggtgaattttccggttgccttgtacaagtcagaaaatctgcttgtgtcgttaaaatcgaacagcacctgccagttgagcgtgaatcccccttaatgcttacgctggcacaagctgtctgtaccaatgaaaaaatggactggatcattcagaaagctgttgaacaaggcgtcatttatatacaacctttgattactaaccgtacactcatccgactcacaggagaacgtgccgataaacgctggcaacactggcaaaaaatcattatttctgcctgtgaacaatgtggacggaacagaattccccagctgttaccacttatgtccctatctcattggttagaacagaaactgttgcaaaaacaggaaaatagtaatctatccgggcgcgatataatactctcccctgtcgctcgtctgcgtttggccgagttgtctcctcccgaatccggggagtgcattacattactgacaggcccggagggaggatttactgaagaagaaaccgacgccatgcttcacgccggatttatacctatctgcctgggcactcgtattctgcgcaccgaaaccgctgcattggcagccattgccgccgcccaggtgctctggggtgattattaatagtgcttctaccttgatcagccatgcaatcggacatcgaatttgttacctggtttcgctccgttactccgcatatccacaccagtcgtggaaaaatcttcgttatcgcttttggtggtgaagtcgttgtgaatggaaaatttgtcgagctggtgcaggattttaacctgcttgccagtctcggcatccagctcgtattggtgcatggcgcgcgaccgcaaattgaatccagattacaggctgatcagcaggaaataagttacgtacaaggtatgcgtgttaccgatgtcactacactgcaatatgtgaaagaagcggtcggtaaagtccgggttgaaatcgaggctctgctgtcgatggggctgcctaattcgcctatggccaatgccgccatacgggtagccagcggaaatttcgtaactgctcgcccgatcggtgttttggaaggggtggacctgcaatacactggagaagtacgccgtatcaatgccgcagccatcctcgatcaacttaaacaaggggttgtcgtgctgctctcacctctgggctattcaccaacgggagaaatttttaatctgacagtagaaaatactgccgctgaagtcgccattgccctgagagccgacaagctaatttttctggtagatacgcccggcatccagcaacaaacagaatcaggtaatacgttattgcaagaacttactgtcaggcagggtaaagcgctacttgcggcaatggatactgcagcagatcaaccaaatgaagatatccgcctctatctgccatgggcattgcatgcctgcgaacagggagtggaacgtgttcatcttatcagtcgtcatgctgatggcgctctgttacttgagttgttcacgcacggtggcattggcagcatgatcacacgtgacccactacaaattatccgtcaggctgatatcaaggatattggtgccatactgcagttaatcgaaccactggaaaatacgggtattctggtgaggcgtggccgggaattactggaaatggaaattgaacgttttacagtgattgaacatgacaacgtgatcattgcctgtgcagcactctaccctttcccggatgacaaagcatgcgaactggcctgcgtcgcagtacatcctgcatatcgcaaagcgggaatgggtcggatactgattgatcacctggaagaacaagccagaaaacaaggctaccgccatatatttgtcctcactacccgtaccgctcactggtttgtagagcgtggtttctcggaaaccacccctgaccagcttccacagtcaaagcagcatctctacaactatcagcgccgctcaaaggttttcgtcaaatcaatctgaaacctgatcgcccactctgcctattgttctttatcgctgaggaacacaaatctggaatcatgcaaaatcagctttgaggattatcttcttgaggctcatcttcatccggtattcggtaggaatctgtagcccacaatcctaaatcaagtaatttacatcgctcagaacagaacggacgatacttgcttgatttttcccagacaacgacttcaccacattggggacagtttacggttggagatttacctggtcgcctttccattcaatcacaccactactcataaactgcagaaagtcaattcaaaaggaacatcttcttcacacacttctgtcttgtgatccgagcgccagggaataaatcgtatattgagtgcatatttattggcactgatctccgggatgcaggaaatttcatcactgatatgcaggcacaaaagatgtgcctgatgctctgaaccagcctgctgaaatactcctttagcagcaatgtaacaaaattttgttccgctgtttctcaatatattcagtatgatattgatcccgctacggatagaagtaagaggtgtaatccagttctggagatctgccctgcgggcatctggagccatattcagccagtaatgataggctggcaaatcaaactcgcacgcccctcctggaatgctcatacgctgcttgacactcatcagccattcatcatcccgcaaatgtccgccaatcctgcctggtatatcaagcaatccacggaaagcagctcgaatatcctgcaatatatgaatgagtgctttttctgatacgcccgggttatcttgcaaaccttccagcatggttcgttgtttatccaattcctgcagcagatccgacttaagatcagatctgctggtaacatcaagaatttcaaacaatgcaaccagagcagcatgatgttcgaaagaggtatccctagccgaaaaaaaatcaattttgtcgaacaaatcctccagtctcagtaacatgcggattcgttcgttcaggggtaattcgtaacagatcacagtaagtaagatgacgtaggaatgttaaagcatagcagaaaactgcagttacatgcatcttaccagaatcgttcagaagctgtgtttgtcaacaagcgcaagatatttctgatgtagcattcgtacctgttgccgcaggtgctgattgtcggagtcgttgataatcacatcatcagccagagcaaggcgttcgtcacgtgagcactgtgcggccatcactttacgtacttcctgttccttcagcttgctacgctgcatggtacgggaaatttgcagggattctggacaatcaaccaccagcacacgatcaatcagctcaggataatcttcagcctccagtaacaaaggcacgaccagaatgccgtaactggattgaatcagcgggagacgtcgcctgctttcctgatagatcagcgggtgaagtatggcttcgagcttacgccgcgccacttcatcagagaatacgagctcgcgcatagccactcgattcagtgaaccatcctccagtataaaatggtcaccaaacacgacacgaattccctgaatcgcactaccacctgggcgaattagttcatgcgccaagtgatcagtatcaataatttcaatacccagctcctggaacagatcagccacactggtcttgccactgccgattccacccgttagcccgataatgagtcccatacgtcaaaatatggccaggtatgcctgattgatctgactgccccagaacaaagcaattaatcctcctcctgccagataaggaccaaagggaagtgttgtaccttttgaacgattagcggccaggatcaggatggtaccaatagcagcccccatcacagaagaaagcaagattaccagtggcagtaattgccaacccaaccaggcaccgactgcagccagcaacttgaaatcaccataccccatgccttccttaccggtaatcagtttgaacagccagtacacactccagagtgtcaggtaacctgcaaccgcaccgataacagctgaatggatatctacaaaaccattatgcagattcacgatcaggcctgcccataacagcggctgtgtaatactatctggtaaaagctgggtattcagatcaataaatgtcaaaataatcattgcccaaataaaaatcagcgcagcaagtaaaatcccactaaaaccaaaatgccacgcagcaaaaccgcttagaatagctgtcagagcctcaaccagtggataatcaaatggaatacgagcctggcaacttgaacagtgtccgcgcaaaagaaggtagctgataatcggaatattttcgaggacggaaattttatgaccacactgtgaacaaccggagcctggtatagccaggttatacgccggcagtacttttacctgctccccacgcaactcagcacattgttgcatccattcacgttttaacatcacgggcaacctgtaaatcactacattcaggaaacttcccagaatcaggccaataagcgagataaatgaaataaaaaaagctggtgaagcttgcagggtattaaaaatattcatgcactgcctgtcctgattcagtcgtgaaaatggcactatctggttatccgaccacctgccccattttaaaaataggcagatacatggcgaccaccattccgccaatgagcgtccctagcaccaccatgatgagcggctccatcagactggaaagtgcctccaccgcatcatccacttctgcctcaaagaaatctgcaattttgctgagcattgcatcaagcgaacctgattcctcgcctatggaaaccatctgcagcaccattgaaggaaaaacattggttgccatcatcgcatccaccagactgctgccggtactgacttcgttctggatattttttgttgcctcataatacacttggtttccggctgcgccggcaacagaattaagtgcctcaaccaaaggaacaccggcagcaaacatagttgaaagtgtccgcgaccaacgggcgatcgtagctttacggatcacctctccaaaaattggtaacctcagagccaatcgatccatgacatgctgcattgcggcagaacgcttccaggcataaaaaaatacataaagccccccaccgattcctccaaaaattgcccaccagtatgctacaaaaaagtcagaaatagtcatgaccatcagggttggggcgggtagatcagcaccaaatccctggaaaagctccttgaaagccgggattacgaatatcatgattactgcggtaatgatgaaagcaaccacaatgattgaaacaggataaaacaatgccgattttattttccccttgatcgcctgaatcttttccttataggtagccaacctgtcaagcaggttatccaggataccggcagcttcccccgctgccaccaggttacaaaacagggagtcaaaataaagtggatgttttttgaatgcattagccagactgctacctgtttccacttctgatttgatatccatcagtagtttcccgactgcacgattactgtgtcccttgcctacaatatcaaaggcttgcaacaaaggcactcccgatttcatcatcgttgcaagctggcgtgtaaacaacgtaatatccttatcggtaatttttccacccgccctggccttggtgatttttgttactctgataccctgtttgcgtagtgtagaagtcactacaacagtgccagccgcacgcatttcgcctttaatcgcccttccggttttatcttttccttcccatataaaattgaattctttgactttcttttctgatgtcgcgatcgttaccatgccaatttccttttatcttgctgatctggatcatagttactacggcagaaagttcaggattatttaactggtattttttctatctctgccagacaggctcccacagtcgggtaacgtaaccggacttgcaattcgcgtttgatacgatcattggttaaacgccttgattccagcatgaaagataataggcttggagagagtgtctctttggcttcctgacgggtaatttttcttgtaccgggaaaattaaaatgattcgctaccagatcaaaatattctcccattttcaaacaggaatcatcactcgcatgatagattctgcccgatttaccaaaacgcagagcagccacaataatgcgtgccagatcatcagcatgaatatgattcgtataactatcttcagctggcaacaaagtgggggtaccctggcgcaaacgctccagcggaagtcgattgtgcgcataaattcctggtacgcgcaaaatagatactcgcaccccattacgcatcccccaatttctgatttgccgttctgcatctagccgccgataggcacgatcatttctcggatttaccgggtaactttcattaacccggttaccactgcagtccccgtaaaccccgctggtactgatatagatcagctgttgtggtagtattcttttttttgtgtttgattgccgccgggaaagtgcagacaacaagtgtaatgtacgcgtatcacgcttgccctgacctggaggcggggcaagatgcaagactgaatgagcagcaactcccgccattctttcaagacttgcaggctgatccagatcacccgctattggcgtgatacccaatgtgcgtaaatgatcgaaattttcaactctgcgacataaaccaaacagttgatagcactgtccgagcaggttggccactcttgaagcgatatcaccgcatcccacaattagcaacttatttttcataaccaatatttttgttagctatatctccccaatggagtcttaccgtatcactttcaggccaagtggccgtatcatcacgaccgaaccaaccgagacgatccttgaagcagctttgcgccatgggctgtctttaccttacggctgccgtaacggatcatgcggcacatgcaagggaaaaattatacaagggattgttgattatggcgcttatagcgaagaagtgctgacggaacaggaaaaagaacagcatctggcacttttttgttgcgccaggcccctttctgatctggaaattgaatgtcaggaaatcgaagcagtcaaggatatcagggttcgtaccatgccctgccgggtacataaactggaacatgtggcatccgacgtcatgattatttatctgaaattgcctgcaaatgaacggttacaatttttgccggggcagtacatcgacatcctgatgaaggatggtcagcgtcgcagcttctctctggctaatgcccctgggaatgatgaatttctacagttacacacacgcaattatgccggtggagtattttctgaatatgtcttttctcacatgaaggaaaaagatattcttcggtttgaagggcctttgggatcattctttcttcatgacacccctaaaaatgatactcccattatctttctggcaggaggcaccggctttgctcctgttaaaagcatgctggaatatctcttttatacggagaatacccgcttcaagcataacaaaataaaactatactggggagcccgcactcgggatggtctttacctgaatgatctggctaaaaaatgggaagaagaaaacaagaacttcagttatatcccggtattatctgaaccacttttaactgataactggcaaggaaaaaacggcctggtacatcaggccgttatggaagacatggacacattgtcggattgccaggtttatgcctgtggcgctcctgccatggtaaaggctgccttcgacaactttaccagtcagcggaatttacaagaggagaattttttctctgatgccttcatcccctcaaaaccggcagtaacttgacacaaatcaagccgagctgatctgcttgagtgcaaagtctagtcccttgcgataatgttcgcttgctgcctcttgcttacccaatttctcaaataactgagccaatgcaagatgtgccggatatcctggatcaattgataaacttgcttcaaggtagttttgcgctttaccccataactccccgtaagtacaaagccgtcccagcgccagcaataaatcagcattgttcggatacttcacgagccagctttctgcccgttgtatttgccagctgactataccgctttgacaatctgcatataatgcaaccagctctggatagagcccggcatccaaaccattttcaataattttttgtgcagcagcattatctccttgagccattaacgcgcgagctgctgctactgcaatcctgccatcagttttttcctgccatggcaaggttccccagtatttcttcagtaaaacaatatcttttgtgttctttttaatattttccaagtgtgcctggtgccgtaattcatccacatgtgctctatcaacagatgagcgatttgacaacacttcagttaattccagcacagcatcccagtttccagccatctgttgggcttttagctccagtaaaagtaccgcagtactttgcagaccaccgaatgaataaattgattgtaaagctgtcaacgcatcatgataacgcccttcatccagaaacaattctgcttcggtaatcaacgtcagtactctgcccacaggagcctgttccctggcagcagtcagtaaatgatcacgtcgtaaataattcctctgctgatgagccgatcgggctgcaacaacggcattcaaaaccttagtcgtttgtgtatcagcaagcttgaaggccttttctgaaaattccattgcctgatcgtaacgcgcttcaaaaaatgccctcacaccagaccatgtcagctgctcggcttttttagcccgtatccgcctgtttataccggacaatccggataggatccgcaggagcatataaaacacggtaaaaactgacagcaccattatgatgaacgtgttgaacgcaagctcaatcttataaggaggtacggtaaataaaaccgaacccgtgttgtagtacgcagccaatacgatagctgtcgctgatgcgaataatgccagtacccataacaccagtttcattcaccctctcctttcagcatgagttgatcgtgatacacaatttccaagatttctcccaaattcggtaactgtgatccgatgttaatactggccaatctttccagctcccccagagcatctctaactgactgagcctctgtattaaaatactgctgcacccaatctattgccgttttcacagcagtgcgaaaattgccttcatctcggattaataaggcaaggcgtgcctgcatcaattgcagtctgatattttcttttagaagatgaatctgggaaggcgataataatgatgttcccgagtcatttattttttcaattttgatcaaccggctgagatctttttcgatttcaagcagataacgatgccataaccgtggctcggatgtatcttgtttctccggcaaatcaatctctatcagactggcgtccatcatcaaaggaagatcatcaatccgtgtagcaagctccgtaatatcccggttaatcctctggacatccacagtagccagcacttcaagctgcgcaatatcccctgccaatgcctcatttaattttgatgacccagggatttcatcggattgcagcagttcttgcgcatattttagtgagtcaagtgcagaacgcacatcacccgtcatccgcagataacgatcagccgaaacaataagacgttcgatcgcacccagcatccaggcacccgtatgagtactgtcaccgtcagacagcttgccaacttcaacaggcgattcacgggtaaccagcaatctttcttccagatgatttaagcgctgctcgatttctgttttttcaagctcaagctcggtaagcattgtgcgtgaacggctgctaaaaacatcggcatcagccagatatgttgccagggaatgctccattgcggagatgtacccttgtttttcagcccatttccacagcatggcagtcactgcaattaacaagatcatcagtatgaaaacagccaagcggcgagctgatccggaagtcgaaatctgcatgtatttattcatatgatcggatgctatcagtgtgactgtattttttcgaagtactccaacaaaccttgcacagtcccttcatctccgagaggagtgcggtatatcttcctgatacccagctctcttgccttgcactcaatccggtcatgtgccgtaaacacggcggtagctctgagcaattgttggcctgttttaccgatcatgtcaaataaattatccagaccttcgctgctgctgatgactactgcctggatcccgttatcatgccagtacttcagcaacggcaagggatcaacctccggccggtggcgacgatagcattcaacatagtcaacactggcgccacgatcacgtagcgtatccccaagcaatttccgcccgccattaccgcgaaaaattatgatgcgcttaccctgcatgatctgcagttgtggcacgcgcaacaaggcttcgctatcagaaccatcttctggaacaatgacagcgggaataccatggtgttcgagcgcccgggcactcccctttcccacggttgcaacacgtacatgctcaggccagcggcgctctgcatgaaccagcggcataactctttccaccgcattcgggctgacaaaaacagccagatcaaaatcatcaagccgcgcaatcatatccagtaacggctgcttgttttcgctatcagaaatctccagcacggggaacaaccatggctctccgcccaaccccttgattcgtgcagccagattacccgcctgatgcaaagggcgggtaatcagaatacttttaccggctaaccgatcaagtgccaatatctgccccgatcacatctcaggccagggcggcaagaatctcttccgcaccgtgcgttttcaggttttgcgccagctgctcgcccacccgttctcctgattccggcttgccacataatttatctgcgattatttttgatccgtcaggggtggccacaaaaccacgcagcgtcaataccccttcaaaaatttcagcaaagccacccagcggtacttggcagctgccccccaacacacggctcatagcacgctctgcctccacacaataagcagttgtggcatggtgtagcggcttcatccattccaccatatcaggatcattatcgcgacactcgatacccaacgcaccctgtccaaccgccggaagactcagctcgggtggtatcagcatgctgatgcgatatcccagctccagccgtttcagtccagctgcagccagaatgattgcactgtattccccctcgtcgagctttcgcagtcgcgtttgcacgttaccacgcaacggacgcacttgcagatgcgggaagcgcgcccgtaactgggattctcgccgcaaactggaagtccctaccacgcttccggtgggcaattcttccaggctggtaaaatcattggaaacaaatgcatcacgcggatcttcccgttctgtgatggcggccagcctgaatccagacggaacaatcatcggcacatctttcatagaatgtactgcgatgtccgcacggccgtcttccagagccagttcaagctctttgataaaaagccccttgccaccaatttttgacaaggaaacatccagaatctgatctcccttagtcgtcatgccaagtatggtgatatcagtttgcgggtataattcaagcagacgacttcgaatgaaatttgcctgccataaagcaagctggctctcgcgtgacgcaataacaattttttcaggactagacataataagaatctgattttgaagcaatgccgccattctagcacgggcgaccccggtccggatgatggcaaataactgcattttatcccggtgacccgagcccatgattacaggagacacacaacaatgagtttgaataccctagcaaatattgttcccgaaaaagacacatccctcgaaaaagaccatccactacgggaagacattcgcttgctggggcgcatgctgggcgacacgatacgagagctggaaggagaaccaatgtttgatctggtagaaaccattcgtcagactgctgtgcgctttcgccgcgaacaggatgaagaggcaggaaaagagctggacaccatactcaatcatctcagccacaaggaaactacagctgttgtccgggcattcagctatttttcgctactttcgaacatcgccgaagatctacatcataaccgccgtcgccgcgctcatttgcgtgcaggctcaccgccccaggatggtagcgttacgttagctctagaacgtgtggtggcaaaaggaattaatacgcaacaactggagaatttctttgccgaggcactcatctccccagtattaacagctcaccctactgaagtacagcggcgcagcattctggattatcaactaaagatacaacgtctgctcaaggaacgggatcgcacccaactcactcccaatgaactgcgccacaatgaagaagatttacgttccgctatccaaacactgtggcaaacccgggtgctgcgctcagtcaggctgacagtacaagacgaaattgaaaacggcctgatctattaccactacacctttctcaagcagattccttatatctacgccaagattgaagatattctggagcgtcacatggacaaggcggcgccatgtattgcctcatttttacggattggcagctggattgggggagatcgagatggaaatccctttgtcacccaccaaattatgttacatgccgccgaacggcattccgcattgatacttgattattatattgaggaagtagaaaaaatcggccaggccatgagtctgactgaacgcctgatcaaagtaaccagcgagctggaggggctggcttcgactgcgcccggcttgccagccagcaggattgatgaaccgtaccggcgcgtctttctcggcatgcacacgcgtttgattgcaaccagcaggtacttaagccctcacgttggccgacaatatcaggaaaatacggcagaaccgtatgctgacagcgccgagttcgtacatgatcttgatatcgttattcgttccctgaaacaacaccaatcaaacaagctggctcaaggtgccatacgagacctgcgccgtgcggtagatgtatttggatttcacctcgcatcactggatatgcgtcagcacagcaaaatccacgaacaggttgtgtctgaattatatgaaaaaaacgctcaggacaaccagaactatcctgatttgactcgagcggaacgtgttgaatggcttctagccgaactcaagcgttcacatccactggtctcatccttgtctgattattctgatatcacacagggtgagttgcgaatcttgagaatggccgccgaaatccagcgtcgctttggccatgtcgcgctgcctaactatattatttccatggcaaccggggtcatccacatactagaagcagcattgttgctgaaagaagccgggctactacaatttggcgaagccgcacgatcgactgtaaacatcatcccgttgtttgaaacaatcgatgatctgcgcggttgcgccaatgtcatggaagaactgtttttactgcccgagtatcgtaaaatgttgcgatccaggagtaacttgcaagaagttatgctgggttattcagacagcaacaaggatggcggatttgttacctccaactgggaaatacacaaagccgaaatcgaactcaccaaggtatttaaccgtcacggagtacggctgcgcctatttcatgggcgcggtggcacggtgggacgcggcggcggtcccagctatcaaggaatacttgcacagcctcctggcagcgtcaacggtcagatcagattgaccgagcagggagaagtcattgccagcaaatatacagatcctgaaatcgggcggcgtaatcttgaaacgctagtggctgccaccattgaatccaccttgcttgatcgtgatgctatccactgccacacaccacagtgctatcagattatggaagaactgtctgccagcgcatatgcagcctatcgcgacctggtctataaaacacctaatttcacacaatttttccaggaatccacacccatccgtgaaattgccggcttgcatatcggcagtcgcccgacttcacgtaaaccttccaataaaatagaggatctgcgtaccatcccctgggttttcagctggagcctgaaccgcactatgattcctggctggtatggattcggtaccgctgtcgagaattttgtgcaacaggccggaaatacgcaggacgtattgatacagatgcaaaaaatgtacagaacctggccattctttcaaaccttgctttccaatatggatatggtgttggccaagagtgatctgggcattgcctcacgctacgcagaactggttactgattctgaattacgccagtatgttttcactgccatccggacagaatgggaactttgtgtgaaatggctgtttgccatcaccgggcataccgaacttctacaggacaatcccacgctggcgcgcagcatccggatccgcacgccctatatcgatccgatgaatcatcttcaggtcgaactccttcgccgctatcgctcaggggatgatgatgatgcgatccggcgtgcaattcatctgaccatcaacggcgtggccaccgggttaagaaacagcggttagtattttcgaaataccttattcaatcagctattgtgaattaaagtactgtgccttacagtaataacaactacgatctagggaaagatgctggtaagtagtcgttttcagatcgtatactcagcacctcatgtatatttaacgaaaaaaattgaagactacgattaaaggtttatctctgatttcggtttatctccgaatctaacttttgatgctgaaaaaattatgaaaacagagagccctcaactggaaaacaccatgtctatcgcagaaagggctcgctctttcataaatcgccttgctcgactcaagcccaccaggctgctaatctttaccgtagtttttctatcttgcctgttactttctctcggtgccgtttttttacaaccagcgatttaccagagttacgccaccttgctgacagtcgccaaaacagcgattgatcaagcaagcagggaagcagatattcagcatgtcaccattcaaaagcaggttctccttggcccagagctgttaactgaaacagcaagccgtctgcgcgaaggaagtgacactgaagcaggcattgatctgacacccgcaaccattcgcgacatgctggatgttcggccaataaccgatactaatctagtcgaaatggttgccgaaggaagcgatcctgcgctgctcccacgcctgatcaatacctggattgatgtctatctggatgcacgggcagaagaagttgcccgatccaaaggctcaacaatacaaatgatgcaggaagaactggctgcgctaactgcaaaaattgaacaaaaaagacttgagcttgagcagtttagaaaacataataaaattattacaaccgaacggcaggataatgaagcactagcgcgtctcaagggcctgaccgactcgttgaacaaagccagtgaagaagaagtcaaggcaaaagcacgactcgacgctatcagaaagtcgattgaactaggacaggttgtcgtacccactgaagatacccgcacgctaagtgcactcgaaaaacgcgcccaggaattacgggaacaactggaagagcttgaccggcaatatacccgcgagtatatggccttaaccccttccctcaaggttatcccggacaaattgcgggcattagatgatgaaattcagcatatccgccataaagggcaatctgtagtcatcagtgaagccgaacagaactatgctgctgctctacaagctactcgttcaatacaagagcaactggaccagcacagacaaaaagcagccgagtttactgctcgcttcaccgaacatgatgcattgaaatctgatctggaagagctagagcagctctatcgggacacacaatcaagactggctcagattgaagcgcaacacaccgggagatatccctatgttgatattatcgaacgagcttttttaccccatcacccaatcaggccggattatttatggaatgccatgattgcgacactgctatccttgctaatgggcttggctgctatctggatttttgaatttctgatgcacaaagaacaggaaaaactagccattcacctgtccgatattcatcttcacaatcagagtaatttacctcgcagcgctcttggcataccgccatcaacgcccaccaatctgcttcgagaacctatacaggcactagagcacatcaaaatagatgaatacacgccccggcaaattgacgaactatttcacgcggcaaacgccaaggaaaaacagctgcttatctttctgctaagcggtctgacatctgatgagatcgcaaacctgcaaaatgatgacgttgatcttgaaaacaacttgctcacaattagaaatgtatccaccagaacaatccctctacaccctgccctggctacactctacagtaaacatggctattgcctgactgatcccaccgggaatcggttgggtcgggaagatctggaagcgttgctgacctgtctgcaaattgatgccgatctgctgataaccagccggatttctgctgaaacactgcggcagacctatattctctatctgatcagacagggaatgcggctggccgacctcgaacctgttgtcggttatatctcgccgacagaactgtcagaatacggcgcttatgctccaccgggagccaagcagccgatcgaagcaataaacttattttatcctgttgaacaaaaacaggatttataactttgagtttaatagcgcatcaaccagatttttttcaatcaaacgatactgatcatcatgattgtgaaggcttaataatccgctccaggcagggttttgtctgagtatattaataattccatgccatccatcaggtggatcaccacgctccggttgttgatccacctgatcaatatggcgagcagcatggccccggttcatcagcttgtccagcagctgatgctgacgcagatacagtaactgtaacgtgttgtcatctacacacaaccatcgagtcccctgaaactttgcctgaatctccttaccatagcgtctgaatgtagaccagccagtgcctgcaattgcgcccaatatactggcagtaccaagactcaatcccccggtcatcaaatcgattccagctccggcagccgcaccttttagcgcggcactgccaatatccagcccataagcctttagtatgccgggggcaaacagatcaagctgccaatatccgttttgtaccggtatcttttgcagagcgacatccttgtctgtgaaattaaacatcttcagcaagtcggtcaggcaattttgctctgcctgacgcacaaaatcctgcaaccttatcgccgccgaggatgtatccactgaattccgatcatcatcggttggctcccgataacaggctgcggtaatgatcaatccggcaatccgtctggcggcggatatacaaagttggttccatattcgtgcacggtggtcaatcaggcgttgcagacgggtgtagtgtatttccaacaggctttgtattttctgatacaaacgcttttccgcctcaaaagcaaatgcaacagtatccagctcaagtgaggcatagatgttgaatgccgccagtttctttctccacagatcaagctcggcccgatgcgcggcagtaaagttgaatatcggaatgatgggttttattgctttgccaagtatctcgatttcgatgagatatttttcaagtactggctcacgcacatcaattacatacagcaggacatcgctgcgcaatatctgccgaataaccttggcttcctgctccagtggatcattgagggaggtgactaatacaaacttctccagctgctcattcggggttaaacgtttattcctggaagcgattatttgcagctcgtcctgcagtgcgtacacatcctcaattccgggtgtgtcatgcagattcagcactgcttcgctgcctgcaaaaatagtcgcccgttcaacatgccgagtcgagccggcagcatcttcaaccttaccaaagctggtgctgcgcaacaaggtacgaatcagtgaggtttttcctgtgttggtatggccaacaacagcaatctccagaagtggtgcgtcttgttctgcagcccccccgcttgctttcatatcaaaatggatcgtcatcaggaaagaacatgttcggccggaattgcactggcttgcgccaaccggaaccaggcttgtttacgcgactccgtaattggaatagcagcattattttgcagtaaaaccagccagatctggccagatgccaatgcagtcagtttttttatgatccgttgcaccccgcgatcaggcagccgatgtgcagccacaccaatgagcaaggaatatctggactttttgatcatctccactgcccgcataagcgtttcctgatctgccacattttcctggcaaaccattcctttcggccagatgatgtgattatccagctcaatgccgatcaccaatgcttcctccggcaaatgccgattgtgccccttgcgggcaacttgcaccggctgctcttgtgcgactcccggatcgcgatcgatcacactcgccataaattcatttgcaatcaggctctgccgcaacgtgacgtagtagggcaggtataaatccagcttgtaacgatactccgataatttcagcattaaaaatgcgaacaaagccagtattatccgaggcaacactccataaacaatcagcgctcccaccagaaatttcgcccaggcgtttctgatcgaagcatcttgcatgcctgccccaatccggctggctgcgatctgctgactgtcaggagaggccaggccgatcaattccatgggggcagccagaagccgggtaagttcaggcagactgttttctggtaacaacgttgtcccccaaacaaaatcgtactgttttgccagcatcaacaggattagtgttcccatccctgcaagcagataaatcatccaaaactggtgagtcagcaggctgattcgccacttacccaccttgccgaacagacaggtttcccaccaggcgtgcgcagcaagcgtgccaatggaatccttctcctttttcttgagctggaggaagggcaaccagcgcgccaattgtgcagcaatacccgaacttaacccttgaatacccagcgtaatccccgcactccacagcagcatcgagaaaaaattgaatccgagtaacacaaccagcagccaataaatattcagtgtcgaagaatcaccggttgcattaatcgctgccagtccgccaagaattgttgccagaaccagaatgactctgcccgcgcgcacaaacagcttctctggctgttggagaatatcgtccaggtgattatcgtgaatcagatgatgggcacgattcagaagtctttccagaaaagctgcgtaactgaaaccagcaacaggatacgattccatattggcaacacccgcataggaaagcgtcttcgcctgaccggtttcaatatgccgcagctgctccaatcgaaccagatcattaaaatcatggtttttaaaagccattactattgatatatcaaagcagaagaaataaaaatcagattaccccagaatacccggacggcgacctgaaaaccctgtcatcaggcagtacaaactaccaatatatggcaacaggaagcggctatcacatggcagatcgtaatacaagcttccacccgcaaaaacccggaaaaccgtacaattcacacgctactgaacaaaacagaatacccgaaagggaacagtgaaatccgttcatttattccaggaaggatattattaatgaaacccgtcgcaattctcaggtttttcccacttgaagggcccggctattttgccacatttcttgatcagcatcatattccctggcagctcatctgcctggataaaggcatgcttcctccgaacaatccaaggggatacagtggtttggtattaatgggcgggccaatgagcgtgcatgatgatcttccctggatcaacctcgtattatcactcatcaggcagacagtagccattgatatcccggtgctgggccattgcctgggtgggcaactgttatcaaccgccctcgggggtatcgtaacaagtaacccagttaaggaaattggctggggacaagtgcatattgaagaaagcacacctatcgcacaggattggtttggcagcgatctctcagaatttgacgcctttcactggcacggtgaaaccttcagcataccggcaaatgctgtacgactgctatccagcccttattgtcctaatcaggcttttgcactgggcatccatctgggtatgcagtgtcacattgaaatgacagcggcgatggtcaaagcatggtgcgaagcgaatattgatgagctgttgcgtaaccatggaaatcccgccgtcagtagtagtgaggaaattcagacgaacctggaggagcgcattactgcattgcaatcagttgcagatcgtctgtacaaaaaatggataactgcattaaaaaattgatggccgcaagcaatacggccatccatcaggagattacataaagcagttgttaaatagctatttcagctcgcattttcttcatggccttggcttcaatctggcgcacccgttcggcagaaacacccaattctttagccagttcatgcaaggttgcggccttatcttcccgcagccagcgggcctcaataatacgacgactgcgctcatccaggctatctagagaatctttcagtttcgcatgcgtcaaccgctccagctgttctttttccagctctctggacgggtctgatccgtctgtcagataggcaatcgggctaaaatcctcttcatcactatccgttagcggctcaagtgaaatatcccgaccactaaagcgtgtttccatctcgacaacctcttccgccttaacgcccagttgctctgccatggtcgcaacctctgcctgattcatcgtatccagcccttttttcatgctacgcagattgaaaaaaagctttcgctgcggtttggtggtggcaatcttgaccaacctccagttgcgcatgatgaattcatggatttccgccttgatccagtgaattgcaaaggatatcaggcgaacaccacgttccggatcaaaacgtctgacagccttcatcaagccgatattaccttcttgtatcaaatcagcatgtggcaacccatagcccagataaccacgtgcaatcgtcacaactgtacgcaagtgagaaagtaccagttgatgcgctgcattgatatctccattttcctgcatttttttagccagcgatatttcctcttcccgtgataaaacaggaaaactgttggccgcacgaatatagctctccagattccctccacttattaccggtaaagttaaaatctcactcatatatattttcctcctgatttccgaatgaatattgcggaatataaaatcaacaagcatattttagcactctcacccttcgagtgctaattcaatattaaggtaaaacaacaaaaggtcctgtcgtcaaaaaaagaacaaatatatttttatttgaggctgttctctctgcgaaatatcccgaaatatttgatcacaaaccacagcaactatccaaaagataaaagatgacacctggcgatccgattggcaagcagcagaggaaaagctgaataagttatagtggtcaagatggttgaaatccagttccgtaggagtatgctattttttcaattttcatcacaacatcatacatcttgatcagtccgcacttttagatgcccggtggaaattgtaatagttgccaaaggagatccaatgaaaatgtatcatttattacttctactatggctgggtgcaggtagcgctatcgctcagccacccgctgtagaaaaggcagcttttaatcctcctgatgaatccaccattcctgccagtccgcagggagatgccattcgtctgggtcagaagctcctgtttcagacatctctgcttctaaaaaataattcagggagtgcattgaactgtacaagctgccatctcaatggcggccgccaacccaatgccgcaccctgggttggaatttggggagcattccctgagtaccgtgccagaaatgccaggatcaattctttgcaagatcggattaacgactgtttcgagcgttctttgaacggaaaagcattaccctacgatagtaatgaaatgctcgccattctcgcctatatgcactggctatcaaaagatgtcccaactggcgtggatgtagagggtcgcggttttatcagaattgccgcgccgcaacctccagatatggaaagaggaaaaaaagtttatgccgataaatgtgctatttgtcatcagccggacgggcaagggcaatatgggccaaacggcgaagtaatttttcctgcgctatggggagacaaatcctttaatatcgctgccggcatggccagactaaatacagcggctgcgtttaccaaagccaatatgcctcttgggcaaagcaatacattaaccgatcaagaggcctttgatgtagcactatactttactcgacaacctcgtccggattttgcaaaaaaactccaggactggcctaagggtaagaaaccgaaagatgcacgctattaacttatcagccaatttccggttcacatccgaaccacgaacccaatcgagtagctgttgaacagctccccggaccacctgtcgacaacttgtattctcccttctgggaagagattttctgcttcagataaaaacaaatgaaatatttcagctggatatggcttatccaagccattttttcttctaccaggcacataattcacgcagatagtagtttgttacccgccaaagatcgccacatcgaacaaacggacatcaacaccattcaaatcgtgaatcgtctaccttttatcgccgttcacgtagttattatgtgagtcactctacaacgtgatcatcccgcatatgtccgcaacctttctcaagccggaattgatgctttcaagaatctttactggctggatgccgggctagagaaccgcacatgttattaatttcacaacaacgatatccgacgctcacaaatcaccaatgattatcccattttactcagatcaagggtttagcgagttcgtaaagaaacaacaattggtgacactaggaaaagttactaactcccctaatctgttttatatcgaagtatcaatccacgccttctaataacatctgatcacccttgaataaactgacgggtgaattaccaacaatttattcgaaaaaaaatctgcagcctacaaagcagcacgagcagcaacaaaaagcccttgattactcgggttgatctccactcaaccacgtttctcagttacttatcaaacgctcgtcacagctgagtcattttctttatattcaaaataacaataaagaaatcattatttattatttttaataataagcgatcgttggtatcttctccccactcatgcggaaacaccgagaatcatcaactgacaaccacaacaagaataattgtcgttattgaaaatattgcaaccatccggccagaagaactggataacttcttcccgacacggggtatgaatgaaacgctcaacatggatatggctttacctgattatatttttgtcacagataaatatggcttacgcaaaagaagatttcacaacaactggaagcagtcaaacgatacagacaacgtcatggccaaatttataccagcgcgctcgcagctacaacagtacgcacccggagtccgatccacctcgttatgttcgtaatctgtctcaaaccgggattgatgccctcaaaaatctttactggctggatgtcgggctggattaccgcatacgttatgaacatcgccacaatgatatccggcgctcacgcattaccacagataaccctgttctactcagaacacgagcctatctaggtatcagggaaattctggatcccctgcgcttcgtcgtcgaatttgaagatgctcgtcgctataacagtaaattccctaaagataatcgcgactggaatgaattcgaactgatccaaacctatggtgaactctattttaaggatgcgctggggcgggatgacctgggcaatcatcgccctgtcagaattcgaggcggtcgcatggcatgggaagcactggatcggcgcttactagccagcaatcaatggcgtaacactaccaataattttgaaggtttccgcatgacattaggccaggaatcgaatgactgggagtttgacgcatggggcgtgcagccggtcataagactgatagacaaatttgaccggcgcgacaaaggtcagtggttttatggcgtaatcggacattttcgccagtggtcaaaaatagtcaccatccaaccctattacatggggctgatacaggatgacgatggtggaacacgagtcaaacgtgaaatccactctcccgccatccgagcccacggcattgtaccggacactgaagtggatttcgatctcggtgctatttatcagtttgggcgcgacggcggacagaaaaaatcagcgcacgcctatttacttgaatttggctatacctttcagcaggctgcctggaagcctcgcatgagtaccttttacggttatataagcggtgatcgtgatcccaatgaccatacaaataaccgttttgaaagatttttcggtttcggacgtccctggtcagctgatgactatgtcattatggaaaatatccaggcaccaaaaatcaaagtagagttccagccacacccggatttacaaatcgatggtggctataacggcttctggctcgccagtaaagccgatcgtttcaacaaccttctcagtagcagtggaaataaccgtgatcgcagcggtaacagcggaagctttctcggacattcagccgatattcgcgcccgttacaggctgacgccccatatcaataccacactgggctattcgcattggttcaacggcggattcgtaaaaaatcggcaactggcggaactaggagaaacaactgccggcacggattttttctatgtagaagtcgctgtcagtgcattcaaataacgttaatttatctataaaaggaaaccaaatgcaattcaacacatggttgtcagtcggtttactgatgttcattgtggcaaattccaatcaggcacttgctgatcgggccattctcaacgtttcctatgatccgacacgcgagctgtatgaggaatataatcgtaaattcacccgctactggcaggaaaaaaccggagagaaaattactgtcagacagtctcatggcggctccggcaagcaggcacgtgcggtcatcgatggtgtgcctgcagatgtagtgacacttgcccttgctcacgacatcgatgcaatcagcgaacaatccggactgatcctggccgagtggcagaaacgcttatccaacaacagctcaccctatctctcaacaatcgtcctgctggtacgcaaagataatcccaaaggaatcaaggactgggatgatttgatcaaaccggatgtcgccgtcgtaacccccaacccgaaaacatcgggtggcgcacgctggaattatctggcagcgtggggttttgcactaaaaaaacatgatggtgatgaagcaaaagcacaagaattcctcaccagactttataagaatgtctcgatactcgattcaggggcgcgtggatcaaccatcaacttcatccagcgcggtataggggacgttctgatttcctgggaaaatgaagcttttctggcactcaaggaatatggcccggagaaattcgaaataatcatgccctcgatcagtattcttgccgaaccccctgtcaccgtcgttgacaaaaatgctgacagacatggcgtacgtaatatcgcgcaggcctatctcgagtatctatacagcaaagagggacaggaaattgctgcacgcaacttctatcggccgagcgatccggaaatagccaggaaatacgctcaccagttcccggcaatcgatctgtttacgataaatgaagtatttggtggctggccgaaagcgcagagcatccacttcaaggatggcggcctgttcgacaaaatatatgtaaatcaatgattgattctgtatccagcatattgactgctcataaattcaaattcaagaagacccggaaatgtcagatttttctgagtgtacacccacgcctattgagtagtaacgagctaccgcactatcagatggatggctattcagaagacagcagcactcgtgataccagatccctcctgccttgtcagaaaaatcgaaatacaagagcaactaacagcagcaaagcaggcggatatgtattatccgcagggcggtttttaggacaggcagcataactcgcaatatgatctcggcagccatctagaaaagattttcacaatcgaataacaggagcttgaattttgagcactttcaaacaatacagtgtgttacccgggttcaatctggcacttggattcaccctgctctacctgagtctggtcgtgctaattcccctgtcggcagcattcatccacagcgcgaaactgacctggccggaattctggagtaccgtgaccgcaccccgagttatcgcatcctatcgactgacatttggagcctcatttgcagccgcagtggtcaatgcatttttcggattgctggtagcctgggtgctggtacgttacccgtttccaggcaagcgtctggtcgatgccctgatcgatctgcctttcgcactgcccacctccgttgccggcatcacactcaccgcaatttacgcggggaacggctggatcggacagtacctggaaccactgggaatcaaggttgcattcacacccatcggcgtatttgttgccctgacattcatcggattgccgttcgttgtgcgtaccgttcagcccgtactggaagatatcgaaaaagaactggaagaagctgcagccatgttaggtgcaactcgctggcaaattttccggcgcattattttccccacaattctgcccgcactgaccactggctttgcactggcgtttgcccgcgctatcggggaatatggatcagtaatttttatcgccggcaatatcccgatgatttcggaaatcacgccgttactgattatcaccaaactggaacaatatgattacaccggtgcaactgctattgctgtcgtgatgttggtgatttcattcattcttttgctgatcatcaacctgttgcaatggtgggttcaccatcgcggcataaaagtataaaggaatcatgactaccatcccattacttcaagcctcttcggcaccgcacaagatactggttacacaggaatcaccatgggcacgctggatactcaccctgctggcgctctccttcctatccctttttcttttactaccgctggtagcagtcttttttgaagcgctgaaaaaaggatgggatgtttacatcgctgctatcaccgaaccagatgctctcgctgccatccagctcacactgaccgctgcagccattgccataccacttaatctggctttcggcattgcggctgcctgggcaattgccaaattcgagtttcgcggcaaaagtattttgatctccctgattgatctgcccttctccgtctctcccgtcgttgccggattaatttacgtactaatattcggtctgcagggctggatgggaccgtggttgagagagcacgatatttctatcatttttgcagtgcccggcattgttctggccaccatctttgtgactgtgccatttatcgcacgcgagctgattccactgatgcaagcccaaggaacagaggaggaagaagcggccatcattctcggggcgaatggctggcagacactctggtatatcactcttcccaacatcaagtggggattgctgtatggcaccatcctttgcaatgcaagggcaatgggcgagttcggggcggtatcggttgtttctgggcatattcgcggcctgaccaatacactttccctgcacgtcgaaattctttacaacgaatacaactctgctgctgcttttgcagtagcctccctgctggcgttactggcactgattacgctggcactaaaaacatttgttgaatccagagttgcgcagaaaacatccagataaggaaattacacatgagtatcgagatacgcaatctttccaggcagtttggctcttttgttgccctgcataatattaatttacaagttaatccaggcgaactgctcgccctgcttggcccttccggttctggtaaaaccacgttgctgcgcattattgctggcctggaaactgctgattccgggcaggtgttattcaaccaggaagattcaactaccaaacatgtccgtgaccgccatgttggttttgtttttcagcactatgcgctgtttcgtaatatgaccattttcgagaatgtggcatttggcctgcgtgtgcgcccccgaaaagagcgtcccaacacccgagaaatcaatcgtcgcgtgaccgagctactgcaactggtacaactcgactggctggcagaccgttatccacaccaactttccggaggtcagcgccagcgcatcgcactggcacgggcactggcggtcgaacccagcgttttattactggacgagcctttcggcgcgctggatgccaaggtgcgtaaagaattgcgtgcctggctgcgcaaactgcacaacgacatgcacattaccagtgtcttcgttacacatgatcaggaagaagcactggaagtggcagaccggatcgtcatcatgaaccgggggcgtatcgaacaaatcggcacccctgatgaagtttatgaaaaaccagccaatccattcgtgtatgaattcctgggccacgtcaatcttttccatggccgtgtacaccatggtcaggcatggatcagcggcttgaaaatcgatgtgcccgaacatgctgcagcagaagatctcaacgccattgcttatgttcgcccccatgatattgaggtgagccgggccataaacggtgaatccgcactggcagtacatgttgttcacattctctcaattggcccggtagtacggttggaactgatgtatggagataatctgacccagcacaccattcacgccgcaatcagcaaggaacattttcgtgaattacagctggtaaaaggagatcaggtttttatcaagccccgtcgtctcgccttgttcccaaaccatgatcaggaacagctgatttattaatagggtaacggtattctttaaatgctctttattgaaaatcagccttgattgccctgattatcgctcgagttataatcgcttgtatcagcaggccaggcagaaaatggaaatggacgccgctcgctattgaaggtcagaaacaaactgatctgatagtcatacattgccagttgacggcccagcttaagcagctgagtattggtttgtccggccaacagggttgagactgtctggaataccgctagcagcataatcagaaattttactcctccctggacgaaaaaaaacaacagcataaaaagtacccgggtccaggtttcagtattttgcaaacgttgttttacttcatcattcatggagaaaataccagtgaaataaggttgataatcagcgagttctccctgttcttttctgcaaaattttgagcatttcctgcagaaaatgaatcgaccaggtaacgccgaacccggtaacatccgtactgatcgcacccaatccatcctgatgacgggaagcagaaagatccatatgtaaccagggaatatcattcacaaaatgtcgcaggaaacaggcggcaagaatatggtctgcctcattttctatggagcactgcttgatgtcggcaattttgctttcgagatcagcttcataatcattgtccaccggaaacacgcatacccgttcgccacttgttctgcccacagccactgcattttgcgccagataatcacggttggtaaaaacaccgctgtagcgagtacccagtgcggtaatcaggctgcctgtcagcgtagcatagtcgataatcagatcaggtttttctctggcagcaagtgtcagcgtatccgccagtaccagccgcccttccgcatccgtatgaacgacttctaccgtcataccattcagagcagtaatcacatcattttgcttgaacgcatcggggctcacgtggttctgggcaatagcaagccagcaatctatgttgattggcagatcggcccgggttgcagccagaagtgccccaagcgctaccgctgaaccattcatatcctcatgcatgccatacatatagcgcgccgatttaagattatgtccgcctgtatcaaagcagataccctttcctaccagggcgattgttctgttagtttcactgttttttgccgttctacgtaaataaacaattgccgcatcatccgtcaagctgccctgcgcgacggctgtaaatgcacctgcccccatctcgcgcaaccgggataattcatattcctggtattgccagttttcactggcagccagcttttttatttgttcacggtaagtcttgggagtcagctcgttgggaggcaggatagtcaatcctctggcaagaaaatttccctctgcctgtgcgcactgtatggcaaatccagtggaatcagccgcgccatgcaaataaattctctccagtggcttgtcatccgccttacgctgtttacgtatcggtagtattgccccgttaatccaggcgatataaactgcgagttcggccagatgtcgtctttgtgtctcatctccataaacagccagatgaatttcaaccgggttctcattcagcagcagttgcattgccttgcgaattccggtttgttgttcaaataccgatttgccggtatccaccatcgtccaggcataaagcgcaccactctgcaggttgacagataacggtgtttccgccaaccggcttggcgatgcgccttgccgctgcagtaaatcattgagcacctgctcagcaggcaatgggtatttcccgggtattttctctgtcttgggaaagatgatcagtaagtgagaagcctgagtcgattcgtcaaaagtatcgtcgttttgagtaagagttgcgagcattatttttttaagtaaactggctttagaaaagccacctgtactattcaattgatatagcgctctattatatctgcttgattcatactttcaggattattcatgcatccataccttgatctaatgcgacatgtgttgcaatacggtcataaaaaaactgatcgcaccggtaccgggacactttccatcttcggttatcagatgcgttttgatctgcaacaggggttcccgttggtaacaaccaagcaatgccatgtcaaatcgatcatccacgaattgctgtggtttctgcgcggcgataccaatattgactatctgaagaaaaatggtatttccatctggaatgaatgggcagataaaagcggggagctgggaccggtttatggccaccagtggcgttcctggactgtttccggcgacaaatccatcgatcagattgcgcaagtaatccagcaaattaaagcaacaccggattcacgccggatgattatttctgcttggaacgtgggagatctcgacaaaatggcactcgctccctgccatgtgctgtttcagttttatgtggtggatggcaagctctcctgccaactttatcagcgcagcgcggatattttcctgggtgttccattcaacattgcttcctattcgttgctgacactaatgatcgcgcagtgctgcaatctcaagcctggtgaatttattcatacatttggagatgcacacctgtatctgaatcaccttgaacaagctcgcctgcaactgactcgtgaaccaaaatcccttcccgtaatggagctaaatccggcaatcaaaaatattcttgatttcaggtacgaggatttcaccttatataattatgatccacatccgcccatcaaggcgcctgttgccgtatgaccatactgcaacctgccaccccccggcttgccattctagctgccatatcagccaaccgagtgatcggattgaataattcattaccttggcacttaccagcagatctgaagtattttaaacagctaaccaccggtcatatcgttgtgatggggcgtcgtacatttgattccattggcaaacctctgcctgaccgcaccaatgttgtgctctctcgtcagcatgttcttgatgtaccaggaattatcacggcacactcgattcaggaagtgctggatcactttgccaatgatgacaggcagatttttgtcattggaggtgctgagctataccgacaaacactaccactgtgtcagcgcctgtacctgaccgagattcaggaggattttgaaggcgatacttttttcccggagtacgatcacgatgactggcaggaaatttctcgcgaaatccaccatgaaacaggaggtagtggcctggaataccactttgtgatgctggatcacaagctgccagattctggtggctgaacaacataacctggcctacctgctgaagaactctactgcgcttgctcctcacccccggaaacgagtgattcagcttctattcgagcacgccactttttcacccagccacccagttcttcagctggcataggctgcgcaataaagttgccttgcgccagatcacagccggtctggcgcagtaattcccagtcttcacgactctccaccccctcggcgactacttccatatttaactgcttcgccaatgccagactggcatcataaattgcacgcagcgttacatccttggaagcgtgatgcacaaacccttgatcaatcttgagttcatcaaacggaatatcccgcaactgtgtcagtgaagaatgtcccgtaccaaaatcatcaatagacaaatgaaaacgtttcaggcgcaagcgggttagaatttccaacggaacccgttcatctcccatcaactgactttcagtaatctccaacactattctattgggaggaatctcagtctcggcagccaacctaactactgtatcttgaaaatcaagggatgtcaggttgtccattgacacattgacggccacttttagatcacaacccagtttctgccatattcccgcctgagcaaaagcctgctcgagtaccgtttgagtgaggtgattaatcaggccatatttttccgcagcaccaataaactgattgggataaatcactccgtccacgggatgatgccagcgcaccagtgtttcaactccaactatttccccggtctctacccggacttttggctggtaatagttgaccagctctccggaattaagcgcatttttaattgcttccacatcataggttttggggacggctcccttctcactctgtccggataacgacgaagccagcttcatcaattgcattcgtagcgcctcaggctgtaccggtttttgcaagtaacctagaatgggaatcttgtgtgcctgtaccagtttttccgtcgttttgagcatgcgctcatcctcaccactgacaagaatcaagctgccagtaaattttcgttcaaccagatagcgcacaaattcaataccatccataccgggcatgttgagatccaacaaaatcagatcaggccgggtagtagcatcatccagcaacttcaatgcatccacaccgttttcgcaacaatcaacagacggaaatcccagattgatcaacatacgcgccaacaacttcagtatgaacggatcatcatccaggatcaggattctggttgtagatatatcagtcatcatcgcctttatcaattacctgtgtacaaatttcagcaacctgacaaaagcatagcacgctgaaacaatccaggatgacgttaaataaaatccctcatcgtaataaacagataattcttcctttacttgctgattaagatcgacttcacacagcagaataccaaaaggagctatgattatttctggtgtatgacaagggagaaggaagcggtgtaacctgttgttgaggatctggcagatcaaccaacaaaacaagggaaacaccgcatgacggatagtaaagtttttaatctgaataaaccagaacaaaatgatccgttacaggaagtgctgcgagaaggcgcacgcaagatgttgtcggcagcgattgaagcggaagtaaccagctttatccatcatcatggcggtttgaaaaccgctgagggtagaacggcagttgtcagaaatggttatctaccggggcgctcgattcaaaccgggcttggtgatattgaagtcaaagtgccgaaagtacgtgatcgcagcggttctggcatcaaatttaacagcagcctgatccctccctacttgaaacgaacacgaagcattgaagaatttctgccttggttgtatctgagaggaatttcaacaggagatttcacagagaccttaaaacacctgctgggaacaggattatcaaaactggactcgccgcgatctgggtggcaaacggtatgcttatgtctgggctgatggtatctacagcactgtgcgaatggatgaccggttatgtcttctggtgattatcggttctgacgaaacggggcgtaaggaactgctggcattgtctgatggttatcgtgagtctgaagcgagctggacggaagtattgatggatttgaaacaacgtggcctcaaaggtgctcccaaattagctgtcggtgacggtgcgctggggttctggaaggctgttacccagtgctggccggatacggatcaacagcgttgctgggtgcataaaatcgccaatgtaatggaaaagctgccgaaagccatgcaacccaaggtcaaggaggcactgcacaatatctggcaggcagaaacacaggaaaaggcttataaagcatttgataactgtattgaacgttttagccctaaatatccaaaagccatggaatgtctggcaaaggataaagattccatgctggctttctatgattatcctgcagaaaactggcaacacattagaacaactaatccagtcgaatcagtctttgcaactgtccggctgagaacagccaaaaccaaaaactgtggaagccggatgactactttgacaatggcgttcaaactggtggaagtggcacagaagaaatggttccgactaaggagctataaattgttagcggatgttgtgcagggcgtcaaattcgttaacggcgttaaacaaaatggagatcgaaaacaggtagccgcttgattctctatacaccagatttgacaatagctcccattagatacaataacatcgaggaagtagcatatgaaactaagatttttaattctatctctatctattgctattggatcgtttaattcattcgcacaagatcaagttggcaagtatcgggttccccagccagcaattgagcaaggagagacttggtcaatcagtgatgttcacaatgttgacatcattttacataatacgcgtaagaaactcattgaagacacaggtaatagtcctcttatgcgaagagatgcacatccaaaacaccatgggtgtgtgaacgccagtttaaagattgatagtcagtcgctagatccaaaatttaggctaggtctttttgccaaagatgcaatttactcatctgttatacgattttctaacggcagtcctgatgccaaaaaagcagatattgatggtgatgctagagggatggcgataaaaattcttggtgtcccttatgataattacttagccgatgtgggagttgaacctgcttcttcgtcccatgatattttagtgatcaattcaccagttttttttattaaaaatactgaaacttatgtaaagtttactgaatcggtagaaaaaggtgggcttggattattatggtttggtatcacccatccacataccgctaaaatactctgggaaattaaaaatacacaagtttttaatccacttgatccgatttaccattctgcaaccccttataaattaggcgatacttctatgcgcatgaagtttgttagttgtaaaaaagcggatgcaaaaccaatagcaccagagaataattatttaagtgatcggctggccgaatatcttgctgtaagggatacttgttttgatttttatattcagccaaaccatgactatcacgaaaatgatattgaaaatccaatgcaaaattgggatgataagaaatcgccatatatcaaggttggacgcttagatattccaaaacaaaatggcatccatacagctacaagctctgagttttgcgaaaacatatcttttaatccttggagagcccctgaggtcaaccgtcctcttggaacaatgaatcgaactagactggaagtttatgttaaacaggcaaaatttagacaaaactataatcaagctaatgatccatcaccaagtgagcgtaggaatattccatagagagcgttaacaattctcagagcctgttcaaagtcttttgagctattgtcaaatctggtgtatagagaatcaagcggctacctgttttcgatctccattttgtttaacgccgttaacgaatttgacgccctgcacaacatccgctaacaatttatagctccttagtcggaaccatttcttctgtgccacttccaccagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggaatctttatcctttgccagacattccatggcttttggatatttagggctaaaacgttcaatacagttatcaaatgctttataagctttttcccgtgtttctgcctgccagatattgtgcagtgcctccttgaccttgggttgcatggctttcggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccatcaatacttccgtccagctcgcttcagactcacgataaccatcagacaatgccagcagttccttacgccccgtttcgtcagaaccgataatcaccagaagtgaaccgccccgggttttgaggaggctccaatatctgagaagatggagccatgaacaaatcaaataaatattcccccgaagtaagagcgcgcgcagtccgtctggtgcaggaacaccgcagtgagtatccctcgttgtggtcgacgattgaatccatcgcgccgaagatcggctgttcagcccacacattgcttgaatgggtgcgcaaacacgaacgaaaccgataccggcttgcgagacggtgtgaccagcgaagagcgcgatcgcatcaaagccctggaacgcgaagtaaaggaattgcgcaaggcgaatgagattctgaagctggccagcgcttttttcgctcaggcggagctcgaccgcaaactcaaatcctgagatcgttcatcgaccagcaccgcgacgcccatggggtcgagccgatctgcaaggttttgcaggtcgccccatcagggtatcggcgatatttcgcgcagcagcgtaatccggctttgcgcagtgctcgcgtcctgcgtgatgatgaactgctgccgcaaatacagcgggtctggcagaccaacatgcaggtctatggtgccgacaaggtctggcgtcagcttaagcgtgaagatgtccaggtggcacgctgtacggtcgaacggctcatgaaacggttagggctgaaaggcgccaggcgtggcaagattgtgcgcaccacagttccggacaaggcgctgccgtgtccactggatcgggttaactgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacagttaaccggcaattcaaggcagatcgtccgaaccagttgtgggtgtcagacttcacctatgtctcgacctggcaaggctggctgtatgtggctttcgtcatcgatgtatttgcccggcgcattgtgggctggcaggtgagcagctccatgcgcacgaactttgtgctggatgccctggaacaagcgctgtatgcccggcaaccggggcggatggatgccttggtacaccatagcgacagaggctcgcaatatgtctctattcgctataccgaacgactcgccgaagccggaatagaaccctcggtcggcagcaagggcgacagctacgacaacgcgctggcagaaaccatcaatggactgtacaaaacagaattgattcacaagcgcgccccctggaaaaccagggaggccgtggagctggcaacgctggaatgggtagcctggttcaacaaccagcggctgctggaaccaatcggttacatccctcccgcagaagctgaggtaaactactataggcaattcgccaaggaagccattccggtggcttgactttaaccaaacagcctccacgaaacccgggacgattcagaagacataaccggtcatccattcgcacagtgctgtagataccatcagcccagacataagcataccgtttgccacccagatcgcggcgagtccagttttgataatcctgttcccagcaggtgttttaaggtctctgtgaaatctcctgttgaaattcctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttacgtgcgccttctcgcagcacttcctgtaacggatcattttgttctggtttattcagattaaaaactttactatccgtcatacggtgtttcctttgttttgttggttgatctgccagatcctcaacaacaggttacaccgcttccttctcccttgtcatacaccagaaataatcatagctcaagtcttttgagtagaacgccaagaaggccaggtgaataaactgtgcaagctggtgttgagtaagcgctcacagttcttccacagccgccgattcttctccaaccaggcaaagctgcgttccgccacccaacgcttggggataacagcgaaggtatgcaactcactgcgcttggcgatctgaaccgcgacagcctcgctcagcacatcgcgtacaccttgagcaaacggctcccccacataaccgctgtccgccaccaccaccacccggcccaggcctgaacgacaacgccgaaaagcctgcaacgcacctttgcaatcggccacttccgctgtcgtcaccgcaatggtgtgcggcaaaccctgggtatcgaccgcgatatgacgcttgatgcccgataccttcttgcctgcgtcatagcccttctggctcgccgtgtccgtgttcttcacgctctgcgcgtccacgatcaagaacgtgctgcaagcgttgcgcccctgtctagtacgatgtcaccggcaatgtaaaaatgccccctaacggcaattaaaaattgaccccctgaattaagctggtcactttttctatgaggtggctgctattgttaacacaggagatggcaatgaccattagggcattaaagaagcagggaaagaggattaaagcaaattgtatatcatgcgggcacctcgaatagcccgagggtttcagtcaatcctgccgcgaaatgatgagtacgaccgaattcggttcgatttccatgacaaatcgccgcttttcctggcgatgtcgcgccgcttttaccccgaatctccctgggcattagcgattcggtccattttgagtgtcaagaggccttgatccctgtctctccaaagtagaccagtcacctcaggttgtagcaggccgccatcgccgagctaaggggcagacacaagcggcgcatacaatgcgaagcatgcgtcggttggggctttccagtggcgaagccacgaccttgagcgacttgttatacaccttttaccaccaacatttctgtagcatttctctgaaagctgtaaggcaccgcaacggtttctgcactataacccgccgatgtaaccgcttcgataactggggctaggtatggcgatggcctgccatctagtgtaatcaaaggatagatcctgacctcttttgtcaccctgcacagctctagaacacctgcaatatgctgctcttcagttatatgttcgctatacaaaaatagaaaatgggagcacagtgctaacgtgaactgattttccttgaacgtaagcaatggaaggcttgcttcaacgtacctgccttcttttttacctgattcatagtcttttaaaaagtctttcatggcggcaagcctggcgcttactacagcctcgacattttggaatgtagaccagatgtaatttgatgcgttttctttaagctgctgtgcgatgttgtggcttatttcgttgacccttgactctatttgatttgcactgaagcaatatattgggtctacggatataaccttggcacctgccgctgttgcttctgcgttaaaacttgctggcccgtcaccacagccaagaatatttccctgaaggtcagcttgcgacagggaaaacatttctttgaagcatcttccccacggtacaaccttactcagctgcatggtatttccttggtgtataacatcgtcatcgcaaagttggctcgcgcctggctttgcgatgccacacgggcgtcatttttcagagaaacacctgctactgctggcatgtctttgagtgtcggataaatcatcctactttttaagctgtcgatacgcagataggcggcggataaccggttcagttcgtgcaaaacgcggttcagcgcatccaactgcataaaagcaggtgcacccaatagcatatcagcaaccccggtaaaataactcaatccattggaagtgactatacaacctggctcgaggtcagcagtagcccagttaaaaaccgctttgtgcgtaaaaccagagctttgataggcttgtttgggtcactatacgccttatcatagaaaaatcgggcttggctgaaccatctttctaatcaggaaaaattatgccacactcattcttctccaaattagtggattctatctttcaccaaagttatttttcatgctaaagtagtaatcaattacttactttaaaggtgtaggcagtgaatgagcgtcctcaatacttgtccgctgaagagcgacgagcagccacagtgcaagcagtggtcgatttggctgccgagcagaacccggccgagatcacaaccacagccattgctgaccgaatgggtttgacgcagggcgcgttgtttcgtcatttccccaccaaggacgccatcttggaagcaacggtatcctgggttggcaaacgcttgctgaccagtgcagacaaggcggcagctgacgctgtatcccctgcagcagcgctcgaagccatgtttatgacacatatcgactttgtcgccaaacaccctggtgtgccacgaatgctgtttggagaattacagcgttctggtgaaacgctcaccaagcacatggcgcagaccttgatccgtcagtacgaacagcggctgcgtcacctggtggaagctggcaaagctcaaggtgagctagacgcagagctgaacgtggatgccgctactacgttgttcataggcactatccagggattggtcatgcaggcattgttggctggcaaggtcaatcagattcgacgcgatgcaccagccgtgtttgccatctatcgccgtggtattggagcgacaaaatgaaagctctctgtgttagtacatccagtctgccaacgtcgaaccagagcaccataaaactccggcttcaacacatgaaaggcgtgccatgagtaaaatcatttcctctcgcgccacaaagctgaccatcgtcatcgtggtgattattactctaggtttcggcggcacattcctgtggatgcagcatgttgatcaagatgagaatctgctctatctgtatggcaatgttgatattcgggaagtacaactggctttccgccaacccgggcgagttgagcaagttttgtttgatgagggagattttgttgccgccggcacacgggtggcgacactggatgctcaaccgtatcaggaagcatttgcggcagcagaagcctccgtgcaggtggcgcaggcagagctgtccaagatgcatagcggcttacgcccacaagaagtcgcccaggcacgagaagcgctcaaacaggcgcaggcagcggcacaccgggccgaacgggactatctgcgcctgagtaaattgttatcctcaaaggcaagcagtcagcaagatgttgacagtgcgcgcgctacgcgggatcaagctgttgctggagtcaaagcagccacagcggccttatctcaggcagaagaagggtttcgaaaggaagacattgccgcagccgaagcccggctggcagctgcgatggccgcgcgggatcaagctgctactgcactggcagataccgaactttttgcacctagtaatggcacggtgattgcacgtatccgagagcctggcagcatggtaaccagccagaacgccatctacaatttgagtctggattatccagtctatgtgcgcgcctatattaacgaaactgtattaggccgtattgctcccggcactcccgttcgggtgcggagcgattcctcggaaaaaacctatcatggccagatcggttttatttcaccccgcgctgaatttacccccaaaacagtggaaactattgaactacgtacagatttggtttatcgcttacggattgtagtgaacgacgctgatccagcactacgccaggggatgccggttacggtagcgatagatacgcatcccgcgactgatctgccagttgatgacttctgatatggatgctgcagcggatccatctatttctactattaccacacctgacaatgcagccgttgttattgatcaactcaataaatcttttggtaatgtacacgctctacacaacctgagtgccagaattttctatggttgcctaactggcttagttggtccggatggtgcgggcaaaacaactttattgcgtatcctaactggtttactcaaaccggatagcggccatgccacgctggccggttttgatactgtgacagacaatgatgccattcatgtggtcagtggttacatgccgcagcgcttcggcctgtatgaagatctgtcggtgatggagaacatgcgcttgtacgcgcagttacgcggcatggacgccgaccataacactgatctctttgccgaattgcttgatttcacgcggctcgcacccttcaccaagcgcctcgccggcaaactttccggtggcatgaagcagaaactcggactagcctgcgcgctcatggcgcggcccaaggtgctactactggacgagcccggagtgggtgtcgacccagtcagccgtcaggatttgtggcgcatggtgcaggtgctcaccgacgagggcatggccgtgatttggtccaccgcctacctcgacgaggccgagcgctgtgaaagcgtgctattgctaaaccaagggaaactcctgttcgatggtcctccacaagatctgactgcacagcttgagggccgcagtttccgactcgaagatgtcggcgcccagcgccgattgatccttaccgaagtgctcgatctcgacagtgtaagcgatggagtgatccagggtgccggtgtgcgtgtggtgttgcgcgtgggcgcgagtacagagcaaatccaggcactggccgatcaggcgcaagtgcacctggcaccggtacccgcgcgctttgaagatgctttcatcgatctgctcggcggcggtcctggcggtacttcaaccctggctgaacgtctgccgccgattgagctcggatcggatattgccgtgttgtgccacaacctaaccaagcgcttcggcgacttcaccgccaccgacaatgtcagcttcgaggtgcgaaagggcgaaatcttcggcttgctcggcccgaatggtgctggtaaatcaaccacatttaaaatgctgtgtggattgcttaaacctaccagtggtgaggcgcatgtagtcggattggatctgcgccgagcacctggtattgccaaggcacaattaggctacatggcacaaaaattttcactttatgggttgctctcagtacagcaaaatctggaattctcagcaggtgtctatggattagacaaggtcacgcggcgcgagcgcattgcagaaatgatcaacatcttcaatctgcgcaactggttatccgccgcgcctggttcattaccactaggacacaaacaacgcctggcattggcctgcgcactgatgcaccgtccacctgtactatttctggatgagccgacttcaggcgttgatccgatcacacgtcgtgaattctggacgcatatcaatggtctagcgcgtaaaggggtcaccattatggtgaccacccattttatggatgaagctgaatattgtgatcgtgtagctgtgctttatcgttcgcgcctgatcgcattagatacacctgacacactgaaaaaaaatgcggccaacactgattgctctgatccaaccatggaagatgcttttattcacctgatagaaacttcagcactagctgatgaagcggaagcgtgagtaatacagctaatcaggaacaaataacagtacgccgttttgatccggtgcgtttccttgcattggtacgtaaggaaagtctgcaagctatgcgtgatccatcaacgttgctgatcgctctagtgctgccactgattctactgtttctatttgcctatgctgtctcattggatgtgcgccatgtgcgcatcggtgtcgtgctggaatccccgggagcaatcgcacgcacgctggcagaagcattttccggcacgctttatctggatgtaacctacgcacatgatcgtcgcgaagtcgccgaaaaattagttagtggagaattacgtggttatgtcgtcatttcacagaattttgagcaatattttgcggaaacaggccaaccactggtgcagattatcactgatggttcacaacccaacacggccaattttgttgccaattacagccaaggagtgatacaaacctgggcagctgatcttactggaataactcctataccggcggttcaactggagccgcgttactggtttaaccccgaactggccagccggcgcgcactggtaccaggcgccattgccatcatcatgactattattggcaccctgttgacagcgctagtagtggctcgtgaatgggagcgcggcacaatggaggttatcttgtccacaccgtcatccgtgctagaaattttaaccggcaagctgttgccctatttcgtactaggcatgctttccacactgatggcagcaacgctagccgtattcctatttgacgtaccattacgaggctcactgcttgctctgttgttgctttcagctgttttcatgatcccggctctgggtcagggattattgatttcatcactaacacgcaaccagttccttgcttcacaactagccttgttttccggctatctacctgcatttatgctatctggttttctgttcgaaatcgatgctatgcccgcccctgtccaggcaattacctggctgattccagcacgttatttcgtctcttcactgaaaacaatattcctggcaggcgatatttggggtgtttttatccctgatctgatcggtatggcgacaattggcctggtgttttttctgattgcgcagcgccacacacgtaaaagtttggagtagcgacgatgtcttaccagcatttccgcgttattctcattcgcctgtacgctcagttcgtcaaggagctgctctgtatcctgcgtgatccacgtaaccgagtcgtagtgtttgtgccaccattgttacaactgctgatattttcttacgccgctaccctggaagtaagcaatgtcgatattgctgtgtataaccaggatacggggcgagaggcacaggaagtcgtgtggcacttggaagctgctcgcttcattacacaggttcatcatgtccacagtaatacggcgttacgtgaacaactagcacaaggcaaagtaattgctgccattgctattccatctgatttctctcgtactgttgcgattgagggaagtggccgtgcacaggtattagtcgatggtcgccgtagtaattccggccagattgttgtcggttatctctccgtcatcgccaaaaacattcactttacagctgattctacttcactaccggaaacatccgtagtggtacgtcactggttcaatcccaatctggtttatctctggttcatggttcccggtttaaccggtacgctcgccttttttagtgcactcatgatcacagcactttctattgcccgggaacgcgaactgggaaccttcgatcaattgctggtatcacccgcttcgacactggaaattattttatctaaatcactaccggcactggtcatcagcaccctactcgcacttttaatgatcagcatggcaatctggttttttcgcattccatttacgggatcatttggattattactcatcggactcatcctgtttatcttgtcggcggtaggaatcggcttggtggtttctgccatcagcatgacgcaacagcaggccattctgggtggattcgttattggcgtaccgaccgtattgatctccggtttcgctacgccagtcgaaaacatgccgctcgtgctgcagtggctagcacaagccattccactgacgcacttcttggtcatcatcgaaggcagttttctcaaggcgatgccgccggacgacattcttgccagcctgtggccactggcagtgatcgccgtggtgacactcacgatggcaaccgtatttgtccgaggacgcctacaatgagacctggactgtgtatgtcatcgccatggcgaacgatcatctgccccagtgccaataaacatgggcgcctgcccatgctggtgctggattttacgctgctaacaagttacggtacccgagtatggccatacactgcgctggcctgattttttggcgaaggagcaatgaacctcctggcggatcttaatgcgcaccaatccggaggatgttgggctgaggcaagagcttgccagagcccgtggccgggtcgatcaagcacaccactacgaacaggcacccaaccccctgcatgtgcccggaactggcgttccgattccactatttcgcactgcgcaagatgcactttttgctgcacgcaaaggagttggtgactttccctggtggctatggaacgctcgatgagctgttcgaggtgctgatcctgaccggcaagatgcagcggattccgctggttctggtgggctgtacgttctagcgtcacatgattgatttcgatcttctgctcgacgaaggctatgtctgtccatccgatctcgacttgttcacttacgcggacgaagccgaggaaatcctcattaccctcgaacgcttttatatcaacgaggcagcaggacatgaatacaaagcagcggtcgatcgctgaatctgggatcatgatgcatacggttgactcgctgctgatgttggtaattctttggaatttgtccggctgtgcaatacgcagcgagctgcagccggcggtgcacatcaatgtggtcaagctgcagcaacatgtggcgcgccagcgtgccgacattctcagcagcaggaccctcagcgcgtcgactatgcagaccctcagcatgagcggcctggacctgcagccgtgcgccacgctctcctcaagtacctgcattccggcactagctgcggcacccggcttgtcggatgaagacaggcactccgcattggtcggactctggctgcagcaggccatggcagcacagccggcaaggtctgcaaaccccgcaaccacaggcctgcaaccctggctggagacagcacgccacgcttgggcatacctctttttcaccaaacacacgtcaggcgagcgtgcgtttgacgagcgccaggcgcaggtccgtgactggtacaacgtcgccaccacgcaggtcgttacccgactgttccaggcccacgacgatcagtcaccgaccgcaactcacatcggggatgccgccagcaccaacgtgagcagggataactggcacctgcgcgttcgcctgcaggcacgcttgcctgccggcgaacgcgccgcaagaattgctgccggcggcacagttgggtttccagggcgtgcgcagcatccatcgccgcgccggattcggcgcagagttggtggctgtgctgccatccgcgccctcgtcatctgcgatgccctggagcgaaatgtcctcgcccaacatgaccgcaatactcagcttggaggccgacaacctggcgcaactgcttgcaacgcaggatgtcaccgtcagcatgcatgatccattgatggaagatcacctggatctgcacggccatcgcgtgccgttggccagcaactttactgccggctatggtttgtggctggcgtgctcaggcttcaacgagcaatcgctgcgcgcattgctgggccgcgagcgcggcatcgagcgaccgcacctgtacctgctgcaaccctttgatccacaacgccgcatcatcgtcatgctgcacgggctggcgagcagccccgaggcctgggtcaatctggccaacgaaatcgagggtgacgagcaactgcggcgccagttccaggtctggctgatctactatccgaccaacctgccgctggtcgccagccatgccgccagttgctgattcagtcccgtgatcactttgatccggacggcactgcgcccgcctcgaaaaacatggtggtcatcggccacagcatgggcggaatgattgctcgcctgctggtctcatcggctgacaatcaactgcacgactgggccatggccgatgcaagaaccgacccgaaccagaacgaccccgagcgcacactgctgaaccccatgttgcgcttcgaaccccctgccggtatcgagcgtgccatttttatcgcgaccccgcaccggggcactgcaattgctggctaccagcctgtgcgctggctgtctgtctggcctgtttcggttgccattgacggcgctggaagccgtgaccgacgccgtgatcccttcagttcaggccacagggcaggttcaggatggctacctgcaaggaaccccgaacagcattgaccatctcaatcaggacgatccctttgttcaggctgccacaaaactgccgatctcacccgaggtacgttaccattccatcattgcccgcaccaatgccgatgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacagggaatggatcctaaaatattctgggccgggccaaatgcagtcattggcggattgctattcggctttggtattgtactggcaggcggttgcgaaacaggctggatgtatcgcgctgtggaaggacaggtgcatttctggctggtgggattaggtaacattatcggttccacactgttggcactggtatgggatgatctggcacctgccctcgtcgtaaattttgacaagatcaatctccttaagatactcggaccacagggcggtttactggctacctacattatgctgggtatatttttggcactggtgctgtactgggaaaaatatttctttgcccggaaagcccgccaggctctgtaaacggcctgaacataagcgccttccatgaaatcaactactattattcctgactttcgcctcgatatgataggagaaccttgcccctatcctgctgtagcaacgctggaagctatgcttcagttgcagtcggggcagattctggaggtgatctccgactgtccgcagtcaatcaacaacatcccgattgatgctagaaatcatggctacaaggttctggaaatccagcaggatggtcccaccattcgttatttgatccgccgttaagataaaattgggcttggctgaacaatctttctaatcaggaaatcttttccagcaggcggcaataaggacaatccgatgcagaccagatgatcgccacaggagacgtggatcgttcaatgagaataaggtgatccagcggcacatcttgcttaagctgctgtcgcaaccaggaacgtttcccctcagggctgttttcagcaggtgattgaatcgatcatcccggaccgcacagcataagtttctcatgccttatgttccgattgagtatcagaattatggcagggggttactttttcttatcccgttctccttcttcgtgattcacgagagaccggattggctcaatcaaattttcgccaccagagggagtactaatacccagcagaacatgacttctgcgatagccatacagaaaataaaaaatcagcccgactcctgtccagattggaaataccagttgagcatctgttggcagaaacaaaaaaagtgttatgcagccaccgatagcaagtggtcctaccagccagattgcaggtgctttaaaaggtcttgcacgattcttatccttgatccgaagaatcatgacggatagcgccaccactagaaaagcaaacagtgttccggagttggagatattcgctagcttgcctactggcaggaaagcggctgataccgtaacgacaagcccggtaaccagtgtcacgatatacggggttttgaaacgcggatgaatatggcttaatacttccgggagcaggccatcacgcgacatgacgaagaaaatacgcgtctgcccaaacagcatcatgaggatgactgagggaagtgccaggaaagctgccagaccaatcaggttgccaactttctcccatccgatctggcgtagcacatgtgccagcgcttcatgcgaacagacaaccggttgttgtcccgctgctgcgagcaatttgcattgtgctgccatttccctggagccgggcataagaccttcccctgcggcatcaattaatggctgcgcacctaccgcaccgaccacaccagcggaaatcagtaaataaaataatgtacaaatcaacaatgagctgatcagggcaatcggaagatttcgttgtggatctttggtttcttccgccgcagtcgataccgcatcgaaaccgacatacgcaaaaaaaatggatgccgcagcagcagcaacacctgatgttcctaatggcagaaaaggatcaaagtgattcatatcagcaaccggtaaagcaagtgctataaatgctgtcagagcgacaattttgaccgcaacaagagtagcattgaatgtagcgctttcccgtgtgccgatgattaacaaaccgacaaccaggatgcaaatgattactgcaggcagattgatgattcccccggcaaagggaccatttaccagagcaaagggaattttaatccccagcgaggaattcaataatccgacgaaatagcctgaccagcctacggccaccgcaccagcagcaacagaatattccaggatcaatgcccaacccaccatccaggcgattaattcacccagtactgcgtaggaataggtataggcagatccggatatcggtaccatcgaagagagctcagaatagcaaagcgcagccactgcacagacaaaaccggcaatgacgaaagcgatcatcattccagggccagctttctgggcggcttcggcagttagtacaaaaataccggttcctataattgcgccgattcccagcaaggtcagctgccacacgcccagggaacgatgaagacttttcttggcagccgtggccagcatagagtccagcgattttatacgccagaagatcatgagcttcctccttcaataaaaacaggtagttgcaacatttctgaattcaatgcgaggtagtgtacaagaaatgccatgaccaaaaacctgaaatcgagatacatttctacatacttctacatttttcacaatctctgcgaaatatttgcaaactgacaagctaaggcggtctatgaagaaactcattcccaattgaaagtgaccctgacacctgagcaatacaccaaactacaggaactaaaacagcaccggcaagaacagtagcgcaaaacatatctggaaaaacagtagaacatcacaacaggaaagccgttgcaggcggtttattcatcgaccattccccctaatacatccatcaattcgggtagtagctgccgcagttcagccgtcattaggaaaaaatcgctatcaaactgttcttcagctgtttctgtcgattcccggtcgatatcaagcaaggttattcgctttaactgcagattttcatcgagaataaatgagatcctgtctcgccaggttattgccagtttgatgacttccttgccagtccggacatgccgggtaatttcctgtagatcaggcaattgctgcacatagctcactgaaatctttttatcctcgcggctgcggaaaatactgtcgctgtcaacagagaaaattgcaggtggttcatcgcctgatagccaggccgtcatggcggatgttggtgcaatattagttctgacgcgctttagcccaataccagtcgatttaatgaatgcctcaatcagggtatctgctctggaagcgctcgcaccttcaacaacaaaccagccatccactgggtcgatccacacatgattccgttgccggacagaaaacgcacgcgccagcagctcacgataagctgcttccttgatatctttcatctgtttgcgaccaggtgggtatccctggtgtgattccatttcctgtgcacgaactttggcaagctgattgacaactgacacaggtaacagctttttttctatccccagcgagatcagcatctgctgcccgtagttgtagaccagaccagcttcctcggctcccggggaaacccagcccttgctctgtgcttccagccccaggcagccctgcaatgtttgcttcgctaaccgctcttccagctcgtcaaaagtaatcactgcgtcggcaagatggtaaatctgtaaatttttaaaccacatgaatttgtattgagatagaaatgtgcgattaactacaacaaatctgaggattccagtaatccggataggatctgttaacaggttggctagttggcgccctggagacgaatcgaacgtccgacctaccccttaggagggggttgctctatcccctgagctaccagggcgggggctgcattttacgccaaaattccggatgaacgaaattggtatgctctcctgatgtagaaaaattcaatttattaccagattttccaccagggtttttctaccagcgaaccggaatctgtaaggtaagcactttccgggaaattttttttgatgactttttctgtatcttcgcgcaaatcgatcatgcccaactcattgtaggcgcttgccatgatgtacagtgcttcttctgtcgcaggcgtttgcgggtattcttccagtacaaactgcgcacgcctgagagctgctatgtaagctttccgtttcatataataccgggcgacatgaatttcaccccttgccagcgcattgaccagataagccatgcgctgcagtgcatcaggtgtatatttactatccggataacgggttaccagcagcttgaaatcttcaaatgattctcttgaagcctttgcatcccgttcgctcaaatcctgtttaatgattttggtggttatataccccaatagaccttgatcatcgttaaagctggcgagtcccttgatataataagcataatcaatattatgatgatgtgggtagagctggataaaccggtctgccgctgcaatggctgaggcctgttcctgatccttatagtaggcgtaagctatttcaagctgtgcctgttgagcaaaccgtccatagggataacgggcttccagtgcttcgaacaatttgactgcagctgaataattaccctcgttaagctcatttttggcttcgatataaaatttactcgcagaccattggctgttatcaaccgttttttcggacagaatgccacatgcggccaacaataccatcaaccaccctgccaaaaattgtcgcaacataatgaataatctcaataacgggcaagatggacgcgattatagcgcaaagcctgattcatccacagccagcggccagaaaaatgaagatattatcgaattgatcgcgccaggtaatcttgcaggattgcggctggatcaagtgctggctcagttgcttcctcaatggtcgcgcagccggttacagcgatggattggagaagaccgtgtcagtgtggatggctcggcaggatcaaccaggcaaaaaatatggggaggagaaataatccatgttacagctggtctggttgaaagtgatcaaagccatcaggctgaggcgattccactcagtattatctacgaagatgatcatttgattgtcatcgataaacccgccggtctggtcgttcatccaggaaacggtaactggcatggaacattattaaatgctttacttaaccatgctccacaactcagccaggtgccacgtgccggtatcgttcaccgactggataaagacactaccggcctactggttgttgctaagacaatcgaggcacaacttgatctggtcaggcaattacagcagcgtactgtcaaacgtcactatttcgcgctcgcgctgggtaggatcgagaaagatggcctggtagacgcacccattggccgacaccctgtgcatcgcacccgcatggccgtggtgaaaaatggcaaacctgcccgcacatattatcggattctggaaaaatttgttgcttgcacattgctgcaatgtagtctggaaactggacgtacacaccagattcgtgttcatctgatgtctattggtcatccgttggcgggagatccggtgtatggcaaaatttcatctgatccaccaacagctgatgcgatcgtacacctgccaagacaagcattgcacgcccggcagctcgaactgacgcatcctaacagtggacagattatgcactgggaatcttcgctgccggatgatatgagcagactcttacagataatgcggaagaccccacgacccatcctggcattttcatgaatccgtatttctggatgtaatcggtgtaattatttccgggtttctatccaaaacacagataagccatagttttctacctgaaataaaatgactgacctatttattcggtgtctgcccaacggtacaataccggccaacgtaccttccttgcattttctctgccaagctcgtgtaccttacaaaccgtttcacaagtaaatgttatttttctggagaaaaaactgtggcagctgatgttttaaagatgattcaggaccatgaagtcaagttcattgatctgcgcttcaccgataccaacggcaaggaacatcatgtcacagttcccgcacatgtcttggatgccgataaattcgaggatggtcatccgttcgatggatcctcaattgccggctggaaaaacattcacgcatccgatatgttgcttatacctgatccagaaactgcttcgctggatccttttatggaagaaaccacattgctgctaacttgcgatgtgattgatcctgctgatgggcagggatacaaccgcgacccgcgatcactggccagacggggagaaacttatctgaaatccaccggcattggtgacgttgcctactttggcccggaactggaattttttatttttgactcggtacgctggcacaccgacatgtctgggtgttttgtcaagattgaatcagaagaagcttcctggagctccaaaaaacgctatgaaggcagtaataatggttatcgtcccgcaatcaaaggcggatatatgccggtgccaccagtagattctctgcacgatattcgctcagccatgtgtatggtgcttgatgaactgggaatccctgtagaagttcatcaccacgaagttgccaatgccggacaatgtgaaattggtacccgcttcaacagcctggtgaaacgcgccgattggaatcaactgatgaagtacgtcattcataatattgctgtttcctacggcaaaacagcaacattcatgcccaagccaattgttggtgacaatggttcgggtatgcacgtccatcagtcaatctggaaggacggtaaaaacctgtttgcagggaacggttatgccggtatgtctgaaatcgcgctgtattacatcgggggcattatccgacatgccaaagcactgaatgcttttgccaatccaggcaccaattcgtataaaaggctggttgccggttttgaagcccctgtcaatattgcttattcttccagcaaccggtcagccgctgtgcgtatcccctatgctagcagcccaaaacagcgccgtattgaaatacgctttcccgatcccagtgccaacccttatctgacctttaccgccctactgatggcagggctagatggtatacaaaacaaaatccatccaggcgatccgatggataaaaatctgtatgatctgcccccggaagaagcctcgatggtacccaatacctgcacatcactggaagaagctctggaaagcctggatcaggatcgtgaatttttgacacgcggtaacgtattttccaacgatatgattgacgcctttatcaagcttaaatcggaagaggcaacattgttacgtaccactacacatcctgttgagtttgccttgtactacagcctgtaaaaagacggtattaatcaacgcttattcacagatcaccaacaacaccacccgacttaaaatctgatatttcccgggcagaacttcgtatttcgctaattcgttaaatatggggttccggttcaaactcatctattttagaaatcggggggtatccatgaaaaaaacttactgcacgatcatactgtctggagtcatatcactcgtattttccactgttagtgcagcttccggtattcacaagttagtggatgagcatgggcgcatcatctttaccaataatgcagccaaagattccataagaattcaatccgaaacatccagatcaacgatttcctcccgccaaataaatggcgttgccggaaatcatcccagagtcagcaaactgcagcaggatcagcgagataccaaacgtcggagaattctttctcaggaactcgctaatgaaaccaggttactggaagacaccctgaaaacaattgatctgactctccggaaaacggaaaattatttaccaaatcacccttacttcacgtcaaattattttgatattctccaactgcgtaaccaggcagcttcacacgaacgtaacatcaaggcacttaatgcagagctcaataatctctgaaacaaacctgattgcggttagagtctgctgtttgattggctgcctcagatttattatcttgaattttgcagccacctacaactatctgaatagtattcatcatttttcctcattacaagataactaatgtgatattcctgaaggttggcagtctccgttataatcaagtttaacatctgcatattctatatttgtaggcgacaagcaaggccaccggtcagctccgtatttgaagaacacgccctctcactccacttgaaaacaatcagatgtcttccgtatctgatttgttgtatcaaccagtaatctggaaagaaaatttcatcatgagaaataaaatcacgataaactgccatccttttgtgcgtgcgagatttattatcagcaactctccggataaatattatcaatcccggacgaaaactaaacaaatatgaaacaacctgaatgtcttgccttgacagatctgattacaaaaaaaatatcagccctgctccatacccaattaagcaccaatcccggcataacaagccagatctttggaacgccacttatagtggtacaacagagtaaggatatttttgcatgattgactggtcctatacggcggccggtaccttcacaggctttattatcggattgactggtgttggtggcggtgctctgatgacacccatcttgttactgtttttcgggatatcgccaacaaccgctgtcgctactgatttatggtttgccgccatcaccaaaatagccggtgcacgaatacatcataccaatggcaatgtggattggcaggtagtcaagcgtctgtgggcaggcagtcttccgatggcttcactgatcgtactactgataagtatggggacacatatcgtaaaggtagactggcttacaaaatgtattggtatagtagtgctggttacagctatcgggttactggtagctcccagactgatcgcttttgctaaaagaaagcagattggacagccggaacgatttaagacaatgcaagcagtgcttacaatcttcgcaggcgcaattcttggagtatgcgttgcactgacatcagtaggtgccggagtcttgggaagcgtaatgcttctgtacctgtatccactacgcataaccccacatcgcctagttgctacagaaattgtgcacgctataccactagcgattattgctggcttgggttatttgttcgcaggtatggtggacggagagatgcttattagcctgttagcaggctcaataccggcggtcattgcaggaagtaagcttgccagcaggattacaggacaatggatccggttcgctttagcaattgtgcttgctgcagcagggttgaaagttcttttataaagaaccatttcaatgcgccgtctgaaaaacagttgacacttatatttcaaggaatatgttacaggataaaatcctttaactagataccacccgaatatctggctcaatcgttctcagaagctgctcaattccacgcaatgttccagatatggaacttgggcaagttccacatgccccctgataatgaatacgcagaaggctgccttccagagccagtacatgaagatcaccaccatcatgctgcaaataaggtctcacctcttcttccagtaaaatattgattcgctccaatcgttgctgatcctcctcgctaagatttgccagcacctcactagcagcagcaaccacggtggctgattgatccgtcgcagccggcgcagcccgaattggatctgccacctctcgcgccagatcctgccaatccgcacctccatcctgtgtaatcgtgatccagcgatccacataaaagacattgataacatgatcaatatcaaacaacgcggcagcaagcggatcatcagccgcctgttcggcgttattgtaagatttggtaaccccccaagtcagtggctccttcaggatgaacttcaatgcattagggtttggagttccctcaatttctgcaatcttcggcatggctatatatcagtaattatttgctacgggattgttgtttaggtgactatctgcttcagttgtggcatctcctgttgaattcatggccgcatgcagggtatgccacggcagaatcgcacacttgactctggtcggtaaatcacgtacccctgcaagcaccttgagccgaccaagatgatcaaaatccttgttttctctacttaccagcatatcccgaaattcctgaatcaaagcttctgcttcctgacgagatcttcccttaacggcattggtcatcattgaagaggaagccttacaaattgcacaggattcacctcgaaatacaatttcttcaatacgttcattcagcatattgacatccaggtcaatccgatcgccgcacagcggattatgtcctgtcgcatggtgggtaggatggctaagagaaccatagttacgcggcttgcgattatgatcaagaataacttcttgataaattgatttcagactcattgtgcgaaaaccttttgtacagaccgaatacctgccaccagagcatcgatctcttttttagtattataaaaagaaaatgaggcacgcgacgttgccgccacattaaaacgctgcataatcggttgtgcacaatgatgccctgtgcgcacagctataccttcctggttcagtaaagtaccaacatcatgcggatgaataccatcaataacaaacgatatcaccgcaaccttattcgggcaatcacctatgattttcacgtctgggatcattctgatttgctcagaagcataaagcagcagctcatgttcataatcagcaatagcatcaaggccgatctgttccagataatcaattgccgcaccaaaacctatggccgccgcaataggaggagtacctgcctcaaatttatatggtatctcgttatatgttgttttttcaaaggaaaccgaagcaatcatgtcccctcctcccttgaatggttgcatagattcaagcaaatgcgcctttccgtacaaaataccaatcccggtgggaccgcacattttgtgcgccgagaaagcataaaaatcgcaatcgagatcctgcacatctattttcaaatgaggcgctgcctgggcgccatcaatcaaaacaggaacatcatgctgatgtgctatggcaatcatgcgtttgatcggattgatgctaccaagtgcattggaaacatgcgacaaagctacaaatcgggtcttggaattaaaaagtttttcatattcctccaccagaagctcacctgcatcattaattggggctacccggatatgcgcacctctttcctcggccaacatctgccaaggcacaatattggaatgatgttcgagctcggacaaaataatttcatcgccacgctgaatgaatttacgtccatacccatgcatcaccagattgatactgtcagttgtaccactagtgaatatcacctctctatcttcacgcgcaccaataaaattttgcagtttacatcgtgctgcttcatattcctgtgtagccaggttggataaataatgtaccgcacgatgaatatttgcatgctgagttttctggtaacgaaccagacaatcaatgactgcctgcggcatttggctagaagcagcgttgtcaagataaatcagcggtttgtcatctaccttgatatcaagaatcggaaaatctgcacgaaattgccctatttcaggtacagttgtttgctgtgcagatgaagtcactaatgtgtcaacaattttcatgatttagctaatgcgtgttcttacaagaatatattcttcaagccgttgcctgagtgaagccactataacgcggttaataatttcgcctccgaatgcgtatgtcagcagattgcgggctacttcttctgcgaatcccctgctttgtagataaaaaagggattccttatcaagctggcctaccgtggcgccatgcgcgcatttaacatcatcggcaaatatctcaagctgaggtttggtatccatacgagctttctctgacagcaacaaattatggttcaactgcctggcatcagtctgttgcgaatgtggacgaaccataatttctccactgaaaacaccatgtgcgctctcgtccacaatgcatttgtgaagttgtctgctcctgccatgcggactggcatgatcgatgaatgtatgtgtatctgcgagctgacgatcagctatcagcgctaatccatctatctgacactcagcaccctcacccgccagcgtaattttctggtcaaaacgtgaaatacgcgcgccaagcgcaagactgaccgaatcataatgtgctgtctttgcaacaaacgtagagttattagcaatatgaaaagcttgcgaagcttcgcgttgtactcggatatgattcacacgggctgactccccgacgtatatttctgttactgcatttgtcagggatacgccttcctgccacgccacatattcttcgacaattgttacttcagctccggattcagcaataagcaagcagcgcggataggcagccacttcctttccggaagtaatatataaaacatgaaccggcaccgttatggaaacattggccggtataacaatacaaataccgtcatgcatgagcgcagtattcagtgccacaaatacatcatcctgaaaatcagcaagctggccgagatactgttccgttttggaagcacatataccagtcaattcggataaactacaaacaatgatagaaccatcatctgtcaggccggatagccccggcatatactggccatcaacaaataccagtctacaagtaggctcatccagaaaagtacttttctggctatccaagcctggtaatgaagccgttgaagctctcggaaacagtgtattcctgagtgaggaaatatcagtaaagcgccattcctcatcacggatcgtaggtagcctgagtgactcgatacgacttaacgcatttgcccgaagccgatttagataagatacagtacgagaaggctcaccttctttcctccaggattcaatcaatttctcaagataatcatcccagataaccgtgctcatggcagcgccccggtaatttgttcatttgtatgaatccagtcataaccgtgcgtttccagagcctgcgcgagttctttgccacttgttctaatgatacgtcctgcctccattacatgcacataatcaggaacaatataatctagcaaacgctgataatgtgttaccaaaatcagggcattatctttattagataactggttaaccccattggcaactattctgagcgcatcaatatccaatcctgaatccgtttcatccagcaaagcaagacggggttcaagtaaagccatctgcaatatttcgttgcgtttcttttcgcctcctgagaatccttcattgacgctgcgatcaagaaaatccggattcatcttgagcagtttcattttctcccgcacgaaatcatcgaactcaagaggatccagctcttcctcaccgcgttgcccctggacagtgttataagccaaccgtagaaattggttattagcaacgcctggtatttctaccggatattgaaaagcgagaaatatccctgcacgcgcacgctcttctggtgccaatgctgacagatcctgaccatcaaacaacaacgttccccgagtaacttcatagctcggatgaccagccagcaccttagcaaaggtactctttcccgagccatttaatcccataatggcatggatctcgccactccttaccgtgatatccactcctttgagaatctcggctccgctaactattgcatgtaaatcatggacttcaagcagaatcttgctgtttgcatttatcatccgacactcccttccagtttgaagctgagtaatttagtggcctctactgcaaattccaaaggtaattgctgaaaaacctctttacaaaaaccattaataatcattgagaccgcctcttccgcatcgatgccacgttgtgcgaaataaaacagctgatcttctccaattttggaagttgaagcttcatgttcaacttgtgcactattattttgtacttgaatataagggaaagtatgagccccgcattggctgccaatcaacatcgaatcacattgcgaatagttgcgggcattccgtgctgttggggtaattctcaccaagccgcgatagctgctgttagattggcctgccgaaattcctttactcacgatggtgctgcgcgtattcggaccgatatgaatcattttggtaccggtatcagcctgttgatggtgattagtgacagcaacggaatagaattctccaacagagttttctccacgcaagatacatgaaggatatttccaggtaatagccgaaccagtttccacctgtgtccaggaaatacgtgaattcctgcctttggccagtccacgcttggtaacaaaattataaatgcccccgacgccattctcatccccggcataccagttctgtacagttgaatacttgatatccgcatcatccagagcaatcaattcgactacggccgcatgaagttgattcgtatcaaaacggggagcagtacatccttccagataggaaacggacgcgccctcctctgcaataatcagcgtacgttcaaattgcccggattcttccgtgttgatacggaagtaggtggataaatccatagggcatttaacccccttcggaataaaacagaaagaaccatccgtaaatacagcggaattcagtgctgcatagtagttgtcccctggcggcacaactgtacctaggtactgtctgattaactcgggatatcgctgaacggcctccgaaatcgaacagaaaataataccaacctcagccagtttttctttataagttgttgcaaccgatacgctgtcaaaaataacgtcaacagcaactcctgccagtgccgcccgctcatgcatggggatacccagcttttcaaatgtacgcaacagctcaggatcaacttcatccatgctggcaagctttttctttggcttgggcgccgaataatagctaatattctgaaaattaattttgggatatttaacattttgccaagtgggctcaatcatattgagccacctccgataagcctccaatctgaacgtaagcagccattcaggttcatttttcttggaagaaatcagccggataatatcctcattgagccctttaggcgcaatatcggattctatattcgtaacgaagccgtgcttatatggttgattcaccaaattttgtaatgcagcactcatttttataattcctgaatttctaagttttaaggctgaaactctctccacagccacaagtattgtctatatttggattgctaaatttaaaagagctgtttagaccttcctggacaaaatcaatctcagaaccatcaataaaagacaattgatcgcgtttaacgataaccttggcatcatttgattcaaacaattgatcatcttccagcacatcgtcagcataatcaaaactgtacgcgaatcccgaacaacctgatttcttgattccaagtcgtaacgccacccctctacctcgcttgcccagttgatgctgaatctgtctggccgcacgctcagttaatgtaatcgccataattcactctattgcaaacaaataatcagaatgcagcttcccgcatgtcatataatttaactactgcctgttcacgctgtagttcgcgctgactctgctcctccaccagccgttccagggtgacattgccaagataatcaaatatgatctcattcagctttgtccataaatcatgggtcatgcatttactgtcgcccagacagttttccttaccaccacattgcgtgctatcgatgggctcatccacagccaaaataatgtcggccaccgatacctcatccaatcctttagccagacaataccctccgccgggcccgcgcacgctgtcaaccaacttccgctgacgcaacttggaaaacagctgttccagataagacagcgaaattctttgtcgttcactgatatctgccaatgcaactggtccacccccatgccgtatcgcgatatccagaagtgctgttaccgcaaaccgcccctttgttgttaatctcatttcaacctcttagcatgtaattttaaagcgattagaatcacttaccgctgattttccccaaaaacgaaactatataatacctgactatattagtcaactatagtcagcggtaaatatctgttgttgcgaaacgtaagtaaactctttatatttgccaacatgatacagcccgtcagaatcaacttcttctatcatccttcttacccgacgactctgttatgtctgctcggacgactgctgcgccttgggcgctaattattccaaccattttcccatctgtttgaagtgtaaaggctggcataccagccaaccgtccggtttgagccagaataatatggagtagaacaatgaaagagcgtttggttatttttgatacaacgttgcgtgatggtgaacaaagtcccggtgcatccatgaccatggaagagaaagtgcgtatcgctagacagttggagcgcatgggtgtggatgtaatcgaagcaggttttccagcagcatcaaaaggtgactttgaggctgtcaaggcagttgcggaggccgtgagcaacagcacggtatgcggtctttcccgtgcgatagaagctgatatcaatcgtgccggtgaagctctgcaggcaaatcagaatatgcgcatccacaccttcatcgccacctcaccaattcacatgaagaacaaactgcgcatgtcgcctgatcgggtcatcgaacaagcgatcaaggcagtaaagtgggctcgccaatatacggataacgttgaattttctcctgaagatgccggacgatccgaaatagattttctttgccggattctggaagctgtaattgatgcaggtgcccggacgttgaatattccggatacagtgggatacaccatgccggatcagtttggcggtctaatccgcacgttacgtgaacgaattccgaattctgacaaagctgttttctccgttcattgtcataatgatctcggcctggcggtagccaactcgctgtctgcagtcatgaatggcgcgcgccaggttgaatgcaccatcaatggcttgggtgaacgcgctggcaatgctgctcttgaagaagtagtgatggccgtgcgtacacggcaagattactttccatgcgacacacgcattgatacaacccagatcgtatctactagcaagctggtttctggaattaccggatttccggtgcaacccaacaaagctattgtcggtgctaatgcttttgcccatgaatcaggtattcatcaggatggtgtactcaaacatcgtgagacctatgaaatcatgcgcgcagaagatgtcggctggggagcgaacaaattgttattgggcaagcattccggtcgtaatgcgtttcgcagtcgcttgaaagaactgggaatcgaattggaatcggaagagaaactgaataccatatttatccgtttcaaggaccttgcggacaaaaaacacgagatttttgatgaagatctgcacgcgcttgtttcggatgaagcacagatacccgaagagcattaccgtttactctcactagtcgcacacagtgaaaccggagaaataccttttgcacaggtcgttattgctacaggaaataacgagcaacaggccgaatcagaaggaagcgggccggtagatgcgacgtttcgtgctattgaaaaaatattgaacagtaaggcagaattgcaattgttttctgtaaataacatcaccagcggaacagatgccctgggtgaagtaactgttcgattgcaaaaagtcggacgaatcgtcaatggccatggagcagatacagacatcattgcagcttctgccaaagcctacctgaatgcctgtaataaactgcactccagcctggagcgcacacacccacaggtttagatccggaaataattaaaaattgtctaccataaagttgattttataaaaataaccagggggaaattccaattccggtacagatacaattactgtaccggaatcttacaaaaagctcaatggagcttgtgaaacgcattgtcttggtcagcctatcggaatacgtgatgaaacaacaatggggaattatagctttactcaccttgattttatgcctgtctgtcaaaggagttgaagcatacgacttccacttcgaggatagtgcaggtaaaactcatactttatcggattacaaagggaagtgggtgctggttaatttctgggcaacatggtgtccaccttgcctaaaagaaattccggatctttcgaggctatcacaggaaagaaacgatatcgtaatcatcggaatcgctatggaatacgacaatactaaagacgttatgcaattcgtaaagaaaatggcgatttcctacccgattgtactgggtgacagggcagcggcagctcagatcggggatgacatctcgatgttgccgagcacatatctgtttgatcctgatggaaagcctgcagcacgtaaaatcggactgattactcgtgccgaaattgaaaccttcattgatgcccgctaagaaggcaatataaattctagttattgtgaaactgtggagtaagtccaatggcgatgccaggcattaaacacaagattagggtaatcggccttgcccagactgccgttatatcttcccagcgccctgaaataatcacctttctccagatcgaggtagtggcgcaggattgtgcagccgtaacgtaggttgacacgcagatgaaacaagttgtgttcctggctgcctatcagatctacccagaacggcatgacctgcatatacccgcgcgctccggcagaagatacagcatattttctgaaattactctcaacctggataatgctaagtactaactcaggatcaagaccagcgcgagtagcttcataatgaacggtcatcagaaatgctttgcgctcttcaatttccgagatccgtttctccaggcgcttcatcatgctgtctagccagtttcttgcctcgagatcggaaagtgtaacaaacatgggtacagccctgtcactaacagtacgctgtaatactgtccgagtgctgaccgacaaggattcataagcctgagaccctgccatagccgtacttgcaatgaaaaatgatagaaaatttatcagccgccacatatttccctgataacagggataacctcctgtagagaaagtaaacgggatgttttatccagccgcccctggtattccaccatcccatcccgcaaatttcgctcaccaataacaatacggtgcggaatcccaatcagctcctgatctgcaaacataacacctggtcgttcctcccggtcatccagtaacacttcgacgcctgctgcacgacatgctcgataaagtttttccacttcagcctggacctgctggtttttatgataaccaatcgggataatcgacaactgaaatggagcaattgccactggaaatatgatgccgcactcatcacagttttgctcaatagccgcagcaacgatgcgtgaaacaccgataccataacaacccatttccagaatttgagtctggccagattcatccagataggttgctttcattttttcagaatatttggtacgcaattggaaaatatgaccaacctcaataccacggcaaatttcgagcattccctttccatcaggcgaaggatcacctgtaaccacattgcggatatcgaatacctggactggcaatggcagatcacgttcaaaattaacttgagtcaggtgatagccttcttcatttgctccgcagacgaaattgctcatttccagaactgctcgatcagcgataatttcagtttttacaccgatcggaccaagatatcctggaaggcaaccagtttcggcaataattctgctttcatcagcaaactcgaagttactcagaaacgggatttttctggtttttgtttcattgagctgatgatcgcctcgcagcagcagtagataaaatcggccatcggctatcactgccagtgttttaagagtctgttctattggaacgctcagaaattcagcaacatccgaacaggatttacgatcaggggtagcaatttttttcatcacacccgccggatccttacgcagaattccatgtgatattgcttcagcaagttcaatattggcggcataatcggaatcagggcaaaatgcgacagcatcctcacctgaatcagccagcacgtgaaattcatgtgatccgctaccccctatcgccccagtatcagcagccactgcgcggaatttcaatccgatccgggtaaaaattctgctgtatgtttcgtgcataagctggtaggtttgttccagactgtccagatcagcatgaaaggaataggcatccttcatgataaattccctggcgcgcatcacaccaaaacgtgggcggatttcatcacgaaacttggtctgaatctgatagaagttaataggcagttgccgatagcttttaatttcacgacgagcaatatcaacaataacttcttcatgtgtcggcccaaagcagaaatcatgctgatgcctatcttgaattttcagcatttgcggaccaaatacatcccagcgacctgattcctgccaaagttcagctgggtgaacagcgggcatcagaagctctagcgcaccactgctgttcatttcctcacggatgatatgttcaatcttgtgtagaattctcagaccaagcggcatccaggtatacaatccgctgcccagacgcttaatcagcccggcccgcaacatcaaccggtgactggccagctcggcttcagcaggagcttctttgagcgtcgaaaggaagaattgggaaacacgcatgatgaggttccatttatcatagtaggtaataagataattttaccttgaaactgttttgatccggtacgctttaacgggaattgactacagcattgcaagtcaaatttagcatgctgtaaagatgttgatgatgctcctactgagagcagcggctgtaaatcacactcaaaatatggaaaaattatcggaaattcactgtaaatcaagctaaattgacagataaattgtatgatcgaccgtaatggatatagagcaaatgtcggtattatcctcctgaactcaaaaagccaggtgttctggggaaaacgtgcccgacagaattcatggcaatttccgcaaggcggaattaaatcaggcgaaacaccaacgcaggcaatgtaccgggaactggctgaagaaacaggcttgcagcctgttcatgtggaaattttgggccggacacgagaatggttacgttacgatgtacccgcctgctggactcgccgcgactggcgcaagaactatcgtggccagaaacaaatctggtttctgttgcgtatgctgggaagagattgtgatgtatcactcaaaacttgtgcgcatcccgaatttgatgcctggcgctggaaccagtattgggttgaactggaatctgtggttgaattcaagcgacaggtctatcgtctggcgctgacagaactttcacgattactggatcacgaaacctgcctgggtaatgatcaagcctacagggagccactggaaccagttaaagaacttgaggagaaatcttctgatgccaggcagggttgattcagtatcttggagtcctgactccggtccggcaacaaaaaattcaaggcgtaagcggctgcgccacgttagccgttactattttcaaaccttaaggagaatgcaatgatcaagcgtacattgactgtttcgctgttatcgttaagtctgggagcgatgtttggatctgttagcgcaatggctgccaacgaaccaatccaaccgattaaggcagtcacccccgaaaattctgaagtggccgagctggggaaaatgcttttttttgatcccaggctttccaaatcaggatttatttcctgcaattcctgccacaatctgagcatgggcggcactgataatattaaaacctcgatcggccacaaatggcagcaaggtccaattaatgcgccaactgtactgaattccggtatgaatctggcacaattctgggatggcagagctaaagatttgaaagaacaggctgcaggcccgattgccaacccgaaggaaatggcctttactcacgaaatggcagaaaaagttattgcttcaataccacaataccgagaatatttcaaaaaagcctttggatccgatgaagtgacgattgatcgcatcacaacggcaattgcccagtttgaagaaacactggtaacaccgggctcaaaatttgatcaatggctggaaggtgataaaaacgccctgagccagaatgagttggaaggttacaacctgttcaagagcaatgggtgtgttcagtgtcacaatggaccggcagtaggaggaacctcctaccagaaaatgggagttttcaaaccctacgagaccaaaaaccctgctacaggacggatgggggtaacaggcaaggaagaggatcgcaacgtatttaaggtacctatattacgaaatatcgaactgacctacccctacttccacgatggagaggcagcaacacttgaacaggctgtagaaaccatgggaagaattcagttgaatcgcgaattcaacaaggatgaaatctccaagattgtcgcttttctgaaaacattgactggtaaccagccagacttcaaaataccagttctgccaccttccaacaacgatactccacatcctcagccatttgagtgatgttgaaaagaaaattctgattctatccggatttttatgaactgctcagccacttcatgttaaatgaggacggttgggcagtatcaatcaagtttaacactgcaaaaatatgctttaatctacccggcaaaaatcgacaatctgttatttaacagactaatcctgatacctgccatagcaaaccagtagacttaacagagcaaaccaacgggtcatgggtattttcagtattctgaaccaatcaccttctggcaaaaatctacagcgtttattccagctcagaattattgccatcgttttccaaatcattgtttttggggctgtccacagtcttatcgaacttgaactgccatggacagcaattattctgactgttttcatgcttgcggttctaaatttcttcacctgggttcgtctgcgttatccttggccagtaacttaccccgaatttttcactcagttgctgattgatgttgccggattgactgcattactatattttagcggtggatcaaccaatccttttatctcgctctatctgcttccgcttacaatcgctgcgactgtgctgccatggcactatacctggggcatggcagtgatcacaatttcctgctataccctcctgttatttaaatacatccccttcccgcatgatcatctcgatgatcacagccggcatatgtttgaattcaatttgcacgtctcaggaatgtggctgacatttgtattgagcaccttactcattacctcgtttgttgtcagaatgaatgcttctattcgtgaccgagacaaggagttgtccagatcgcgtgaacgggcactacaaaatgagcagattattgccttgggcacccttgccgccggagcagcacatgagctgagcacccctttatcaaccatggctattattacgggtgaattacagcaggaatccctcgaaaatactgaatttcagcataatattcgcatcctgcgcgaccagatttctcattgcaaacaaacgctgactcatctactggcagatgccggacaaaccagagtagaagaaggcaatggacaacctgtcgatctttttttacaacaggtaattgataaatggcagctgatccgtccatctgtcaaattcacccatcaatgtgaaggcacaaagccagcaccgattatcatgaatactcgcctgctgagccaatctatcctgaacttgttgaacaacgcagcggatgcctcaaccagactggtaactatcaccagccgctgggatgaaaaacagttgcacctcgaaatactcgacgatgggacagggttaaacacagaagctgtcgaacatgcaggggagcctttttttaccagtaaggggccaggacaaggttttggtatcggattatttctcgcaaacactaatattgaacgctttggcgggaatgtacgtttatttaatcgacccgaaggaggggcatgtactcatgtcaccattccggtttcgcacagaacaaccagtacttcactatgaaaggagaatgccctgtgaatgattccatggatcgcccaagcctgttaattgtagatgatgatgaagttttttgtgatgtactggcaagggcgatgacaaagcgcgggtttgacaccacttgtacacataacattaaaactgcgatcgaacaggcggaatcactcataccggaatatgccatcattgacctcaaattgaataatgaatccggtttatcacttgttgaaaaaatcagggaactggatcctggaacccgcattatcgtcctaaccggctacgccagtattgcgactgcagtcgaagccatcaaattgggagcaacccattatctggcaaaaccggtagacgcggatgatatcatggcagcgtttgagcgcacggcaggaaatactgatataccgattagccctcaccctctatcagtagagcgcttggaatgggaatatattcatcgtattcttgcagagaacgatgataatatttctgccaccgccaaggcactaaacatgcatcgcagaaccttgcagcgtaaactctcaaaaaaaccggtgcagctttagtttctgctccgcttaacagatatacacccgcgcgttgcgagtgtatatctgtcagcaactgattctgatcaaatgcaagttagagttctggccatcgggaacctagaaattaaccattgccgtcaaacggaaaatacgcggagcgcccggcataatgttgttattgttatgtgcggaggtagcgtattcgatattagccaaattttcgacattcgcctgaatgcgaatatttttatgcggttgtacaaatactgccgcatcaagacgtgtatagcttggcagtaataccgtattatcaaccgcagcgtagatgctgccacggtgaatcactcccagtcccaaaccaaggtaagacgtaaaatcataccggttccacacggctaccgtatgttttggaacttgtgccacagctgcccctttatctgcgcctgcaatattcttggtaatttcggcatcagtataaccatacccccccatcacactccaatgcggagtgattctccccatcaacccaatttccgctccgcgcgtacgttgaccatcgaccagtatcgttctagagaggtcatttgggtctgctgcaataacgttactgcgatcaagctgatacagtgctgcggttagcgctagatctgggcgaatatcccacttggcgccaagttccagattcataaacttttcaggttttaacgcttcattggttaccgaaagtgaacttaactgatcaccggctcgcggcacatacgccaggctgtagttaccataaatggaaagaggttctatcggtttgaagatcagccctactcgcggcgagatcaagccatcattagaatgagccttatcaccattgcgattattgcgaacagttgtatcaaaattatcgtagcgtattcctagtactgcttttagctgaggaataatagtaatctgatcttgcgcatatacacctaccgcttcgaccacaccgtggttatctgcatcagtagcactttgcctgaaagtgacaggcacaaatgacattggattgagaaaagatacagtggtatttttagaaacgttattgaagagtccggtattacggaaattatctgttacttgatggccatattccacacctgtcatgaactcatgatccaccccccaagtattcagcttgaatagtaagtctgtctgggtaaacagatttttgcgccgagttgcattgttataggcagataaatttaccgttccagttgcgtcttcagccgttgcctgaccaccagcatatacgttctgataaaatttatcgtaatcggcataacgagtgcgattgcgtaacttgatattgttattaaaggaatgttcaatcagtgagttgaatgaccaggcatcgactcttgcatggctatcatccggatttccaaaaaaagtggaacggtcgatatctgccggtcggccggaattgacaacattggccatggttccgaatgagggaatgccgcgatcaacaacccggcgatcataaaaatactctccgctcaggacgattttggtcttatcggttggtaacaatgtaaccgttggatttattccccagcgcttcagatcaacgttatcacgaaagctgtctgaatgctcaaatacgccattgagccgggctgcagcaatttcattgatcggttgacctatatccgcagtaaaacgcttgtggttgtaagaaccaaattctgcggtagctgccctgaccggttgccagtcagcttccttagtgacgcgattgatgaccccccctgccccgccacggccaaatatcattccattggagcctttcaagacttcaacacggtcaatattataaagatcacgataatattgaacatcatcacgcaatccatcaacaaagaaatctccggtagtactgctgccacgtatgattacggcatcccggtggccttctccttgagacgggacaatccccggaacataccgtacagcctcggtaatgctttgtatggattgatcacgaatcatatcctgggtgataactgtaatagactgaggtacatcacgcaaaggcgtatcggttctggttgcgctgaaactttctttggtcacatatccatcagtcggtttgatcgagtccgtggaaacgttgatggcgggcagcaccgccgaattatcgctggttgactggcctgttgatgattgtgcccatactgtttgcatcccgcttgagattgcaagaatagtaaccgcaatgtatacgccacccgtcccggctataaacttcattcaaaaatccctcatgtatatattattgataagcattctcgtttttatattatattatattaataaatgagaaaagagcagaaatctaatatttgcccagggcaatgcatctaatttgcgcggctgcgagaaaagaagaggcgtttttagcatgtctgtggtaattccatgccatcttctgagataaaggaaagcattttcgacaagctgcctcaattcatacagcgctttatcataaaatctttcctgattagaaagattgttcagctaggcccgattttttctatgataaggccatactggtccagacaaacccattagagaggaactgtcatggccatgaaccgtatccaatttcaagaaggcttgtctttacctgcatttcttgggatgagtaatgtgcggatgcattggaaacgtcacgttggccgcaaggattcagctgcccgggctgcggcaacgcaaattactacttacttcaggcaggaaaatacaagaacttccaatgtaagtgctaccagctacagacatctctgattgcaggcaccttgttctaaagcatccacttgtcgctaagcatctggttcttggcaatttatctgatcagccaagccaaaatcggcctgtcggcgctcgacctcaaacggcagccggacgtgaaccccacggcctggctgattcagcagaagctgatacaggcgatggtcgaacgggataccaaatacaatgctatgtggcaatgtccaggcggatgatgcttaccttggtggggaattgggggaattggctggcagcaaggcaaaccaggtatccgagaacaaagtgccttttgtggcggccattttgctcaatgctgaaggccgtcccctatatattggaatggtactactccctggttttacgtgcaaagcggtttttaactgggctactgcgggaacagtaactgatcttgccatctagggtgtcacctacggtgtcagggtaatcccccagggcagagcatccgcgcacaccgggtagatcgtaccgaacaggcgactcagcttgtcgtgagaggggataacatgggcatagcgggaaattgccatgataatatctgatctgattttatgcatctatcagagcttcgtgtgattgctccgctcacaaagccgactactgttgtagataatccggtaaaaatagatacacactcttgttacgatgtgtaatggtctgcaaatagctatgcacagggcgaggtaattgagttttatagagcccatcaagaaattcttgatcgtgagcagccaaacagacgaaaaggaatttcaagatggattaatttttaactttgaactatttgaagtgagagcacaaataatttacttcagtatctcgatggctaatcgatggtatccgtgtgcaaattcaaatggaacacgcctaacaacgttcattgcgcgatcagatgaaagtttgtctggcgcatagattacgaggaaggagctaccctcttgtgccgagtccaggtgaatctggatagcttcatcagcccagccgtaccgcgcaagaaatccctggttctgatcgagattctcctgagcagccatctttacttccttacttgagaaaaatgcacaatcgtcgcgctcatatccgcccgctatcagatcctgttgtacacgtagggcatcttccttatttgaaaatgcaaccaccacatagccgataggataaaaaagaccgaaacttgtgggatatttttgtttttctatcgctttatctttatctaccataaaacacctcctgattgttagaatactctgcctatttgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacacctattgcgtgacaagcttggcggctattgcgaatataaaaatatgtttagcaccatctgatccgatttgaagggctgttgctggccacggaccaggaaatagcaagacaatttacccgaaaactggagccttcgctactaattcgatctgcgagtcccgctagtgagatctggaaacgttacccgtgccgtagttcatgtagctgcatacaaagaacccggagctcaagtgccgcggataaaagtgttgctactctcgtatgcggatgcacaattaaaatagtcattcgccatccgcacaactactctcgtagcatagcacgatttctagcgaatgttcgcgtaatatctctttcttcagcgattgcgcttaaggtgtggacgagtcgaggtttttagagacgtccaaaagaagaatagctcatactaaaaacactagaatcaagttaatttatctgaacaaagcttgaaaataagctcccaaacgttgtcaccagattattttgagcaaaaaagaaaagtgtagggaaggttgatgcaaggatcgaaaatatattagctttagcagagaaccagcagtcaggaatacgagaataatccaggatgcaactttaccaactcccaaactggctaaatatgcttcattcgcacacagcaaggactgatctggatggtagattgtgcagaatgtcggtcgatatgaaacagggctggatcacttaggtatccttacgtaactcgctgcgtctcctgtttttgtataaccgccaaagcttcatgccatatccggataatgcataagccaggaacaatccaaataatacaagcggcggatgacttggaatcaagacgaagaagaacaggagcagcagcaatactacgaaaaatgaaacttttctgtgcagattaatttctttaccactgtagtaaggaatattagttaccatggttaaccctgcaaatagagtcatggcccaggctaaccatttgatatcatctgcagcgatctgaaagcccagtgctacccacatcatgccggcaatcaatgcagcagcggccgggcttggtaatccctgaaagaatttcttatctacaatttcgattgacacattaaatcgggcgagacgcaacgctgcacaggcacaatagataaaggcagcaatccagcccagctttcccatgtctttcagggcccattcatacacaatcaatgcgggagcagcaccaaacgaaaccatatcagataggctatcgtactctgcaccaaattcactttgtgtatgcgtcaggcgtgccacccggccatccagtccatcaaacaccatggccacgaatatagccacagcagaatgctcataatggccattcattgcttgcacaatcgcataaaaaccggaaaacaacgctgccgttgtgaagaggttaggtaacaggtaaatacccctccttcgccaccggacgcttgcaacaggcaatttttccgaatcagattcctgcataaatagatatggatatcagtcggaaataatcagcgaaattcagccagcactgtttgggtagcttgaaccttatcgccaattccaacattgactttcattcctagtggaagatagacatcaacacgcgagccaaagcgaataaagccaaaacgttgtccacgagcaagatactctccgggatgtacatgacagacaattcgttttgcgattaggccggctatttgtacgcaagttacatctcgcccttctttggttctaatccacaaggcattacgctcattttccaaagaggccttaggtagacttgcattcagaaaacttccgggaaaataccattgatcacgtatttcaccatctaccggactacgattcgaatgcacattgaaaacattcataaaaacactgatttttagcgcttcgcgcgaaagataaggatcttgaaccttatccaccgcaacaattctcccatctgccggggcgagcactgctccggcaagagtaggtataacccgtggaggatcacggaagaattgtaaaacgagcagagcaatcagccacaatggtagcgcccatacccaaccagcaaaaaattgtactactaatgcaacagcaaatgctccagcgataaaaggccagccttcgcgtgcaataatcgggtgtggatagtaagaagtcgacatatactcagttcttcgcctggtcaaccagtttgtttttcttgatccatggcatcatgtcacgcaatctggaaccgactgtttcaatcgggtgttcggaagcaaggcgacgactcgatttaagtacaggtgcaccagcacggtgttccagaataaattcacgagcatattcacccgtctgaatttcgcgcagaatcttgcgcatttcattgcgggttgcttcagtgataatacgggggcctctggatacatcaccatattctgcattatttgatacggaataacgcatgttggcgataccgccttcatagatcaaatccactatcagcttgacttcatgcagacattcaaaataggccatttctggtgcgtaaccggcttccaccagggtttcaaaccccgcctgaatcagtgacgttaatccaccgcacagcaccacctgttcaccaaataggtccgtttctgtctcttccttgaaagtggtttcaatcacgccaccacgggtaccaccatttgcggcagcataagaaagtgctaaatcacgcgccctgccagacttatcctgatgaacagcgatgagagatggaacccctcccccctgggtataagtagaacgtaccagatggccaggccccttgggcgcaatcatgatgatatccaaatcttcacgggggatgatctgtccataatgaatgttgaaaccatgagcaaaagccagtgtagcgtttttcttcagcgccggctcaacttcagtctgatagatcgatgccatctgctcatccggtaacaacagcatgacaacgtcggcatccttgaccgcttcacttacttcctttacagtcaaaccagctttctttgctttatcccatgacgctccatctttacgcagaccaatgataacttcgactcccgaatcatttagattgttagcgtgcgcatgtccttgtgagccataaccgatgatggcaattttctttttcttgataagggacagatccgcatctttatcgtaatagactttcattattttccttcctgagtgtttatgcagccacatcgacagatgagctatcgatgaaatcagaatctaccgacagatcccggtaaaaaatttatagttctaaaatccgttctccacggccgagaccggacacacctgttctggctatctccagaatcagattgcgatctattgcctgcaagaaaccatccagttttgctctggtacccgtaagttctatggtgtagattttatttgtaacatcaatgatattaccccgaaatatatcaacgagtcgcttcatctcctcacgatccttatccaccgcccttacctttatcaacatgagttctcgctcaacataaccttcatcgctcaaatcaatcagcttgacaacttcaatcaacttattgagctgcttagtaatctgttcgacaatttcttcagggccattcgtgaccagagtcatacgagacaacgtcggatcctcagtaggagcaacagatagggattcaatattgtaaccacgagcagaaaacaaaccggctactcgcgatagtgcgccagcctcattttccattaacaaagaaataatatgtcgcatactgttataccaaaatcatttcggatagaccttttccaccaggcaccataggaaaaacgttctcggtctggtctgtaataaagtctatgaatacaagctgctcatccagcttgaaggcttctttgagcgcaccttcaatatcttccggtttatcaattcgcatgccgacatgcccataactttcagcaagcttaacaaaatcaggtaatgcatccacataggattcagcatagcggttgccgtggaaaaactcctgccactgccgcaccattcccatgtagcgattgttaaggttgatgattttgatgggcagatgatattgtttacaagtggataattcttgtatacacatctgaatacttgcttccccggtaatacaggccaccttgcttcccgggttggccatttgcacacccattgcagcaggcaagccaaatcccatcgtacccagaccacctgaattgatccagcggcgtggcttatcaaatttataaaactgtgctgcccacatttgatgttgcccaacatcggatgtaataaaggcatccccactggttatttcatataacttttcaaccaccatttgaggtttaataatattagccgtcctatcatatttcagacagtcacgtgcacgccacagctcaatctgttcccaccatttaagtagcgcattaatatccgttgtttccctgccagccttgagcaacatgttcagctcttttaatactgccgatacgccgcccacaataggaacatctactttgacacgtttggaaattgatgatgggtcgatatcaatatggataattttcctttcttcattacagaaatgtttgggatttccgataacccgatcatcaaagcgggcacctaccgcgatcagcacatcgcaatattgcatagccatgttcgcctcgtaggtaccatgcatacccagcattccgacaaactgctgatcagttgatggataaccacccagccccatgagtgtaccggtacacggaaaattcagcatccgtacgaattccgttaattctactgcagcattatccagaatcacaccacccccaaaatagaccatggggcgttttgcttccaaaatcatctggatggctcttttaatctgctgaacatctccggtaactactggagtgtaggagcgcagtgaaatactggcaggataattaaattcggccttttgctgcgtaacatccttgggtatatccactaaaacgggcccaggacgtcctgttgatgcaatataaaaagcttttttgatcgttgtggccagctctgccacgtctttcaccagaaagttatgtttaacgcaagggcgcgtaatccctactgtgtccacttcctggaacgcatcctgaccaatggcagccgttggcacctgtccgctgataatcaccattggaatcgaatccatgaaggcggtagcaatgcccgttacagcattcgtaacacccgggccagatgtaaccaaagccacgcctactttattgctggaacgtgcatagccatccgctgcgtggagcgcagcctgctcatggcgaaccagaatatgcttgattttatcttgtttgaacaattcatcgtacaggaacaacacggcaccaccaggataaccaaaaatatgacttaccccttcctcctgcagacagcgtattgtgatctcagcacctgtcaattcagtactcataccaggaaattcccagatttaaaataatttttttcatcttgtaattaaaaccaatgccaattctttctttatatcgtttgctgcttacatagcaataaagcattattgaataatccgcgctcaaggctcgaaattaaacagtaatgcaggaaaaagcgccgttgcccttatcgatcatagataacaagctttccagatttcccttgtcggctgcaaaatacacaagacgtgagataaacaatatccgagctatattacttggattatatatttacttctcgtaaatatccccagtaaaacatgcagataataccagcacgtataactatccgtttgttcccccaactgttaagccatctaccctcaaagttggctgcccaacaccgaccggaacactttgcccttccttgccacacgtgccgactccagggtccagagccatatcattgccaatcatggaaacgcgagttagtacatcagggccgttgccaatcagagtagctcctttcaccggataggtgattttaccattttcaatcatgtaggcttccgcagcggaaaatacaaacttgccactggtgatatcaacctgcccacctccaaaattagcggcgtacaaaccatgtttgacagaagcaatgatctcttccggctctttgtctccattcaacatgcaggtgttagtcatgcgcggcatagggatatgagcaaatgattcacgccggccgttgccggtaacgggctgattcatcaacctggcatttaaattatcctgaaggtagcctttgagaataccatcttcgattaagacagtgcattgtgtcggattgccttcatcatcaatattcagcgacccgcgacgatcacgtattgtgccatcatcgaccaccgtcactcccggtgcagcaactcgttccccaatacgcccggagaaagccgaacttcctttgcggttaaaatctgcctcaagaccatggccaattgcttcatgcagcaaaatacccggccacccattacctagcaccaccgtcatacttcctgccggcgccggttttgaaaccagatttgttatcgcctgatgaacagccttgtgcgcataatcctgtaacaccgtatcggtaaaataaccatagtcaaaacgtccaccacctccagcaacaccctgctcccgctgaccgctttcttcgactataacctgtaaggataccctcaccagaggccgtacatcagcagcgagcaaaccatcactgcgtgcaaccatgattacttcgtactctcctgccagcgatgccatgacctgaataacccgtttatccaatgcgcgcgcaaattcttccaagcgttcgagtagcctgatcttgtcagcatcctgacaaagtgcgatgggatccagagacggataatacaacgcctgtcgagtaatatttcctgacaaacccattatacgtgtctgtttttcactgccttgagtagcaatcgcgcgtgttgcacgagctgcagaaatcagagcctgaccgctgatatcgtccgaataggcgaaagcagtcttctcgccactaattgctcgcacccctactccttggtcgatgctaaagctgcctgatttaacgatgccctcttccagcacccagccctccgaccggctatactgaaaataaatgtcagcataatcaattcgatgggaaagaatctgaccaaatatatcctgcaacctggttggattcaactcatacggggccagcaggtactgatcagctatcgcaaatgaatccatcattccagaaataaattctctttagtaaagtgggtaaacaaataaactgcggctacgaggcatgcaatgaaggtagcctgtagaaaaattagggtaacgtataagtcagatcaaatctatattttctcagcaggcaagcaagcaccgatgttccagtgcaggcaggctcgctcgtacacttgactgatatacacggtcgatttctgcgagcactactccggctccgcgcggaaggcgatcaatgattactccccatggatcaacaatcatactgtcaccattggtttcacgtccgttcacatggaatcctccctgtgctggcgcaatcagataagcctggttctcaatcgcacgagctcgaataagtgtctcccagtgagcttttccggtaatggcggtaaacgcagcaggcgccaaaatgatatccactttacccatcatgcggtatagctcgggaaaacgcagatcgtagcaaatagacagccccatacggccaaagggcgaatcaattgcaactacccgattacctgcgtcgatcgttctttcctcagcgaaattctcgttacccagtgacagtccaaacaagtggatcttatcgtatcgtgccacctgccgaccttgttcatcgtataccagacagctgttgtatactttattggaaagaggtgaaactaaaggtactgacccccccgccaaccagataccaaaccgcttggcagtttcactcagaaaattctggacttccccttctccaggattctcacgtaccgccagcttgtcggtatccttcattcccatgatacagaaatattccggtaatgccactagttgcgcaccctttgtagcagcctcttcaattagacgaaaagcttcctcaagattggctgttacactgggaccagaggccatctgtacggctgccacccgtactttggaatcaatacctgaactgggagaagtagtcaattcaacatttatactagtcgacatagttcttccctctcttgtattcaatcaatattgtcaagctgcctatactcagctttcctttcccttcaagtttattttgccccggatttatattttcaatttaatgacaagagcgtaaatatcaggtctcttcgtaattgttattgtacctgacctgcttaaatccgaataatcgtactttgtttcagattgaaaataacattatggcttatgattacgctgcctaacctgattctcttcctcatccagcctgattacaaccgggtcattccagcttccggttatggcatattcattcagcagcacccggctaaaaggatcttgtagcgttcccgaagcgatcatggcagcaattccagcaataggggttactaatccaaatgagggaaatactttcaaattcaaggcctgagtctcatttaccagatcccattctccgctcagaacaagttcggctgaactccccataatatataaaccatcagtcgaagcgataccgttctggatagcaacatggccgccaagtttatcaaagccaaatcctttaccaaatacatcataaaagtccaacgtcaatcggcgaggcaaagatttcaggtcaaaaacccccaataatctgccgataccaggcttcaattctgtgaattgcccgtgctgggcatcaaattgcagtttaccggatagtgttggaaaattgatagagaacggcttgcctgcccattccagatcgcctgtcatcgccccttccccacgagcgatacggcctggatagccatggcgcttcagaaatttaccgatattacctgattgcaactgaatatggctaaacacccggtaaggtgacctgtgattttcccacaatccactggcctgcaatgtactatctggatgtctgatatccagattctccacctgccagccattctgcttttgtacagcactcaatttcatctgacctagcaacacaccatccacgatcagttcatcggcctcaatatccacattcggccaatctccagggatatcaagactgtgctgtaacaatgcgggttcaggtgcatccttcggcataattaatctgctcagacgcgctgccactttctgtggggatgttgcatgccagtctattttaccggcgacctcacgactggaaacctgcatttgccaaacatcatcctgcctgtcgataacaaggtgggcatcattgaaatagctggacagaaattcaagctgcccaattcgcacatcaaactgtaccggcccggttaaaatattatccagtccacgtgctgtatgatcaatcgaaacatccgcttctgcatgtcttcggaacaactctcgccactgatcccattccaatttggcaacagcgccttcaatccgggtaatctgattctgtggcagcacacctcttccaccaaagcggatgatgccgcgtaccgggtggtaatgatgcacagcctcatgaacacgctgaaattccgcagtaataatatctccgtagcgcaagcgggtatgatcgtcatgtggccaggtaaaatatttttccagacgcaacggaacaacctccgcagctgttttagacaaaggagccggcaacgtgagtcccacacccttcagggaggattcgatcacaatactggctttattgtgctcgatatccattccaaaccgccaatcggtactacctcgcataaattgtgtccacaaatgtgacaaattcacgggttcagttgtgatcctgtccgactgaaagcgatcaaaatcagctcgtccgcttgcagtaatatgcatacctccttcaggagtagagacagaggatatttcgactggcccacctagtactttggcacgaaccccctccaacgccatgctagcttcagtaaaaaccagtgatccattaacctgataaaaatcaggaatatagcggtcaaagttgatctggttatccataaactgataacgcccttgcattctggcaatggaaaattctttctgggtaactgacaaagaaacatctgcctgcaatcgtccttttccagaaaattcagcctgatttaataactcaccaatatgctgatttacatctgccttacgcaacaaagcggctatttcaccactttcaccctccgccagaccttttatcctgatctttggttgttctgcatgcagatcaccggattgcagcgtgaatttttgcaacttgataccagaaatgttggcagaagaaagtgacatatccaaaacactatcctgtagcgagacatatcctgccatgccagaaatttccggccagtcaccgggagttttgatagcagcattgccaatatctgtttctgcacgaatggataacctgttctttttatcagctgattggctattcaatatacccttaacatgaaaccttgtatcatgcagctgccctgagatgatagctttgttgatctcgttcaccacagtttcatcggtcacccaggcgatatattgacccaaaagaggtatatcggcctgtgacaaatgcccggccaaatctatctgtccgggtaaattgccattaaaagcataactcccctgaagtgctccattccccgcatcgctcgtgaaaacaatattattgaatttcagctgggccgtttcatgaccatgcgcaattttccaatctactcgcccgatcaaagtatccaatcgtaatttttcttcgggctgctgcgtcttacggagttccatattccttgaggacagaaacagggagccatctgtttctgtcatgttgacgatcccactagcaccgctgaatgcagggtatttatcaagtgactgcacggcaagatcactgaagacagcatttgctttgaaggatgatttttcagaccaattgccctgccattcgagatttacatgttttactgtgccgcgaggagacacttcagacaagaatttatataacctattttctagtggcaggttggcggcaagtctggtcagtacattcaagtcaaacttttccacctgcaatctgtattcaggcggaccaccatccttatgattgcgcacatgccataacgctgcaactggctcagcaaggggaaaatccttcaattcaacacttaaatcacgtacaaaccactgttcatttgtatcctgtgcatcttctgtcttactccacccgctacgaccatacaagtgatcgatttccaacagggataaatgctgcgcaaaacgaatagctgcttttcgcagattgatatcagccacccaacgtgagagattgccagcaccaacatccatccaggcacgcacactgccttgcccgcgcttaagcgtcagatcagccggcaatgtcatccattcttgccagttttccagatcaaaatcctgtaactggacgaacagacgcccttgccacgctgatagcatctgtacagaatcaccaatcagatctccacgaatatccaccttggaaaacagtgggccagatgattgtgcccgtaacccgaattgatgacgctttcccccttgcctgttctgcagaagcagattgacagattcaaaataatgtacagtgcccaatcgcaaatcatcctgccagtagatgatcgcctgcttaaccaccaagcgccgctgacgcagcagccagtcaaagaacccactttcctgccgatctcctcccaaggtgatgcctgcaatatgtaataagccctctgtatcccggcgtgttaccaaagcaggtcgatcaattacaatttcgtgaaaattaagctcgccacgcatcattgatcgccatgaaactgtaccttcaattcctggaaaaattaataccagatgaccctgctgatcgtgcacactgacgccttgcatcgataaatgcgggcgcagcccatcccaattagcctggatgacatcaatccgcactggctgcccggcgacacgggtgattgctgcggcaatatcagaacggtaattgccgatatctggcaaaatccagtaacgtaatgcaagcagcgccaggcaaagaaatagtacgccgaccagaagacatctgcccgcccagctcaagcagaccacacaatagcgtaagaagtaacgcgacataaaccgactcaatacaaagctggctcccggaatatctcatccgttacctgaaatttagtttccatttaagaaataacagtctttacacccttcaacgggatatcatttccgtagaatcatgcactacagtaaaaacaaagcattttatgcgaagctatcactaaatccgtaatacatcgaagcaataaaatcagcagcaataacttgtcgcgtaactactatcttatatgacgacaccgatcagcacatcccgtgcagcttccattgtcagcagtattctgccttacagtcggtacttgaaacgggtactggaaaatgaatccgagcttcaacaagaacttctggagcaattacacagtccctttacgcgggaagaaatgcttggttttctccaagattccacggcgcacctgatagatgaggcagatttacaccgtttattgcgtcaactacgcaagcgcgtcattcttcggctggctgcacgcgatctggccgggctggctgatctgaacgaagtcatggcaaccatgacagctctagccgatgtaacgatccagttttcactcgaatttctccatacagcaatggtgcaacccgggcactttggtaaaccaaaaggagaaaaaactggtacagagcaacaattgctgattgtagctatgggaaaactgggcgggggcgaactcaatgtatcctctgatgtggatttagtttttatctatcccgaagatggcgaaacagatggcagtaaatccattaccaatcatgaattttttctcagactcgggcgaaagttgattgccagcctcaatgattataccgtggacggttatgtatttcgtgtcgatatgcgattgcgcccgtacggcgaaaacagcccgctcgccatcagcctgcccatgcttgaagactattttgttacacaaggccgtgaatgggagcgccacgcctggatcaaaagtcgcgtaatcaccggctcatcaatcgctgaagcagcgttgatggaactgatcgtacgcccctttgtatttcgcaaatatctggattttgaggcctatgaggcgatgcgtagtctgcacactcaactgcgcaaagaagtagatcggcgcgagttgcacgataatatcaagctgggccccggtggtatccgtgagattgaatttatcacccaggtgtttcagctaatccgaggaggacgggatgccgatttgtgtattcgccctacacttggcgtcttgcagcgattaaagcagaaacagcctctccccgaacagacagtagaagagctgattgaagcctattactttctgcgcaaacttgaacaccgcctgcaatatctggatgatcaacaaactcagaatctgccacaacattcggatgatcagatattgatagcaaaaagtatgggatttaccgactataccggttttctcaaacaccttgatctacatcgccagaatgttacccgtcattttgagcaaatttttgcagtacgccgcaaagccataaagcttggtacattcgcccggatcaggccagaacaaaccaacgacaacgaaatagttaaggtcttcagtaatcaactaaaaacactaggatatattgaccctgacaaaattactgcacgcgttcagcaattttacgatggcactacgtttcggcagctaagccaccctaatcaggaacgtatcctggaattaatgcccacattaatggaagtggtaactcgatttcctcctgtggaaattacgctggaacgtatgctgcgactactcgaaaaaatcggacaatattcagcctaccttgctttattacaggagtatccacaaaccctgccacgagtagccaaattggtcagtatcagccaatgggccagtgattatcttggcagccacccgattctgctggatgaattacttgccccatccggcctgcacaccctgccagactggccaacgcttaaaacagagcttatccatcagctgcatcacggcaatatacccaaggcacagataatagaatggcaaatggatgtactacgacattttcagcatgcacaggtgtttcgtttgcttgctgttgatcttgaaggaaatttgttgctggaaacactcagcgaccatttaaccgcacttgctgatcttattcttgacaatgttttacaactcgcctggcagggattaaaaaagaaacaccggaaatctcctgcttttgccattataggctacggcaaactggggggaaaagaattgggttacgtatccgatctcgatatcgtctatctctaccaggacaatcaccctgatgccatggagatttatactaaacttgcccagaatattaatctatggctaaccagccatacctccgccggcgtactttacgagacagatctaagattacgccctaatggcaccagcggattgctggtcaattccattgaggctttttccctgtatcagcatgagcaggcctgggtgtgggaacatcaggcattgacacgtgcgcgctttgtcattggtgatagtgaagtgggcgaaaaatttgaacagatacgtaaaaacatcctttgccaaccgcgtgatatggaaaatctcaaacgggaaattctgatgatgcgtacaaaaatgctggaagcgcacccaaattccacaccgttattcgatgtcaagcatgatcacggtggcattattgacgtggaatttattgtgcaatatctggttctgggttacgcccaccgctatccacaattaaccggcaacattggtaacattgctttactcaagcttgccggagaacttgggctgacatccgctgagaaagcaaatgcagcgtttatcgcctatcgtgaacttcggcgtacacaacatcaactccggctgagcggcatacctgaagccaccggtactgctttaccaaaagatgtatcccagaaatttgctcgtgtaacgagcgattacttaagcagtgccagacgggcagtctttcaactgtgggaagatgttttcggaacgtaagaaaacattgaaattgcgggcaacaaaagcaggtttttttggggtggctgatgggactcgaacccacgacaaccggaatcacaatccgggactctaccaactgagctacagccaccatggatctgaaaaccaatttatctgatcaagacaagatcagatctaacttggcgtgcccgacaggaatcgaacctgtaacccccagcttagaaggctggtgctctatccggttgagctacgggcacctttactcaagccgggctctggcccgtatcaacgacacgaaaattggtcggggtggagagatttgaactcccgacatcctggtcccaaaccaggcgcgctaccaggctacgctacaccccggaaaagtcggtcactataccgattaaccgggcaagcgtcaatcgcccctggcatttatgtaaaaataaactgtctgaatagcgcaccagatcaaatctggcattgcgcgtagatcaatatagaacagacaatccttcaaacacgcacaagatagaatattgcggtttccacttgtcggcacattattatcatagccggaaatcacgattcaccttccttcctgagtgtgccggggaaattactgaaaacgctggatgtgcatatcgtcggcaacatatacgggcaatcctgctgatgaagtgctcgttctccgtggtaccgaaggtaatacagaactcagtttgtgccgttctccatttgcgggaccaggatgcgacagtcgtgcggtactggagcatgaacaccttgcggccaaccggggcgggtgatcttgcataaaaaaacccccgtataacgggggtttgcaggcagcagtctgtgtgtatcagttcaacaaggggggagggttgtagctgatgatgatggtggccatgcgtttgttcaaccccatgacgggtacaaccagcagttttttaccagccacatctgatttgacggtaatggtttgcaaatcaagaacttctttcggataaagattcgatgcatcttcagtgatcagccttttatcagtggataccagcaattttccttcgtcactgatcagcacgacacgttccgtatcttttgttctgacgagttcagacagatactggtcaatctggtcaaggttattacggattaattcaccacgcactgcccatgccagtacctggccgaagcgttcttcttccttgttatattggctgtccgcatattcgcgtgcctttttgaccagtgctgtactttcctgttcgagcttcagggccaattcagcctgacctttttccagtcgtgattccgcttggttgacagcaatctgcttccagacgaataccagcagcagtacacccagaaaaaccagtattgaccacgaaggcagctgtttatgctggagatcggaaatcggcgcaaattttttgcacaaaatattgaataatgaagcgggtttggtccattcaaccttatctttggactgatcgcccccgttctgcgtgttttgatccgacatgaattgctccttcgttaataagtgactcaaatgaaaggtgctaattatccaccattccctttctcagggaaagcagcgctgccaacaacttgcgcatattatgcatatgtgttgcaaaatctgccagtcttgtacagattctttccgggttacgggtaaaatgcaggctttcaaccaacaaacagtaagtagatattcccgtggaaaaagataaaaagacctggtcaggtcgtttcagcgaaccggttgcactactggtacaacgctataccgcatcagtcggattcgattatcgactggccgagtacgatattcagggatcgcttgcgcatgcacgtatgctggcagccacaaatatcatcccgcaaactgatctggaagccattgaaaaagggctggcgcagatctgggaagaaatcaaaaatggccagtttgagtggcagcttgagcaggaagatgtacatctgaacattgaacggcgtttgacggcgctgacaggggatgccggaaaaagactgcataccgcccgctcacgcaatgaccaggtggccaccgatattcggctctacctgcgcgctgccatagatgagattatcgacctcatttatggcctgcaatatgtattactggatctggcggaacagcacgctgccaccattatgcctggctttacccatttgcaggtggcgcaaccagtttcattcgggcatcatctgctcgcctactatgaaatgctgctgcgcgatggacaacgtttgcaggattgcagaaaacgtgtcaatcagctaccgctgggagctgccgcgctggcgggcaccagttatccgatcgatcgcgaacaggtggcacgcgaactggggtttgatgatatctgtcataactcgttggatgctgtatctgatcgtgattttgcgattgaattctgtgccagtgccgcgcttatcatgatgcacctctcccgcctgtcagaagagctgatcctatggatgagtccggcatttggctttatccgcattgcggaccggttctgcacgggttcatccatcatgccgcaaaagaaaaatcctgatgtgcctgagctggtgcgcggaaaaaccggtcgcatcaacggccatctggttgcactgttaacactgatgaaatcacagcctctggcctataacaaggacaaccaggaagacaaagagcccttgtttgatactgtggataccttgaaagatacgctgactatctacgccgacatgctggccgggctgcaagttaatccacaagccatgcgccaggcggcattgcgtggctacgccacggcgactgatctggctgattatctggtcaaaaaaggaactccctttcgtgatgcgcacgaaacagttgcccaggcagtccgtttcgcagaaaacaagggatgtgacctgagtgagctctcgcttgcggatctgcagcaattctccgcaattatcgaacaggacgtatttgaggtgctgacactggaaggttcgctgcaaagccgaaatcaccccggcggcaccgcaccggagcaggtacgcgcggctatctgccgggcacgttctcaattgccggactgaagtggaaatgaagcagcaatgaagcagcaatgaaacggaatatacaacaagctacttcccttccatggacagccattgctgcgcaaatctcacagcttacccggcaggcgttcaccctggaaaacctcacctcgattggaggaggctgcatcaatcagaccttctgcattcgcaatcaggatcagcaattctttatcaaactgaataaggccgagtatctggccatgtttgaagctgaaacagccgggttggaggaaatcctagattccgccagcctgcgtgctccacggccgctttgcagtggtagcgggcatggctatgcctggctggtgctggaatacattgacttgcagaatcagggtaatgcagccgcactgggtatcgggctggctaatatgcatcggcatactgctgaaaaatttggttggatacgtgacaacacgattggctcaacgccacaaagaaatacagccgatagtgactggattgcattctggcgccagcagcgattgggttatcaactgaatctcgccagggaaaacggttacaccggttcgctgcaatcgctcggtgaacgcctgctatccggttttcaatatttttttatgggctacacaccgcagccatcgctgttgcatggcgatctgtggggaggaaactacgctttcgatacagatgggcaacccgttatcttcgatccagctgtctattacggcgacagggaagctgatctggccatgacggaactgtttggcaggtttccaccagacttttatgctgcctaccgcgatatctggccggtggataccgggtatgccacccgcaagcagctctataatctttaccacatccttaatcatctcaatttattcggatcacaatactggaatcaggcggaaacgattatgaaaaaactactgtccgaatttgattaacatgaacagatacagatgtgccagtgtatccatttgtaaagcgactgctaccacaataaaattgacccggataataaataaagccctctacaaacctatatttttcaacgccaacattcactaattaaacaaggatcatcaaatatgagtacgaccaatatcctcaagcacctcgccaatctggaaaaacatctcgcagaagaacacccggataacccggttctgaccaaagccgtacacagtttcagaaaactggacagcgtcgcccaggcactcgggttgctggagcggaacgagtcatatgccacctatgtcacttggtggccaatgattgcggtgctgggcactttttcatcaggcaagtcaacgttcatcaattcctacctgaatctacccctgcagcgcaccggcaatcaggcggtcgatgacaaattcacagtcatctgttacagccgtcacgatgaagtcaagacgctgccaggcgtggcgcttgatgctgatccgcgtttcccgttctaccagatcagccataacatcgaggaaattgcagaaaccggaccgcaacgcattgatgcctatgttcaacttaaaacctgtccatcagaaaaaatccgtggcaagatcctgattgactctcccggatttgatgcagacagccagcgtacctccaccctgcgccttacccagcacatcattgatctgtccgatctggtactggtttttttcgacgcgcgccacccggaacccggcgccatgaaagatacccttgaatatctggttgccgctactattaaccgcccggatgccaataagtttctgtacatcctcaaccagattgatgtgacagcaaaggaagataatcccgaggaagttatttccgcctggcagcgttcactggcacaggccggattactggccgggcgtttctatcggatttatgacaaggatgccgctgtccccattcacgatccacaagttcgggaacgttttgaacaaaagcgtgaagaagatttggcagacatcagtgcacgcatgcagcagatcgaaatcgaacgctcctaccggattgccgccatgctcgaacaaacggccaacaccattgaaacacaggttatcagcaaacttgaagccgcgctggatcaatggagaagccgggtatttacgctggatagcatcttgctcggtttgctggtggtattgacgggtgcggcgctgactgccaccgaaagctggcacctagttgagcgttgtatcgccggcatttctgccgggggcgtattgccgattcttttgggtgcttttttagtgggcgcacttggctacgtccatcttactgttcgcaaaagtgtctcccacagtattctgaaacagcttgcgactgaatacagccacgatcacactgcctccaagcaaatcattcgcgctttcagtaaaagtactgctggttaccgccccatgttcctgaaaagcccggctggctggaatacaacaaatcagcgcatcctggctgaagtcaaggaagatgctaatgattacatccagatgctgaatgatcagttcaccgatccatccggccatcaggaaccgaaacagcaatcggaacatgccgaacaaccggcagcagaacagatttaaatagaatcaaccaatagctacctgtttgtagtaatacagcaggtggcatttttatttcaggatggctccggcatcgcacttcgctgggctacgccatagctctatatagtatatttatcaaaatcttagatatgtcagtgctttctgaaacttgaccagacttcccttctactggctcctacaaggctcctggaaatcggatctttccgagaagtcatcatggctaagatcaagctcaccaagtccgcagttgatgcgacgcaaccccaagcgcaagctatcgagctacgtgacgcccttgttcccagctcttcctgtgcaagactacgccggccggtcgcaaggtattcatgcttccagtatcgaacgaactctggcgagcgatgaatctctgctggagtaactgcgcggagacaccgtcgaacagcgccccttcgcccctgcttcaccgatccggctctagaaggtccatacggtggcgtggtcgggcactcttgcgatggtgttcgtcggcgaacaggtcggggcttgaaggcgctatgtggtttcatcgacaggagaggaacgggtttcaggatcgcataattttaccaagtctaccaggaggggcgagtcaagctttttcgaggcgcccattggtgatttctgggtattcgacgatttttgtctgtatgtattaccgtttgagtgcaaggagaagcacaccgcctgcaatcatcgtgattccaaaccattcctgagatgatggacgctcttccagaaaagtgaaagcaaatacagccgccaagacaagactgaatttatccacgggggcaaccttggaaacatcaccgattttaagggctcggaagtagcacacccaggaagcccctgtggccaaaccagatagaccaagaaatagccatgtcttgggtaatagctcgaaggggttggcccatttaccagtggagatcacaaacacagatagaacgacgatgatgatagctgtccggattaaggtggccaaatcagcatccacatcctgaacacctaccttaacaaagatagcggttaatgccgcaaaaatagcggataacaatgcccaataaaaccagtcgtttgaagtcatcttcaatctccctgtggatcgtcggtcaccccaaattcaatcggtatcttgatatagaacacactgatcttttcatcgcgtagccgctggaacaggcgtttattatccgcttcgctgagtgccatcgttatctcgatgggctgatcagccagttcaaagaaacatgcagcgtgtaacttgcgatcgcgcccgaaaccttcggttgctgcgatcaaagttgcgccacctactccgagtttacgcgcttcttcaatcaaccagttgctcaagggctgatgtccgtgcttgcggtcttgctgggtgaaaaatgtcaattgatagccttgcatggtgcctcccctatatcaaaggtgcttgcaaatattataggtggccaaccccaaaagcgtcatcaataatgagccaatcacatgcgctgatatcgccataccagcccacaatatgcgttcctgttgaatcagcgtggtgacctctgctgaaaatgtcgagaaagttgtcagcccacccaaaaacccggtgatgatgaataaccgccattcgggagctaaatatgcgtgctgactgaagtaggcaagtgctacccccattagataaccaccgaacatattagccagccacgttcccggtgggatcgtcgggaacagtgcgttgaaagtcataccgaggatccagcgcaggatggctcctaatgatgctcccagcgctatcgctagcagggagcgaattaagacgctggtttccatgttttatgaagcaggttcacgccagaacaaaatggagaaaataatacagcagtgcagctgtttaaatcaaaatcatcttaaaaacctctgcgcaatctggccatcacaaggccatatgcaaggaagtttcagattgacagagtttcgcaaagattccctcagccatcagatttgagaaaattctatgactaggtagcgcatgcagtttagtgctctttcagaaacccagcttggtcaacaggttgtcaacctgttcttgatcgacgtatacgtcgtcttgctttagcgaattaatgacaggcccattcattaagctgttctttttttcaattgaaatttcttttttcgtcgagtcttcttctgtcagcaattgctgtatttcctgttcgattgtttcgatcatgcgagtaattttctgaatgacctggctggtcaggtcatgaaaattctgagccaccatgatttccgtaagataggcttgtgtggagcttgtctgctcaggaatgtcgctcaggaaatcaagggtttgcttgagtgtattgtttagaacaggatgatctgcaatagtggtgactgttatttctggcatctgatgccataacttgtgcaaattagtggcatttactgccagattttccaggatgggcttggcgttttctatcgccaacagtgagcattcggcggcctgcgttgttttattgacaacataggccagcccatccttgctgctggataccccgatacttgcttgctgtaaacgctggctatgaccgagctcagacagacaattgtgcaacatctgggtaagctgttcgaggtgatcgatgacatttttattagtatccaggctgctattcatcttttggattaatatctgtttgtcgatagataggcaagaaaaagcagttcaggcgtgtacaaccatattctggagaatcttgtttaatttctcatccagtgtggcggctgtaaagggtttgacgatatacccgtttgctccagcctgggctgcggcaataatattttctttttttgcttcggcggtgaccatcagcacaggaatatctttcaatgcgttatccgcacggatattttgcagcatggttaatccatccatattgggcatattccagtccgaaacaatgaaatcgaagctaccatcacgtagttttttcagagccatggctccgtcttcagcttcttcgacgttattaaaaccgagatccttgagcaggttgcgaataatcctgcgcattgtcgagaaatcgtccactaccagaaatctgagatttttatctgtcattacgttatctccttaagtaacttggtcttatgctcaggtatttgtagttgtttgctgtaaaaaaatcgaagaattattttaccttgttggagtagataacttgactctcacagattaaacatgcacttttctgttttatttgccgagtcagaatcttgttttcaataaacggtctggcaggaaaatacttgagtaaatttttaatagcgccatcacagaatttttattcctgattagcaacgaacgtcagccattcgaatagagtgcaaaggctgcggagtagtcgaagcagcggcgatcagcaatcgttcgtgtagtgagcaaagatcaaaacgccggttgaatcagtaactgaaggcggcaagatagcgagcggcatacttgcggaagttgaaagcatggtaacaacctgacaagctggtcttgagattgccgaggatagtgttgatccaccgaaactcgggagtctcctttggtttgcgtccggcgataactgtaaaatggtgactacaggcaattttggtgacggcaccaaagcaggccgaggcatccgagaataccgtgctgccgggtaccagacaatcctttgtccaggctgaaattgcctttagcgtaaatcccgagactggggtaagcctcacgcgcaaagggtgattatcctcagccagagacacagcggcaacaatgggcaccttattctctgaacctccgcccgcttttcctcccgcacgctctccaccaagataagcatcatcggcctggattctgccatccaggacatagcgctcctcacgattagccatcgcctgcatcagtttgtggtgtatcaaccctgccgtaggatagctcactcccagctggcgtttgagcgccagggacgacaaacctgtcttggcctgactaaccggataaattgccaaaaaccagacagtcaatggtagtttagtgccctgaaaaactgtcccggcaatcaatgaggtctgatgtcggcaggctctgcattgaaaaaccttgcgtataccatcacgtatgacatagtaagcagtaccgttacagcgtggacagtgaaacccatccgaccaacgggcaacttccagcgcttgtcgcatcctgaacgattacttacaaaatcgtgggcttgaagaatgaaaatggctcatgtgagcagagcaggcacgcttcaaaaatttgggctccttagtcagtgaataggaaattgatttcgctctcatgccgtctttgtaccagatgaaactttttcgattaccgacttgatcggagctgataaataactgtgtttgatgctatttatctggcgctgtacaggcactagctccgtcttatcaaagcagatattgggatactttatttaaagtacagtccacaggcatttccggcgccacaggagtctgtctgtatcaggcacgcacaaaacccagcggataattatagaatcttcggcataagctcaccgaaaccgattcgggaaaaactcagaaaaccagccgcactgtggagccagtagataaattgattactggacgtaaacaaaactgtggaaaagattgcagacgtagataaatccgtatacagatatttataaaaccactctctcagtttcaggcataaaaacaaacgatgcccaatgaaaaaccgcccgggaggggcggttatatttgttctatcatatttttccttttttatttcgtgattgcctgctctgttttctgatcggctctttgatctgttttttgatccatttggtctggcattgaatcacgttccatcatcaggctcggcggatagttgccgggtttatccgtatcaagacacccagtcaagacagttgaagctactaacagggtggcgacagtaagtatgagtttcattttttagtctcctataagaaaaatatattgacaatataactcttctagctggtttgacttattgcctcccttctcaggagacagttatttaataacaaatattttatttattgtcaatattttttaattgtctcacttaataaaattataaaataatctttatgttataaataaatgatttttaatgcctttaatgaaaaaagacataccgtgctcaccaagctctgaaattcgggagtaaaaataacctatgtagattacgattaccggcccagccggtgctggtaaaacaactgtgcttgatgttatctgcctggcactgtacggccgcactcctcgcttcaataaagttaccaagcgcaaaaatgaaatcatgtcgcgacagacgggtgaatgttttactgaagtactctttgccacccagtccgggcacttccgctgtcatttgagccagcgccgggcgcgcaaaaaactgatctgcacttgaacaatttgaatttgaacggaaaaaacagtagaaagctatcccgctgatccgcagcttcatcgtcagtctgacacgttggatgaagaagcacttgatgccgcgctgaaaaccctcgctaacttgcagcaggaaggcatgctgattggaatcatctcatgttaccgcgttgcaggtggatcagcacccggattcaagtcactcccaatcaggcggaagaagcctgttatccaggccgggttcagacactttaaataatctaaataatcgcctctatcgccattttgataaggatccttgcagtaaagaggccgttattgtgcacgcctgaatatcaatccaagcgattgtcgcaacgaatacttcaagctaacgtagctttgcgtttattgtaaaaatagccaattaccagcaacgcaatgaccgccaattgcgacagggaagtctgccaggttggaaaaacacccagcagatcaatatgtggtaccggtgccagcgatacctcaatccaaccagccttttgcaaggcagacacccctttcccggtaagcgcaacggcgagaacagcaatcagcactgagctggctgcaaaaaatgtggagataggcaaacgacgactggttcgcaacaacccccaggcaatcagtgccagcaccagtaccgctgcgccaataccccccagcaaccagattttctgatcttcctgccacaaagtcgcataaaacaggatggtctcgaatacctcacggtagaccgatataaaggtaagagcaaacaaaaaccaggcagattttttattcagcgcattgctcattttttccttgagataagcctgccagcgatctccggtacttttctggtgcatccacaatcccactgccagcaaaatcagtgcagcaaataatgccgacaatccttcggtaagttcacgactggcaccactgatatcaatcagatagtgtgccactgcccaggttcctccccctgccaccagtgcagctatccagccagcatgaacatagcgaagagtttcacgtttaccagccttatccagaaaagccagcaaggcaacaataatcaacaacgcttccaagccttcgcgaaccagaatggtaaaagccccaaagaaagtggttgtggcattacctgcgctgctggtaagtttctgagcgcttaccagaagctcatcaagctctgccgcctgctttgcaatactgtcaataccaatatctttggaaaggccagaacggaaagtacccatacccagttctatacgagcacgcagcgcactatcagtagcactgagctgtagctccacaggctcgataccgtccagataggcagatcgtgcaagctggatggcctctttgctgttacccgcccgataagcatccacactggcagccatccgcccgcgagcaagcgcgataccggtcagtgcctgttctagtgcatcaggttgtgcacgcaaatagcctatcaaagcatgggcctgatccttacccagcacagcactgatctgatcggcacgagtacgtgacagctcatccagattgctgatgtgcgcacgtgcaccaatatcccgctgccagagagcctgccctcttttaatatcatctgtataagcaagcgtgcccgcgtaataagccagtgcccagcgatcaacctcgctcaattgctcgctatagctgatcatggaagtaccccccaccccctgagaaatggtctggaagagcgacagagggctgcgttgatcggcacgttccacatcagtaaaggcaataacaggcggatccaatccgactgcagccgggccatctccgtccccctttacaccatgacagcttgcacagtggctttgataaagcgtagcaccccgggcaagatcgggtgctgtagcaggtgaagttggaataggataagctgtcagcaaggcatccgccagttggtgagcctgcaatgcaacttcagcagcatcggccttattctctaccagggttgtcagactatcggcctgtgtcagcaaagaagctttgtcagtatgctccggaagtgcagcaatttgcgtgcgtactgctgctgaaaattctcgcatttcggcaaactcaggatcatttatgactgttcccttatccacggctccggcgtagtcggtccccagatagtcgagcatctgccaagtctgaggcaccagtgaaataacgttatctgctcggataccaaaagttaaagccagcaacaagaagaaaacgaagaaacaggctgaaggatgtcgattgattgagatcatgaagcctcacacttggtcgattgatctgtaagaaaatattgggaaagtaagcaatataacacgaacgaccgcaaatgcgtgtcattatcattacagattgtagtaatctactatgcttagaatgataaaatttggacaagactcaaaaatattgatgagactgaaacgtcaacaataacgatattttattctaaaatccaccagagagagcagtctttgataaccggatcttgcaggtaatcacccttgaaaaattcttgctgctgattgccgtttttcggaacgaatcaagttttcctgtcatttatgcacacataacgtgaaaaatagaagtttcccgactgggaaaattagtgtcgcttttctctgtttgaaaattcatcctgccatctccattttaaccagacacgcagtcgcctgaagctgcctgcatcgatgttgtccggcaagatgaccactgtgcgataccggtatgtttgttccatcttcaggcagagtacagtcatatagggggcgacaaaggtactagcgtcgatgacggtattaatggattttcctacgcaagtctctattttgcagcgatttcttccagtcagatgcagtgtcatgatggattgtggaaaggcaagccaggcgtagcgccgcaggtagtaatagagactacctgccaacagcaaggtgatcataatcttcaccaccacgggcaatgccaatggccagaacacaccagctgccgtacaatgcgcaaggctcagcaacactgccaactgtctggaaggttgcagctgaattgacagcgcactctccgattgattattgatatcacccaacgtaattttcctttctttccatgaaccctgactggtttacatttttgacaagccgcaatgcccatatcgaacaaaatcgagtgttgcattttggtcaacccgacgttgaattggcacaagtagaatcagcactagtgctgattgatctctcccaccttggtctgatccacttttctggcgaagagacacaaaaatttttgcaggggcagttgagctgtgatgttcacaccaccgattccggcaaagccacttatggcggctactgtacgcctaaaggtcgtctgttgagcagctttttgctatggcagaacatttccgactacagctacctgatgcagctcccggcagaactgacggaaaccattgccaaacgactgaaaatgtttgtactgcgagcgaaggtgatcattcaggatcataccgaggattgtattcgtattggtgttgccggcaagaatgctcacacattgctgcaaaatacgttggcaggaacggttctccccaccaagcccttggctataacagccattccagacgggcaggtaatttgtcacagtgaaaaccggtttgaaattctgatttccccagcccacgcactttcattatgggagcgactaagcagtcaggcacgttgcgcgggtgccgccgcctgggactggctggaaattcaggaaggagtcccggcaattttcaaagccacccaggagcagttcatcccgcaaatgatcaacctggatgcaattggcggggtcaatttcaaaaaagggtgttatcccggtcaggaaatcgttgcccgtacgcaatatcttggcaaggtgaagcgccgcatgtaccgggctcatctggattcagattcacccctggagattgcggcaggtgacaacctgttcagtgcagatactggtggtcaggcatgtggaatgatcgttaatgctgcccctgctcctgctaaaggcgttgatgtattggcagtgattcaggttagcagcataaaagctaatcccattcactgcaaaacaccggatggtccgcagttgactatccagtcgcttccttatttaatgcctgatcagcactcccattaagcagaagacaacagcaatttaatcagtcttgccgttgtttatgcgtcagtaactgcacgatatcagtatgtccgcgtttctgggcccaagccaatgccgtaccatcggcttcgtttctgactgaaacatctgcgccatgtttcagtagcaggtcaacggtatcgtaatgattaccacgtgcggccatcatcagagctgttgtgccgttatccgtggtggcgttaattcttgcgccataatctagcaaaaattcgacgatctgcttatagcctttactggctgcataaatcagcgggttccagccatcatgatcaattttggcaccctttgcataaagtcgcttgatcagatccagctgtccgtaatagctcgccagcatagtggctgtttcaccatatttgttttgcagattaggattcgcgcctgcctccagcagcaacctgcccatctccgaatttttgttgcgggcagccagcatcagcgctgtttcaccatgcagatcgcgtacatccgggctcgcaccttcctccagcaagtttttaatgcgatgggttttattgttctctaccgccgagatcaaatcctcatctacaccggcgtaagcaggcaagtataggcagaaggcacacaacagggtgatgactgatgcgatactccattgattccacaaagatttgttcatttcaggccaccttgaacaagttgaagaagttattggttgttaccgcagcaatttcagcaacatccgtttcacgcaaccgggcgatttcctcggcaacatgccggacaaatgcgggttgattagtttcgcctcgatgagggacgggcgcaaggtaaggagaatccgtctcgatcagcatcctgccagctggcactttctttgccacctctttaatgattgccgcattcttgaatgtcacaatcccggagaacgagatgtaaaaatttaaatcgagcgcacgctgggcgatttcccaggattcagtaaagcaatgcatcacaccaccgacttgatctgccccctcttctttcataatacgtaatgtatcttcagccgctgcgcgagtatggatgatcaacggtttatcgcattgcctggcagcacgaatatgtcgccggaacctttcgcgctgccattcaagatcacctttcagccgaaaataatccagtccggtttctcccagcgcaaccaccttgtcgtgatttgccagctccagcaactgttcaacttcaggttctgccgtgtcttcgtagtcgggatgcacccccaccgaggcaaacagattcggatgtgattcagccagtgcgcgcacgcgcggaaaattttccagattaactgcaacgcataaagcatgtgtgacctgactgatttgcatattcgtcagcaactcattcaggttactggccagatcaggaaaatcaaggtgacaatgagaatcaacaaacataagatttacgcatcagttcgatttttatatttaagtaaccagattggaaaagcctaaataacttccgctcaggatccaggagcctctcccaccaaatcaaatttgaaatccactttgttcacatcagcccaacagttaggagtttcaaacaaacggatatgttccagctccaatctgcccgcatatttgttccgtaatgtgcgatgcaagctgtcaaaagcgattaaggcaagattttctgcggtgggctgtacttccagcacaaccgttttgtgaccatctattgattgcagaaattccagcacgcgggtatcaccggcatataccagaaaggcatgatcccactgatccaccagggtttcccgaataatgcgtttgacatctgaaaaatccataaccatgccttgctctggcgctccggcatcagtgataataccccccgaaatcgtaacttccagcacatagcggtgtccgtgcagattgcggcattggctccggtgggtggagatgcggtgtcccgcatcaaactcgaattttcgtgtaatcaacatcccgggaattataacattgccacctactgctggacgattaagccaagataatcacagccgtgacagcgccggtttgacctatgtctacccggtcatttctcgtcgtgctggcggaatatccatcggtatcaatctcaaccctaacaatgcttgcaactggcgctgcatttactgccaggtacccgatctcaagcgtggcgtagcccctgccattgatttgatcaagctggagcaggaattgcgtgcttttctgtatgaactgttatttggaaactttatgctggagagcgttccgctggaagccagagtaatcaaagatatcgctttatctggcaatggcgagccgaccagtgcgcgggaatttgaacagatcattgagatcattggcaggacaaaagctgatttccccctgccggaaaaacttaagctggtactcatcactaacggcagtttgattaaccgggttgcagtacaaaagggcctgcgccggatggcagagctcaatggcgaagtctggttcaagctggacagtgttacgcaagccgggcacttgcacatcaataacacccgagcaagtttacagcgtatgcgcgacaatctgcgaactgcagcctcgctctgcccgatctggctccaaacctgtgtattcaaactgaatggcgcacatcctaacaaagcagaaaccgatgcttatatctgctttgttcgtacgttgttattggaaggaacccgaatccagggggtattgctttataccctggcgcgccctgccttgcagccggaagcgacaatcctctcaaaagcagatccggattggatagaagccttcgctgacaaaatcagggcgcttggtatacaggtaaaaacaactgcttgagaacagaaacagttcgaagaaaaccaaacttactttagttgtttagctgattttttaaggtttttatatagatcagggtgttgggtcttcagcattgctgcgataaggaggtcatctctttttattctggtcagatcaacatgttcaatgtggaccagcctcaataactccctcactgctttcggcatttcccggccactttcataacgcgaaccaccactctgggtcacgcctaccttgctccagaattcctgctgattcaatcccaatttctgacgtatttctttcgggttgggtatgctcttaaaaagtttcattttattttctttctggatatcaaaaatataagtagtgatttagtgcaatatcatatttttgttatcgtcataaaaaggtctgacttaagctcatccatgcattcattaagaatatttttacccgtcttttttatccttttaagcatggtttcggacaaaatacttattccacaaggataaaatcatcagtctaaaattaatcttgtggtgtaagacagcttgaaggaataccgttacatcacgattcttgctcacatccaaatatgggagtggaatattacggtagaagttcgctggagctgtatgtgttacacaattattcctgaaaaatcagaaaacgatttcccagaaaaataaattgggcttctttattaccaataacatggcatgaaagccctgatcgagcggaattttatcgatgctcatgttcaagctgtccgggcggatcaatctgtacagtaacatgatcaatggcataacgttcccgcaaccaggacgataccaaaggaggtagagaaagtggatcaacaccacgagcaggactgacatgaacagttgcaatagtggtctcatccgccagaatccaggcatggaaatgcccagcttcttcaatttccggtagttgtgtcaggccgttctctaccactcgtgtatccatgccacgaggaacaacctgcagcagcacatgtaccgaatccttgaccagcacccaggcagaacggatgatcagcaaggcaacaagcaccgacagaatcgggtcaagaatcgtccagccagtaaacatgatgccaacagccgctgcaaccgcacccactgacccgagcaaatcgccgattatgtgcagtagggcgccgtgcagattgccatcttccttgttacctgaccacaaaacccatgccccgaccagatttataaccaggccaatcacagccacgatcaacatgggtccagccagaatctccgtcggtgtgtgcatccgcccgatcgcttccaggatgatccaggctaccagaagcaacaaagtcacgccattggccaaagctgccagtacacgcacgcggtgaaaaccataagttctcgtactatcagccggtttcctggcaatgcgataagccaccagcgccaataacagtgcagccgcatccgagatcatgtgacctgaatcagcgatcagcgccagcgatccggacagccacccaccgattacctgtatcagcgcataaccagcagtaaaaaagaagacaaaccgaatgcggcgctcgttaccggctgtgatgacctgcttatggttatgatcatggttgcggtcccggtcatcatgaccattcttgccatgctcggggtgcgggtgaggttgtgaaacagtcacaggttattttttcaaccgaaaatcttatgaagcaatcagcgaaggcggctggaaccggcgcaaacgcagcgcgttgcccaacacaaacacacttgacattgccatggcgcctgccgcaaagatcggggacaacaataaacccagagcgggatacagcgcaccagccgccaggggaatcagagcagtgttataggcaaatgcccagaacagattctggcggatattggtaatggttgctttcgacagcgcaattgcattgggtacagcttgcagattaccggacatcagcaccacatcagccgattccatcgcgatatcggtacctgtaccgatcgccagaccaacatcagcctcggccagcgccggcgcatcattaatcccgtcaccgatgaacgctactcgcccgtaggtggctttcagacgacgcaccacctcaacctttccttcgggcagcacctcggccaccacgtcatcaatacccagttgtctggcaattgcctgcgcagtgcgtgcattgtcaccggtgatcatcgctaccttgaggcctaattgatgcagtgccgaaatcgctgcaggtgtgctggatttgattggatctgcaaccgccacaatgctggccagttgatcatcgacagcggcataaagcggtgtcttgccttcatttcccagacgttcagctgttttggcaaaacccgtcacatctattcccagttcgcacatataacgatcagaaccaacttttatactgataccctccaccgtggcgcacacgcctctgccagtgactgattcaaattcagtcactgccggtagcgtgatgctctcctgtaccgctgcttcgacgatggcgcgagcaatcggatgttccgagcgcgactccaccgccgcaacctgtgccaatacctgattgcgatcaaaaccgggcgcaacttccagatcagtcaatgcaggccggccttcggtcagtgtaccagtcttgtccaccgccacgacccgggcatccttgagcaattgcagcgcttcacccttacgaaacagaatgcccatctcggcaccgcgaccaatgccaaccatgatggaagtcggcgtggccagacccatcgcacaagggcaggcaataataagtactgctactgcattgaccagtgcaaacgtcagtgccggtgcaggaccaaaaatcagccagatcaggaaggtaattaccgcagccagcataacggctggtacaaaccacagtgtcaccttgtccaccattgcctgaatgggcagcttggagccttgcgcctgctcaaccaggtggatgatctgcgccagcatggtttgtccgcccacggcagttgcacgtaatataaaagcgccccgttgattgacggtcccgcctaccacttcgctaccaaccattttttcgacaggaacaggttcgccggtaatcattgattcatccacaaaactgcggccttccaccacttcgccatctaccggtatgcgttcgccgggacggacttcaacactatcgtccagagtaacttcaccgatcgggatatcaacaatattgccatcgcgcaatacatgcgccacctttacctgcaaaccaaccaggcgcctgatcgcttcagaagtacgtcccttggcgcgtgcttcaagaaaacgacccagcaaaatcaatgtaacgatgacgactgctgcttcgtaataaacgtttacagtgccaacgggtaaaagatcaggagcaaaggtagcaatcacggaataaccgaatgcagcaaccgtccccactgctaccagtgaattcatatccggtgcaagccgcagcagtgctggaaaacctttttcatagaaacggcgtccagggaagatcatcaccagcacggtcaatgcaaactgcagataccaactctgctgtataccaatagtagccatcacccaatcatgcacagcgggaatcaggtgtgatcccatctcaattacaaatacaggcaatgttaatgcactagccaagatcaaattccgcttgagtagcgcgcgttctacgtccttcttttctgtcgcttcatcgctggcctgtgccgtggtatccatggctttggcggtaaaacccgtgttcacaatggcattgattagcgtgtcagcatcggccaccccatgcactgtggcatgttccgtcgccagattcacggttgcttcctgcactccgggcacagctttgagcgcccgttcgatacgccccacacatgaagcgcatgtcataccttccactaccagttcaatggtagttgcaggaacatcaaatcctactttttcaactgcttgaatcaatgccatgcgatcaaccgaattcgcaagatggatatctgcgcgctcggtagccagattaaccgatacatcactcaccccctcaaccttggccagtgccgcctccactcggccaacacaacttgcacacgtcatgccctcgataggcagactgatcattgtggcgccaacttgagctggattatcatttgatgcgcccatattttgcttctccaaattaattttcgatatacagactggctcttttgccattcttatatgcagacaaaccttaatctgaataaattcctgcttttacaagcacaatctgctgtcaaatcagaatgatacccgccagcggcggtaaggtaatgatgatggaatcaacttgacctgaccactgctgcccggtcggaacaatatccccaggattaccggtattgctgccaccatagtaagttgagtcgctgttgaatacttcttggtatgttcgggattccggtacgcctactcggtagccggtacgtggcactggtgtgaaattcaggatcaccagcatgaatgatccatctctggcacggcgctggtaactgataactgattgttccgaatcatgacaatcaatccaggaaaatccttcagtaaaaaaatccagctcatgcaacgctggtgtatccaggtagaggtgattcagattccgcaataacatttgtataccacgatgcggatcacgctccagcagataccagtcaagttcatgattaacccgccattcacgtccttgagcaaattcattgcccataaagttgatttttttgcctgggcaggtcatctggtaggtaaacagcaaacgcaggttggcaaacatttgccagacatctcccggcatcttgtccagcagggattttttgccatgtaccacttcatcatgcgaaagcggcaaaatgaagttttcggtataggcgtaaagctgattgaacgttagttcattgtgatggtaatgccggtgaattggatccagctgcatgtaattcagcgtatcgttcatccatcccatgttccatttcatggaaaaacctagcccgcccagataggtcggacgagatactgctggccaggaggtggattcctcggcaaaagtaagtgcaccggaaaattcaccatgcaccatcgtgttcaattcacgcaagaaatcaattgcatcaagattttcacgcccgccaaaacgattgggcagccattctccttctttacgcgaataatccagatagagcatcgaggccaccgcatccacacgtagcccgtcaatgtggaaaacggacagccagtaatgggcgctggaaagcagaaaggatttcacctcactgcgcccgtaattgaaaatatacgtcccccaatcctggtgatagcccaggcgcggatcttcatgttcatagagcgctgtgccgtcaaaccgtgccaatgagaaactgtcttgtggaaaatgtgccggcacccagtcgagaatgacaccaattccagcctgatgacatttatccacaaaatacatgaatgcttctggattaccatagcggctggttgctgcaaaatagcctgttacctgatatccccaggattcatccagcgggtgctcggaaattggcaacagctcaacatgggaataacccatctcttgtagataaggaatcaggtgatcggctaattcctgatatgaatagaaactgccatccggatggcgtttccacgaacctacatgcagctcataaatattgactggcgcatgtagccagtcccatcctgcgcgttgcaccatccagtcgttatcctgccattcataccggctttcaactggcgtcaatgcggcattattgggacgcaattcataccgggttgcataaggatcagtcttgagcaggatttctccagttgaatgatttctgatctcatatttatataacgtacctccgggcagatccggaataaacaattcccataccccgctgtgatcacgcgccatcatagggcacaccctgccatcccagtgattgaaatccccaatgacacttacccgttcggcattgggtgcccatacggcaaaacgtgtgcccgtaacaccttgatttttgacctgatgggtacccagcatgtggtatgcctggagcaggtgcccttcattgaacagatacagatcatgtcctgaaatctgtactggaaaagcataaggatcatagcgctcctcaattaccccggtttctgcatgttccagacgcagtaaataaggacgcgtaacagcctcccctttccactcgaaaatacccgcatcgtgcgtgcactccatcacctggaaaccggatggagtctgcagccatacccgtgacatatacggttgaaacactcgaaccagctcaccgcctggaacagaatgtatccccagataagagccgggggcatgcagccttgcggccaataacaatgattgcgcagaatcacctgctaaatctcgggatggggatgggaaaggcaaagatttcatcggtatgggctcgctattacctgcagtgtcggctggtaatggttattcggatcaagtaagataaacatggaaacacagggtatgcggtttttttaaacactgcaaatcagtgaggtaaccatgaacgttcaaacaggctgtccagatgaataacaacccgcgctttgtcagcacacttactcgcaacacactggcgctgatcctggcaggcggacgcgggacgcgccttaagaacctgacagactggcgcgctaaaccggcggttcccttcggtggcaaattccgcattatcgatttcacgctgtccaattgcgtcaactcgggtgtacgtcgtatcggcgtcgtcacacaatataaggcgcaaagtttgatccgccatattcaacgtggctggagttttttggatggccggttccatgaatttatcgagctgttacctgcgcaacaacgtaccgaagagggaacttggtaccaaggtaccgctgatgctgtttttcagaatctcgacattatccgcacgcataaccccagctatgtactggtcctaggtggtgatcacatctacaaaatggattatgggcaaatactagctgaacacgtcgaaaaacaggccgatttgacaatcgcctgcctggaaattccgatcgaagatgccagcgcattcggcgtcatggcggttgataacgactcgcgtatcaccaactttaccgagaaacccgctcaccctgccccgatcccaggcaaacccggacacgccctgatcagtatgggtatttatgtttttaacgcgaaatttctgtatgaacaactgatcctggatcacgacatgaatcaatcatcacacgatttcggtaaagacatgataccccgcctggtagcgagcaatattcaggtttatgcacatcgctttcagaatagctgcgtcaatatggcttcaggtgtaccttattggcgtgatgtcggtacagtagatgcatactgggaggcaaatattgatctcaccactatcacgccggatttgaatctgtacgatgaagactggccgatatggacatatcaggaacaactgcctcctgccaaatttgtgtttgatgacaatgatcgccgtggccaggcactggattcaatggtatcaggcggatgtattatcagtggggcaacagtgcgccgttctctgttgttttctaatgttcaagtacgctgcttcagtaccattgaagactcggtcattctgcctgacgtcagtatcggccgatatgttcatctcagacaagtggtggtggaaaaggaatgccagatcccggaaggccttgaaattggttttgatcctgttgcagataaaaaacatttttatgtcacggacaatgggattactttgattacaccggaaatgttgagacagcaaattcactatactcgctaaaatctccaatccagctttccggccgattgatctctatcaactttctttacacgatttgatatgccatgaccagccatttttctaaactcgatcttgtgttgctctggcacatgcaccagccagactaccgggattataaaaccggtgaattcatgttgccgtgggtatatttgcatactatcaaggactataccgatatggcgcaccaccttgaaaatcacccgggtatccggctggtggtgaactttgttcctgtcctgctggatcagctggaagattacgctgatcaatttgctggcggcacgattcgtgatccattactgcgcttgctctccgcgccggatcttgatcatatttctcccaatgagcgcttgctgattctgaacagctgcttcctgaataatcacgaaaccatgctcaaaccttatccggcttatcagcatctacgtgatctgtatgatcatctgcaaaagacgaatgacaaggaactgatgtatgtctccggccaatacctggccgacctgctggtgtggtaccacctcgcctggatgggcgaaagcgtgcgccgggaaaatgaatgcattgtacacctcatgtctcaggaaaaactgttcagccatggtgatcgtatcctgctgtttaaccttattggcgaactcatccaaggtattattccgcgttatcgtaaactggcagaatccggccagatcgagctttccaccacaccgcactatcacccgctagctcccttgctgattgatttcacttctgcccgggacagccttcccgaaactcaactgccagccaacccgatctaccctggtgggcgcaaccgggtagcgtttcatctgcaatcagctattgacagccaccggcagcgttttggcagcgaaccttccggtgtatggccagccgagggcgcagtatcagaaccgctactggatatcctggccggacacggtcgtcagtggtgtgccagcggtgaaagcgtgttggccaacagcctgcacaaatcttatcctgaccagcccttgcctgcccgtagcgaatatctttatcgcccttatcggtttgaatcaggtaataacagtattctgtgtttctaccgggatgatcagctatccgatctgatcggatttgaatattcaagatggtttgggcgtgatgctgcagaaaatcttgtccagcggcttgaacatatccgtcacgaaacaaacggcaaccccgctccagtcgtcagtattattcttgatggagaaaatgcctgggaaacttatccctacaacggttactatttcctggatgatttgtatgaaatacttgaaaaaaatgctgacatccgtacaacaaccttccatgaatacatcgccgggttatccgaaaacaacattgaaattacccgattgccgtcgctgacggccggcagttgggtatatggcagtttctccacctggattggagatcatgacaaaaatctggcatgggatttattgtgtgccgccaaacaaagttacgatcttgtcatgcaaggatcacgcttgacggatgaagaaaaattggctgccggacagcagcttgcttcctgtgagagttccgactggttctggtggtttggcgattacaactcgccacactcagtagaaagctttgatatggctttccgaaaaaatcttgccaacctttaccgcctgctgaacatacccgttccggtgaccattctcgaacccattagttatggcagtgcatccacaggcaaaggtggcgcgatgcggcatgcctcttagaggactcacaaaaaatgtaatactggcaatatgaaacaaccgataaatatttaaggatatcccagatgacctcatccgtatcattgctgtttggtgtccacgcccaccaaccgattggcaatttccccgaggtcgttattgatgcgcatgaacgctgttacaagcccttcctgcaaactttataccgctatccggaatttcgttttgccatccacttttccggctggttgctggattttctatttgagcactacccgaaagatatggcgttattacgtgagatggtcacacgcgggcagatcgaaatatttggtgcaggcgataccgagccggtactggcggccattcccgagcgggatcgcatcggccagctcaagaccttttcagctaaactcaagaaaaagctggggcagtcgccacaaggcgcctggctaactgagcgtgtatgggaatccactatcgtgcctgctttggttaattgcggtatccattatgtaatagtggacgattaccacttcatttgtaccggaaaaaataaaatagaacttgatggttacttcagtactgaagaagatcatcacaagcttgatctttttcccatctccgaagcattgcgttaccggctccccttttctcctgcgttggaagccattgcctatattgaatccctgattgatcagtccacaaccgagcatcaacctgcagcagtctattttgacgacattgagaaattcggcatctggccagaaacttatcagtgggtttacgaacacggctggctggagaaatttatccagggtgtactggcttctcctcatatccagctgcagcactaccgggattaccatgccagcgaaaaaacccgtggcattgtttacctccccaccacctcctacatcgagatgaatgaatggacgctgcccgctgaacctgctcatatttatgatgatctggtgcagcaagctaaatccacaggtcagtacgaacaaaccagatctttcctgcgcggaggaatgtggaaaaactttttttcacgctaccctgaatccaactggatgcacaagcgcatgctcggcctgtccgcacgttacgccagcctgccggccaggcagcggacctctaccatgcaacgatgcctgtacgcttcccaggccaatgatgcctactggcatggtctatttggcggtctgtacctgccgcatttgcggcgcaccgtctacaacaatctgattgaactggaagcgcaactcgatcagtgtgaatcgcgcaatatctactatcatgaggatactgatctggatggcacggaggaaatctatctgcaaaacgggactgtgcaggcagttttgaaactcaacagcagcgccagcatctgcgaactggacagctatccactgaaacacaactttgccgataccctcgcccgccagactgagcattactaccgaaagatccaaccgggtctacagggagcttcatctcatcagcaatcaggaatagcttcagcacatgatcgagtcaatttcaaacatgctattagccaggcagatatggaaccggatctgtatgcacaacacctgtttattgatcgtttaaacggtgagctgctggattatcaactgcacccctcagataaggcagatgaagttatttttcaggcgataacagatttcgggtcaatcagtaaatgctttcggattatcagcaaccagctacttgtcatctatgtatgcagcggggaagccagtggatacatgcagacagaaatcaatctggccatgcccagttgcgacggaccgggcggacgttacatccggaatcacactgtgctgtccggcttcggacaacccatcgaactggataatctgacagccattacactggaagacgacacgctgggcggcagtctgtcacttgatatttcacctgtaacaaaattttatgcctgcccgcacttcaccgtttctcaatcggaaggcggatttgaaaaaatcatgcaggcagtcaaactaatacttacctggaagataacggatgaccagcagcaacatattacccttcgttttgatgaaatgaacactactgtttgatccggcccagataaagaataatggagctaccatgatagaagaatccggtcgtctcaaactatgtgatgaagagcagattccctggaaaaaatggggcccgtatctaagtgagcggcaatggggcacggtgcgcgaggattacagcgataacggcgatgcctggaattactttccgcattaccagtctggcgctcgcgcttaccgctggggagaagatggcctggccggtattagcgatgaccggcagttgctttgttttgcattggtgctgtggaacggacgcgatccgatacttaaagaacgcctgtttggtctgaccaatccacaaggcaaccatggcgaagacgtcaaggaatattatttctacctggacgccacgcccacccacagttatctgagatatctctacaaatatccgcaaacagcctatccctatgaagatctggtcaccactaacgggcgacgctcccggcaggaatcggaatatgaactgctggacaccggtatctttgatgagaatcggtattttgatatttttgtggaatacgctcaagctgcgccggaagatatcctgatccgcatcagcgttatcaatcgtggccctgaaacagcagacttacgactactgccgacactttggttccgcaatacctggtcatgggaacccggttcagctaaaccgcagctatcccaggagggtaatcagaacgaatgccggatcattcgtgccaagcataacgaactgggagattatcaactgtattgtgcagataaaccaaccctgctcttttgcgaaaacgaaaccaacgcctggcggctgtttcgcaacaacaataaaggcctctacaccaaggatggaattaacgactatatcattcatgacagaacagacgccattaaccctgccaatagcggtaccaaagcagcggcagactatgctctgagtatcccttccggagaaactcacataatcaggttgcggctgtgcaaggctgattctgtcaaggcagatatattttttaccggtttcgacgaactcatcgaccagagaaagcaggaagccgatcatttctatgaatcactgtccggtgaccggttgaataaggaacagcaacgtatcctgcggcaggcattggctggcatgatatggaccaagcaatattatgagtttgatgtagcacgctggctgaatgagcacccccggcacagcacacgcaatgctgactggcagcacatgcaatgccaggacatcatttccatgccagataaatgggaatatccgtggtttgccgcatgggattcagcttttcatgttctacccctggccatgatagatcccacctttgccaaacagcagctcaacctatttctggaaaaccgctaccagcacccaaatggacagattccagcttatgaatggaacttcaatgctgtcaacccgcccgttcacgcctggtccgtctatgtggtttatcaaatctgccaggattaccatagccagaacgatctgacattcctgaaatccgcctttgccagcctggaacacaatttctcctggtgggaatcccaccgcgagccggataaaaacgtgtatgaaggcgggtttctagggctggataatatcggggtatttgatcgcagtgccgcactgccaaccggcggccatctggagcaatcggatgccaccgcctggatgacattgttctcgcaaagtatgttgcagatcgcattggagctcagcctgcacgatccggattacgagcaaagagtgctctcctacctgaataaattcatggccactgccgctgccatgcaggatatcagcgatgaacaccgcgacatgtgggatgaagaggatggctttttctataatgtcctgcgttttccggacggccactccactcgcatcaaggtacgttcactggtcgggctgctaccgttatgtgccgtgattgtagtagaggaatccacgctaaacaagctaccgcaggttgcaaaatattttgaaaacctggtcaaacgcaggaatcatctaaccgcccatatcttttgtccaattaaacctggcgtggaaaatcgccgtctgctggcaattatggatgaaaagaaattgcggcaaatattgacaaaaatgctcgatgaacaggagttcctgagccctcacggtattcgatcattatcgaaatatcaccaggaacatccctacgaattttactggaacgggcagactttctctgcaaattaccagccaggtgaatccgattcagccgtgttcggagggaattccaactggcgcggtcctgtctgggcaccgatcaacatcctgattattcacgcattgctggcgctgtatgcctactatggagaaaatttccggatcgaatgccccaccggatctggtaggcagtgcaacctgttccaggttgcaagaatgattgccgtaaggctactccatatctttctgccggatgaatatggccgacggccggtgtttggcggcactgaaaaattccagaccgatccccactggcgggattgcctgctgttttatgaatacttccacggtgaagatggctccgggctgggtgccagccaccaaaccggctggacaggcgtaatggccgccctgctgagtatcttcggctctctggaagaagaggaactagcagaactgggcatgcaggaaataccggccatccttgcaggaaataacaatgtataaacccatcccctgacaaacctctggctaccactatccagggtaaaaatacgagagatagccaccacacctaaaagaaatcaaccaatttgcatcaaacatcttgtctgccagacagccttcagaattcacactacccatccaatattcatgggtggattaagctcagataatctattaaagattggatccaatgcaaatcaatcttaccctggtgaatgacattacttgtcacgcaaagcctgcatggttctgcgggcaaagcacaagtcttcccatgccttggccttgtccgtcagcgaacgcaacagataggccggatggtaggtcgcaatcaggggaatgcctgcaaattcatgcaatctaccacgcaggctggcaatgctgtcgcctgtcaccagcagattctgggcagccaccttacccaaggttatgatcaacctaggctgaatcaatgcaatctggcgcagtagatagggacggcactgctgtgcttccatttccagcgggttgcgattatccggtgggcggcatttaacgatattggcaatgtaaacaccctgttcgcgcccgagatcaatcgcctgcagcatactgtcgagcagcttcccggcctggccgacaaacggttcacccagcaggtcttcccgggcccccgggccttctccaataaacagccagtctgcctgttcatcacccacaccaaataccgtttgcttacgcgtctggcaaagtggacaagcggtacagctgctaaccatctgccgcagctgctcccagcttgcacgcgcaattaaagccgatcggtcatcaactatagaagattccacagcggtttctgtgtgcgcagccggattctcttttgaatcagacgattgaacagatggctgtccgagaatagcattcgacctgacacgccacacgggtaataagcctaattctttgagacgattgggatccatggttgaatctttcctgatcaaacaggatgagaaatcagggtatccggggttctcggcatcatagctcccgcctcatgatcagcgcatcctcgcgtccgcacatcgccggatagtaatccttgcgcacggcaatttgctggaatcccagtcgccgatacaaatttgccgcaccggtattggactcacgcacatccagtaatataaattctgctctgtgtttcctggaaagttcaatcagatagcgcaacatctctccacccagaccctgattttgccaggcgtaacccacacccagtgtcagcacatgcgcttcacctggcccgatcatgagaatactgtaacccatcaccaaatcagtatccggctcggcaccctgctgttgcaccatcacctggcaatgatgacccgccttgattgaatcactaaaattgccgattgaccatggaaaaagaaaaattccgtgctcaatacaaataacctgttcgaggtcactcaaacgcatttcacgaattttgatctgaaaagggcgtgccctgatctgtgccatcgttaccgttcgctttccttcagtgccaccttgttgcggatatacactggcagcgccttttctgccgccctaccctcaccattagcaaatttaatcgctgccagttgcacaatttcacgcgcatgcggataacaatcgagaataatctgctgcaaattttcgctgtaaacgtttgacaaaacagattgatacagatcaaaaccactaccacatcccgtccatccgtctccgattacccctggagctgtttccggccgacatagtagcggagcatgaacaggaaaccagccgatttctcttttttcataagctgcaaaataaagttcacccatacgcgcatccagcgccgccagcacctgagacgcatctacctgttgtgccagggcttccagtgtactcaccccaaccaccggaatatcccgtgcaaaagccaatccctgggcaatgccgcaggcaatgcgcaacccggtaaaggaacccgggccagctccgaaagcgatgccctcaatctgactcaaggcaacaccggcttcagtcagcatggtttgcagcattggcaataacaattcggaatggcgctggcccgccaactcttccctgctaataatgtttccattcagccacagagccagggaacagtattcggtagaagtatcaaacgcaatgatgttcatcggaatcctgtggttcacagtgcccagtctgcaagagattgatagactgattcgtatggtgtctgccgggattgtgccaacgaccattgagtcactggccaatcaatcgcttggattgaatcaggcaagctgcagtgccttacatttcttaccagcgtgacgtgtggtgtaaatggatatgtgtcgtcataccggattctcaaggcagaaagcaagtgctgcagatcctgcacaagagtagttaattctgctggacattggcttgtcccggccaccacgactccggcttttttccagaagcaaaccttatccagagtcaaattgaatggagattgccggatagccggggctgcctgacacaatcgtggaatattaccttgatcgatttcgcccatgaatgccaatgtcagatgtagatttttcggttgaatgcaacgacctgaacaatcatccgccagctgccgcgccagtttggccaattgatctcttgcgatatcctgtggccacaatgcaaggaacagcctgacaggatgagcagcgccggacattatggctgtgcttcgccttcgtcactgttagcgatcaggcagaccacttccgctacgataccttcaccacgcccgacagcaccgagtttctcggcagtttttgccttgatattaatatttccagcaggcatggcgagatcctgtgcaatgttggctatcattccggaaatatggggggccattttaggtgcttgggcaatgatcgtcgcatcgatattcacaacacgataacccgtttcagccagcaaccggtgaactttacacaccagcttgcgactatcaatatctttataacgtgcatcggtatcggaaaaatgcttgccaatatcccccaaggcggcagcacccagcagcgcatcacacaaggcatgcagcagcacatccgcatccgagtggcccagcaggcccttctcatacggaatagtcacgccaccaatgacaagctcacgcccggcagctaactggtgaatatcaaacccttgtccgattctgatttttttcatgataactgggtaatatgttctgaagtgagcaagctactcaagttctgaggaaacagcagaaatcatctgattgccccacctgcacactcctgtacggatagaatctgcgattatcgcatggccaagcaagccctggtaacaccggcatcacccaggacaagcgtttcttcgctacacagcaggttggcaccaaagtgccatgagttgcctttcttgcttgagtgcatttcaggcttgcgtttaccctcagtattcctggtagaaggtggtgcggcaatcaggctggcatcgacgatcataccttgtttgagaaacagattttaggctgctagttggcgattgacagtggcaaaaccttgttgagccaggttatgttggtccagcaggtgacgaaaacgcagtatagcgctttcgtcaagcatgcgattcagttcaaaatggcagatctggcgcaatctcatcaagggtatcttccatgcccggatcagagcagctgtaggcaatatgcacgcgcaacatatttttcagtggtagtggttgctcgccatggcatccatttgtcgggtagtacggtttgatcaggacaataaactctgatcaaggaggcaaacgctcaatctgagtaaaaaaatcactctttatgaaaggattcgtgcagagactccttaaatccaaattgattgttgttttcttgatttttagctgctctgaacagaacaggattattcggagcagcttgaaaaacatttgattattctgggtttatttgacacggctgcgatattcgcgtgtgcgagtatcaatttcgatcttgtcaccgatttcacaaaacaacggtaccggcaactcgaagccagtaacaattttggctgatttcattaccttgcctgatgtatcgcctttgactgcaggttcagtgtaaataatttcgcgcacgacagaattcggcatttcaactgaaataggtttgtcattataaaacacaacttcgcacggcatgccatcttccagaaaactgagtacatcactcatggtttcttcttcaacttcatattgattgaactcggcatccataaatacatacatggggctagcataatacgagtagctcacctcttttttctccagcacgactatatcgaatttatcatctgccttatacactgcctcgccaggtgattctgtcagcagattcttgtatttcatttttacaaccgaggaattacgcccggatttggtgaattcggtcttcagcacaaccatagggtctttgccgagcataaacacattacctacacgaagttcttgagctgttttcatctattctaatcaatataagtcaaggaaaaaaaaggatattatactttgacttccccaatgtaatgaagaaataactactggtttctgcaaaaattcaccagattggaagccaaatcaggagcctgagcaagctgttcagcccatgctatggcatgttgttgcaacgccttgtggtatcgccagaaattatcccagtccagctgtttattattattccagccttgatgcagtgctcgcagcacatcagttgcttcttggaccaatccctggcaataaagattcagaaaggcctcaagtttgggaagatgcgcatcttcctgctgtggataaatttgccagattactggccgcgctgcccactgcgcacgcacgaaggaatcttcgccccgcacaaaattacaatcgcacacccacaataaacggtcataattttcttgtggcacaaagggaagcacctgcaacaccaaattaccgcgctgcacgctatcccctgccaccaggcgtgattgtcctgcccatgcagctgcttgtcgcgaggccacaccttccggcaacaaacatcgcacgggtgaagttgaaatgacccatgcttccaacaaatgatcaactggcgcatggtcatagcaaaacagggaaacgatagtttcgtcagaagcaggaacaggaatactcagttcgtgccacagttttgccggatcagattgcagggaatcgcgttgtgcgaacaaccccgcctcctgtatcactcccccagttaccgcagtaaaaccaggaaaaaagaaatatttggttaatggcaggcgtggatgcggtgaagctagcctatgatagccttccacccatgattcagtagataaatactccagattgatccacatgcacccttccttctctttcatatccacagaatctgccgcctggaatgaagccacagccattgccattacataattggctggtaattcacagccgaacgcctcaatcaccacatctgccggcacaagatttggaaacggctcaatccaatgtagaatttgtatgttccgaatatactgagctgtcagattgctatcaatttccggacaaattcgctgtaatgaccctaaatcatccaccagcaaacgcaccgtcatgccaaattctgtagccagctgacgtgccaggcgccagcaaacaccaacatcgccataattatcaacgacatgacagaaaatatcccagcgcatcatttttttctttaatcagataagccgcagcattaccctatttgacattccgggtatttcccgatacgttattttcatcgaaagaatcaccccttgccctccatttatcttgctgttcctaccggaaatatgccaatgaagatcacctttttcagcactcaaccgtatgaccgtgaatcattcctcaaacatcaagccgattcgcgccttgaacttatttttctggaagaaaaactgactgagcacactgtatcccttgccagaggaagtgaggtggtttgtgttttcgtcaacgatacacttaatgaaaatattatccaccagctgtctcaattgaatattcagctcatcgccctacgctgcgccggctttaataatgtggatctcaaagcagctcaggcgtgtaatatcaaagtggtacgggtaccagcctactcccctcacgccgtggcagaacatacgctggcgatgatcatgacactcaaccgcaaaacgcataaggcatataaccgtgtccgcgaacagaatttttcgctgaacggcttgcttggtttcgacctctacaagaaaacagtgggcgtcattggtaccggccatatcggggaagtattttgccgtatcctgcacggcctgggctgcaacattttggcctgtgatccgataaaaaaaccaactgtggaagcaatgggcattccgtatgtccccatgagcgagctcttcccccaatgtgatattctttcgctgcactgcccgctcaatgaagaaacacgctacctcatcaacaacgaaacgattgcacaaatgaaagcgggcatcatgctgatcaacaccagccgtggcggattaatcgacaccaaagccgtaatcgccgggttaaaaacaggaaaaatcagttatctgggtattgatgtctacgaacaggaagccgatctgtttttccaaaacctttctgaacagatcctccatgatgacactattgcccggctcatgacctttcccaacgtcctgatcactgcacaccaggggttttttacccaggaagcactcagtcagattgcccttacaacactggataacgtaaggcagtttatagagggagaggtgctgattaatgcagtcagtaaggacaatggataaccttccaatatccacctatgagttgcatgggagccaatatgttgcaaggctccgaatgctgccggcctgcaacttgattagaaattatgctaccaaaaaatttccaaattacaacaatcggaaagacagtgcagcaatgaaggtaggcagcagtgcaaacagcagcaatctgaatggatgcactgcttcgtcatcgaagtggttgcgcagaatggttactcctgccgggttcggggcattggcaataacagttaaaccacctcctgtcactgctccgctagccagggcatatttatggctatcggataatccttccaccagcgaacccagataggtcagcgcagcgttatcagtaaaagcggtcagaatggttgcacccagaaacatctgatcactggtcatactcatcaatactggctgtagccaccattgctgctggccacccaataccaccagcccggccagaaaaaaagccaccagcagtccttcacgcaagatcaaacgatcctgataatgttgataagcatgagcaatccctagaaaaaagaggaacagccccataaatatggcgggatggtgagaaaaaattacgatacctacgagaaaagccagatgtatacatgtcagggcaaacggaacagtatcactacggttactttcctctgtttctggcaacaaccgcaattcttcgcggaatagcagtgttatgcataaggcgtttaccacaacggcaagaactgctttccagccgaatgttgacagcataaacatagtatcccagccccattttccggccaccatcagaatcggaggagcggcaaagtgtgtaagtgtgccaccaatagaaatattcacgaatagtacagccagcgtagcatatttcatgtgtgtggagattcccttcatgaagatacgttcggccagaatcagcgcggctagtgtcatggctgccggttccgtgataaatgaaccaaacaagggaaccagtgttaacacggtaaagtaaaatcccatgctacccggcaagggtatgatacgggcgaaaaaatccacagcgatcgttgctgtccgcaggatcgggcgagttcctgcaaccaccatgatggcaaaaacaaacatcggctcggtgaaattacgtgaatcgatgtaatgtactgctgctttttcactatcggcaataaacagcatgacaaccagtaccatcgcccagaagccaaacaccacctccacttcgcccagcaaatgccacagcccggcgtgagtcggctggatagaggccaatcgcttgaaaaaaccggtagtaaacgtgtgcaaaatagccagaacaaacaatatcgtaccaatcaattccacagcagtcggtgtcatcactttatccaggaatattactttgagttatttttacaccaatccgtgtcatgagcgctatacaccttgctttaaactggcttcgatgaacacatccaagtctccatccagtacggcctgagtattgccaacctcgatattggtgcgcaaatccttgatgcgggattgatccagaacataggagcgaatctggtgtccccaggcaatgtccgtcttggaatcttcgatcgcttgtttggtttcattgcgctttctcaattctgcttcatataggcgggatttcagcactgtcatagcatcggcacgattccgatgctgggaacgtccgctttggcattgaacaacaatcccggttggaatatgcgtgattctgacagctgaatcagttttgttaatgtgctgcccacccgctccggaagcacgataagtatccactcgcagatccgccgggttgatatcgatttctatactgtcatctacttccggatagacaaatacgctggcaaaggaagtatgccggcgatttcctgaatcaaagggagatttacgcaccagccggtggacaccggtttccgtgcgcaagtaaccataggcatattcaccgcttactttgattgttgcactcttgataccagccacatcgccgggagattcttccagtaactccactgccaagccacgtcgttcacaataatgcaaatacattctttccaacatcgaagcccagtcttgtgcttccgttccaccagagccagattggatatcaatgaaacagttattgggatccatcgggtccgaaaacattcggtgaaactccatttcttccaccgttttggcaagccccgctacatcctcggaaatactgtgcaaagtttcatcatcgctttcttcctgagcgatctgcagcaattcttgcgcgtcctgcaattggcgatcaatcgatcgcagggtgaatacgatattttccagagattttttttcgcgccctaattcctgagcacgcgccgggtcattccagatggcaggatcctcagattgacgctcaagctctgtcagccgtacttgtttggcatcaaagtcaaagatacctccgtaaaatttcacccctgtgctttaaatcatccagttgttcggtcaaagtattaatatgttcagcttccatggcagtatctcatccaaaaccattgattatactgtaagtcgaattggtacataatctggcaaaacgaatgcgagtataataatcagttgaagacactaccacatgggtgatctttttctattttcccattactttaataaagtatcggtcaatggtatagagatagatattgatcggtatcgtaaatatcacaggcaagataagacgggtgatcgcattggtaatcagccacataggccccttcgatacaatgtacagccggttgacccatttaccactgcctttgaaaagtgcatcagctattttcgatagaacaaacgacagagtaaatatcaccaggaaccaataaattcgaggaaccaaatccaatgcgaatttttgaaaactttcctggtcactgacgattttccaagtactgacgccaaacccccactctatacaaaaataaatcaggaagaagatgatagcgaggctcaggataaccggcacgcttaccatcaacaggccaagtgattgtttggtgcctgcaatcccttgcagtacgtagatgatcggcttgaaaaatttgtgatgaccttgctccagccgcttcaatactctggagtcacctgctttcagtccgggttgatactggctgaatcgccagtttccatgcaagtgtgaagatgatacataaggcttcaactttaaaagcgctgattgggacatttgataaccatctgcctgcaaacaatctgcttctacctcagtaaaagaatccagatcggtacgaatgcgtgataacgcatattgcgcttcctccgatacttcaaattgagaagatgaagaatcggtctcaatctctattttctcaccaggtagccaactgatcttgctggcggatagcccgtgtgttaaatgaaaataggcaacatgcttatcctggatttgtatcagattgttcactacctcttcccgtacccgcctcatcaaaattgagctgcttgaggcaagaaccgataataaatcagttcgggggttattcgttgcagcaacttggccagaagcatcgcttacaacgaaatcagtacacatataatcaggatccagcaagctcgcaataccctgattatcataggcaccaccgtcaatgagttgcacgcgacgatccttatataagttggaaatagccatgggagggaatatgccaggcaccgccgctgatgcggccacagcgtttcctaacagaaaataaggttctctggaggtaatctcctcataacgcatacggcgataacgatctcttttgtcgatatcgcgaaaaattggatttctgggaggcacttcacccatactcatggcggtaaaataccagctatgcgcagaattcagactgacagcattaatcatgagtatgggtactttatgcttgcgtccaggattgccgcttacagtacatggatggaaaggttgttctactccctgtggctgaatcagcagatcactcattcgtatggggcgatcaccaacatttatcaacggccggtaaatataacgctcgtataattcaccgatcgaatctgatcgggaataattgggaagcgccatgcgcatatttttgaagggattggcaaaagttcgcagtcgtaaatttttctgtactgcgtttagaaaatgctcttccagtttttgtaccagctcaacataatccgaatcggtaatatcacaatcggctttggattccagcaaaatcttcagtaacaggtaataggctgcgcccactattgaaccacccgatacagttgaaatggattccacatgctttagcattcccagttccgccatgcgcgcgagcacaccaatatgatagaacgatgccctgaatccccctcccgataaagcaagccccaagcgttgattacattccgttgcttctatcattttctttcccctttatggtgaaattccactaaagctgtctctttggaaaaatctttttgaagcaagccggatctggccaacataaaccagaactgattcacatatcagtcattatttgttccgcctaaacagtttggtgatggaatatagaatcaatcaaatacttcatctcctgtcggttcaaggtgagtggtttcattcatttcctggcggaatctagataattcgtaatacattctaaagcgtgcccggtttatattgcccaggggcttgtgttcaggaaggcaatgccagggattcatttttagccgtttggcaaactcgaactgcgcatccgaatcaaatttctgtttaggaatatggatggtggcggcaggaatgaatgaagaaagtttttccggccagcgaaccgaactgtcctcaatgggcattaaatgaggatccgtctgtacctggatcatcagatcaaactcaacttctttttcatcgagcgtcttgatcatgttctcccgcaaataattgaacggcggtgtaccaaaaggcaagccgggaatatgtctttcaacatcttttgtttttggcacgaatgaatacatcatcgcctggccctcacccagcagataaggcgtgcagctccagtagcgttgtcccagcggattatactgagtggcagtccacagactctgcatgaaaaaatcgagtaagtgagaatctttcggattgagaaaataataaagcgtcatatccaccagactccagtattgcagcttggcgttttctcgcgtattaggtgtaacaaacgtcgcccctccgctggttgcaatgaagtcttgcgtcagtttttcttcactcatcagtttctcgcccgggacccccataattttcaccgccatgctcataaacccgacatcatcaatatcagcaggtacattcgggccaggtccggaatagcgaatataggccggataactgcgcggatgagcaaaaatacccttacggcaatgttccggcagatcatcccggatggttacggtggcacgtacaataccgtgtgttttggtattgcctccccgttcatagccgcctggtttaaagcgcccgcgcatttgatccatcatcagatcgataattttatttaagctttcttcttcgtcaggatcaaaactttcctccgccagctttaaattttcattcttgtgccgtcgccggttaacaaagaactgaataattctcgaacctggttcgcgaaaaagatagtcccactgcggtcgaaaccaaggttccaatcgacgctcaatgcgtaacagctgaatcaaaaaattgtgaatcgccttgagtacccggttcttgatcgtcattatcatgatgagccaccatttccattaggaggtaaagctgaaatgtacttgagtgcacgcagtccgggcataaaaaaatatccacctcccagtacagttgtaaattgtggcaaatgacaagttctttgcactggtccggatggagtgggacgattaaaatgatcggtactatcgccattcattagggattcacgatttcccaacaaaggatccggttcctcttgcaaaccatcaaatttactattcacgatccaggcattttggacaaattcgaattgccggcctatgttggcgaccaaacaaataaactgcagaccgcgttcagcagcaggtgcatccggtttgatagcgtcttccggtgcaagaacagggccataaccgcgacctcgccgcaacaaacggtgaaaacgagaagaggcaacaagatcttcctccggtttttgcccaaaccccaggattctaaccaaccgacctataaaagcgattacgctgaaacccgttgcacccggcggtagatcgcctgtacggggattggctctgcgtacatgggcactaaccggacaatggttgcctttcggatccaggtcataggtaaaatggttgccgtgattcttgcgcgaaatccccggaatgtgctctgcaaccaaaggtgtaccatttcgttccctacccaccattgatgcggcaagctgctcacgtttttccggcgtagaatctgatactttattgagaaatcgccagaaaccgggaacatcctgccccagctgccgaagcaccagatacgttccattgcggccaaaatccttcagtgcaggattgtctttggcatttggcagattggccgctaatttatcatgctgaggatcgatcagtggtcgtgcggtgtattgtccatattcattgggatagccaagcgccatctccccggcagccagtaaattggtataacgatcatttgcatgcgaatctgtgctgtgccgatctgcccagtcaatttcgggctgactgataccatcctcaaacccaaagggctcaatccgtcccatgtccgaggtgggtaaatgtttcaataattgaaatgcctgtaagaaatacgcaccttccactgttgctctccaggcattaagccctccctctctggcataaagcaataacaggacatgtggtacttctgatgtattgctgccccacttccagtactttggtgcattgcgtccgatatcacccagccggcgcgaacaattttcatttcgggtcatgccataaataaactcatcggagaaatcatcaatgattgattcacttactcccaatgcacgtaaaccttgcacagaaaaagcaatctgcaatgccgtatcaggcgatggatggtttgcaatggcactgctgaccggcgctatactcagccattgtttggctgcgttcgcatctgcaattttcagcagcataaaacaggtatcggtcagttttccgtacccaaaacgcagcaatccctgcacgtcatcaaattcaaaatcacttgattttttcatctccatactccctcagatcaaactgagccattcacggatttctgcatcattagattggcgaacttccacaccttgccgaatgcgattgttgcgcgccagatcaacagcagtcagtcccggataagccttgtaccagacctctgtcggtatttggtgccgcctctgtgtgtatttgaatgcgtgctcacgttgcgcaccttccttgataatccatcttgtcgtcgggtagccaactgcattgctaaaggtaagatttaacccccagccaaccttgttaataaagtcatccatatagctttcgtggctgccatcgtaattactggcgaaaaaaacccgatgattgttgtccatgaatacccagcgggcgaagtggatcgttttgatgcgtgcgagaaagccatggttataaacatgtctggcaaaccagtcggtcagcagaagtatgaatttgaaagttaacaggcggaacaaccccggctttacatcaccaaatacactgtattgattgctgacatcccaatcttcctgctctgaaagtgctttgatatggtcataagttggccggataaagagttcagggtcagagcgttcccgctttcttaaccatagcgcaaagaaaggagcgataaccaataacagcggggaaaagagtatcaagatcagcggtactccgattttatgcagcagattgcgagttttccattcacttggtgtcagttctggcgaagagagtacaagcctacctttatatttttccatttcaatatgcgacaaaagtttctgccgtagcgcacgaatattttcctgtccaacctccgcaacaattttctgtaaataagcagaaaggctgtgatgtagcgctgcatcttcatgtatttgcctgacagtccgacccacccaattaacataattagccctggggtgaatgttatacgtttccatccatcccaacaggttctgatcttcctcggaaaaatcgtcacagtgggagaaaatttttgtcagccccaatcctgcgtgttccaccagctccgccaggaaagtatgcatatccccatcaatatcaccaagaaaagcaagagtgggccgccacggccgtggttttacaccaaactccttaatttcttgaagcgtttttgcttctatgatcacaaaccgcgcaaaatgcaaacgatcaaatttcccgaatggaaccaggttgttatcgggatcagcgtgtcccggaattttattcatcgaagccagcaaggcgcgcagattctgcaactcaccaacgcgcaccgttgcggtaatcatgaaggtagattgaggtgtcatggttttttctgtcccgaataaacagttggctggctggttactgagtatcgcttcgtgtcagggcaaaatccaggacacgtgttttaccccaccatacttttccaagataaacaccgggctcaacctcgcgaatttcatcgcgaatcactttggcaacaaatgaagttttggaataatcgataacgatggtgtctttgccgtcgagccagcttttgtcgcgatagaccttggcaacaataaatgtcaaaccaaagggggtaatcttgttgacaagaacacctgcctgaccacccgggcaaaataaatcaaacaccttgccttgccacgcaagaagacgtgcaaaggctgctactgtttttgaaaagatggaccctgccagaattgctgtaccacgtgcatcacctaccggaatatttcccggcgtagcatggcgataaatttcatccagctcttcacgtgatttacccaaccaaatcttgaccgtgttattcattttagttactcctcgtggttatcccgaaaataaataaatcgaacgtctggcaacacgcgatccgagacaagtgcccaccacatcagataaatcaggtagaaagccctttgtggaaaaaaaccaacctgtatcgaactcaaaaaccttactttgaataagcttattcctggtttatccaatattcaactgtttaatgtcctcagaatagaataatgtcaaataactatctgctatctgatttttattcaaattaattccaaatactgcaataccttcaataaaaaaaggaatatattattaataagcatactgtaagtaagggcttggaactttagctcgtcctgatcaataatttaacgggagatcatcatgaaaacatgtagaaatatcctttatttcactgggatcagcttggttttattgcttgcaggatgctcagatgacttatccctgaaaattgcaggtgaatgtatcaagggcgatcatgcccagtctggaacagttctggatgaagcacagtgtgtaaacagatctgcagaaagttttccgggagcggatgaagattatttcaaggatatggattatggaatcagtcagactcccgataaggtagtcgctgcacttgagcccttcgtgcccggtatctcccggaatccagatcaagctgtccaatctatcgttaaaggccgcaacaactggatcgtctggacaggtggcaatgacaagttctgggattacatgaatgcgaagagctttggtagcttcgatctgttaaaggtgctgtcaaaccatcccgggcttgtgaaaaaacccgggtacagccgcgataaccgttggaactggtttggcctggtcaatgaaccgtgcttcatgaaaaatactgatgcacaaggcaagctgattgggcgagaagatcgttttggcttgtatctggatgtacgagattctaactgccctgctgatccttttgagaatgaggaaaaatatccaggtgttaagattggtgcgcgcggagaaaccgtaccggtaggatcttattacggctacgcgaccggcattgtcggtctgcgtttattccccaatcccgatttcgatgaagctgcaaagaaacattggaatgccgagaaatattattctgatcccgattactacaatgatccaaaattggttaaaccgtaccgggtcggaatggcctgtggtttctgtcacgtagggcccaacccgaccaatccgcctaaagatccggaaaatccgcagtgggccaatcttaattccaatcccggagcacaatatttctggtttgaccgagtgtttgcgtatgaggccgataaaaccagtttcgcttaccagcatctccataccaaccgcccgggtgcgttggatacctcactcatctctactgactatattaacaatccgcgcaccatgaatgctgtttatagccttcctgcacggatgctgaatgctttgcgctggggcgaggaaaaactgaacagcggcgagcggaataacaagcaattcaatcattttaaggagattccagctgatagtccgcttagggcttttttcaaagatcctgacacggtactaacgccgcgtgtgctcaaagatggtgcagattcagttggtgcactgggtgctttgaaccgcgtatttgttaatatcggcctgttcagcgaggaatggctgcagcatattaatcctttggtaggcggtaagccgttcacgccctttccaattaaaattgccgagcaaaattccagctattggcgagcaaccgagcagcagacactcgatggcgccttgttcttcctggctgcaactccaccggatcatttgaaggatgttcctggaggtgggcattacctgattgatgacgaaaaaaccctggagcgtggtaaacaggtgtttgccgagaattgtgccgcttgtcattcgagcaaactaccggaacaagcatctgaatttttcccggataacggctgcgtcggccccaactatctgaactgctggaatgaatattggcactggactaactcatccgaattcaaagagcaaatgacaaagctggtaatggaagaagattttctcaaggaaaatttcctgtccacagagttgcgcatcccggttacattactggaaaccaatatctgcgcgtcgatagcgaccaacgccatcaagggagatacctgggacaatttttcctcaacctcctataaacaactaccttcggtaggagaagtattgatccaccatccggttacacgcgaacctgtggtctatgccatgccagacggagggcgtggttatatccggccaccttctctcacaagcatctggtctaccgccccctttttactgaataacacggtagggaagttttatccatcaggttcagtagaagatcgtatgaaatccttccagatcagcatagagcagctgctctggcccgagaaacgctattgtgatcaaaaagatttgtattactacgagcatagtgaaaaagagaaagactcctatgcatatgactcggaaacaacaaacagttgtgaggggaaaacctacctcactcagtccggcaaggaaataccaggaattattgatcgaacgactgaaaggagtgagctgaagataccaaaaggttatctgccctggtatgtcagtatctttcccataggagatggattggagcttggtccgtttcctgcaggcattccggtcaatctgatttccaataccaatatggaaatgaactgggggcaacgactttccctttcatgggatcttgtaagcgccatcgggtggaatatctttgatttatggaaagcacaggaaaatcccgaaagtattaccgatgaagagttgcgcaaaatgttgagcggtatagtagatcctttattggcagtgaataaatgcccagactttgttgttaaccgggggcattatttcggcacggactacctgccggcagaagaaggcagaacagcgcttgatgacagtgacaaacatgctttgatcgagtttcttaaaaccatgtaattctgtacgacaggtatttcaggatgcagcgaaatacctgtcgtgcttctcagtttacaggccatgatgctcaatccggttttgcttcaggagatgatttgtgattaagcctgcccacccggaaaataatcagattaatagtggcgatgacgaaaagtttgactatatcgtcatcggttctggtgcaggaggcgggccgcttgcctgcaaactggctctggaagggtttcgtgtgctgttgctggaagctgggggagatgacgagccatgtgattacagggttcctgcatttcatgcgcgcgcttctgaaaatgaagcgcttcgctgggactactttgtgcatcattatggtgacaaagcccggcaagagcaggattgtaagttcagtaaagaagagaatggtgtactttaccctcgctcaggcacgcttggcgggtgtactgcccataatgccatggttctgatgtatccccacaatagtgactgggatgacattgcggaactgatgaatgatccaagctggcatagtgaaaatatgtacaagtacttccagcgcctggaacgctgcgaatatgtgccaagatggaaaatttggagtcgccatgggtttgaaggctggctgcccaccagccaggccagcccatggatgctatggaaagataaagtactaacaaaactgacactctctgcggtggaagaatccagacgcatgatgcatccactcaaacgttttttcctgggaattctgaaattcattattcgtttcgatcccaatgactggcgcttgattcgcagaatccccgaagggctatgcaaaattccaatcacgacacaccgcggcaagcgggcgggtaccagagagtacatcctgcaagtccgtgaacaatgtcctgacgaactggtaataagaacgcacgcactggtccagcgtattctgcttaatgaacataatcgggcctacggtgtggaatattgtgtgggtgcccatcaatatcgggctgatccccggcacgaagaaacagctatctccgaaataagaatagcatgcgcagagcacgaaatcattgtagctgccggtgctttcaatactccccaactgctcatgctatccggaattggtccacgagaagaactggaaaaatatggaattgaagtaaaagtagcgctgcctggtgtagggaaaaatttgcaggatcgttatgaaatcgggatggtaacaagacttaaagaaaatatccctctgatcaaaggaatgaaactgcgcccgcctgaacctggagaagagcctgatccgcaatacactctgtggcttcaggggaaaggaccgtacaccacgaacggtgcaacggtcgctctcatcaagcgttcttctttcaaacaatgggatgatgatccggatctgttaattttcggattactcggaaattttagcggatactaccctggctatgctcatgacattaccagggataacagccgctaccccaatgcacggtgtcataaaaatgatgatcgctccgatatctgccaggaaaatatctttacctgggccatactcaaggcgcacgcaagcaatacaggtcatgtcaccttgcggtctagcgatccacgcgatgtgccggatattaatttcaactatttccctgaagattcggacagcggtgatggcgagaaggatttggattcagtagtagagggtgtggaagctgttcgcaatatcctcgaatattgcggagatctgattgaggaagagatcctgccaggagcaaacgtcagcagtcgcgatgaaatcaggcaatttatcaaagatcaagcctgggggcatcatgcttcctgcacctgcaaaatggggccacagagcgataaaatggcagtggttgacagccgattccgcgtgtatggaactactaatctacgcatcgttgatgcctcaattttccccaaaatacccggtttttttatcgtatctgctatttacatgatcagtgagaaagccagtgaaatcattattgaagatgcaagaatgaacgcttcttgattttttatgtatcacctagaaggacagcttactgagcaaatgctttatcttcctcggcaccgggttgaggtttccatcggatactgtaatattctccgcgatctcgtgcccagggatcgaatacattaaccacgttctgtagctcatccgtcagttccggcaacgttcttaacaggacgcgctttaatggagaaaccgcctgctgatggccattaggcatcccctcctccataatttccggaccgggcccattgtgcatcacccacgccactcccagggtgctataaaattccggacgaaagcttgaggtaaaaaaccggtcgctgaagagtctgcgcgaagcattgagaatgaacacaacgaattgagtttcggaaatagcaaagccatgcggacgcttgaattccgccagccagccgacgatcgcatcgacatcctcaatattgtcaacaagacctccgttggggtgtcccagacaatcgttaatgggtgatttgtcgtcattcagttgagcgtttgtgatcagtttgaattcatcgcactgatgctggccgtatacctcgcgtaacgtctgcacaagctgctcctgttcgcgacgaacaggcgaatccctggacaagcgtggatcaatgaaatcatcaaagctggacaattgtttcagtccgtactgccggcgaaattcgttatagcgtggaataccccgctcccgatcgcggatgagatcgagcgcagcaatatcaatttgccgggtggatgattgcagatggggcatcttcaggctttgcaaaaaccggggatgattctggagcgtcaactcacctgcccgttgacgacccatgctgagtgcccagtttgccaggcccttttgccgcattgcctcagtcgctttaccgcggaaggtgtcgataacgggtattttctgctgagtaatattcggattgctataccattcgcgatattcgatcaaatctggtaacaagggatgcagccgatataccgagacaaactcttcgggaaaactaaagggagaaccgaaatggttgatgccgccgttaatatcttcgttactggtgagtgtccagagatcctttctgctgcgatcaaccagagaatagagcggtgctcctgcataacgatgattacctaacccgaaaatacctgccccgccagcgaaagcagcataaagactgttgttgatatctttcgtatcatcgagctggcgaataacctctctcagtgcctcagacaccgcatcatgtttatgaaaaaggccataccagttggcattcattcctcgatacaacggctcgttgtacagtagttgtgtcgtccattcgatggtgtgaatcttggcgatctcggcagcgatcaccagtcgggttacgttgaataactcgttcgctgtgacatcctggtaacgaatgaccatctcagggtttgccgggtttctcaaaccgctgtcggcatcgggtgttttagctgcccgtctgcgaaattcttcaacaaaggcattgtgttctctggcaaagacgttgtgaaaaaaactcaatccaatggaccagttatcagggaaagcggctgcctcctgacctgaccattccggattgatcggatcatctatttcaaaaatcggcaaatatccaagcttatcgctcttgtccacactttctcttacagggatcagcaacaatttggcggcatcctcgggatctcgtttcacccgctgactggagcgttcgtcatagccataaagctgcgaggcatcccaccaagccgtcacgtaattgcgtgtagtctttggcgctcgtgtgagataagatcggctgccatgtataaatgatgcgggtggcgtatcatcagcaatcggtgagacattgattctgtcatccggtcgacagcccagttgctgaatctcctccttcgtcaatggcagctcgatattatcaatctggtgggtcgtgcaaccaaccgtcatccacactggctgatcaggctcctcttccgtatgagaaaaccagtcatgggtcatgaattgaacccagaaagccgccaatacgttcaaggctggtgctttcttgtaatcacattcggattctttcaggccaccgggtaacccgtagccatttcgacatttatcagggtgggattgcatacgagtgaacagcttccgactaatcacctgtggatcgggcttcaacaagcctaatcggtctccgtggcgatttctggtcatctcattgagatccagatcaggaaaagtggcgtcaaactgaacgttgcgcgcaaagagctgatgagttgaccccatcagcggattgtagatatcgttgcagataccagtaacggtacgaaagcgaatcagttcgccgccgcaaacctgatgttcctgattatgcttaacatctttgtaataaggatgagtgggtggcaactgcatctccggccaggtttgcaacacagggccagccctgccattacggcccgtcacataagcctggtaagtgccactattgtcaaagagattaaatttgatgagctcgatccgctgcaactccagttcatagagcgcactgttgatgccacgttcattgggcccgagaaacgtgctggctaatagtgtagaaggagacagtgacgagctatcccctgcagcccagaaatttggccaatccagccagggactctggctgagcacagcaatcgcatgatctccacccagacaatgcgcccgtctctcagggatcttgccgagaaaccgctgctctcttgtctttgcaacgcgctgaatatcaccctgtatgagcaccgtcagacaggaaatttcagattccagagcatcacatccgcccacaagcagtaatcctgccagcgcgatggctatcgagaagcgattcatctgaaatccgggaaatcccatataaactgttagaaattcatacgaatcccaccagaaatgatattgttctccgcgtgcttgataattaatctgtcgtaattaatgtacccgataatcgagcgggcaaacagcatttgcactccaacccccaggtttgcccaattacgcactgagcttgcaactgccattgatgcagaagtgggactatagttctggccagtgaaaccggccgtgatagttctggcattgttttcaaattcatgcacccattctgcacgcagtctcgggataatgacgggaataaaagttctggtgctaattgcatgactaagttcaacgcctaatgtactggtaaccgagcgtatggtttgtttattcacagacatagcaagagataaactatcgttcccactatgagcaacgccacctttttcctgaaagctctggatactaatatcactaaagtccccgcgaccatatcctcgcagattccatccatccattaaagtaaaggtatacccaccacccacgctagcaaaaaactgattagcatcatagttggctgtggcgttatcaaacgtgatgtcattttgactcgaaacgctgcgcgtggaacgataattaaccaaagcataccctcccatcagagttaagtagctattggtagttggtctgaaaagcacaaagggtgcaaaccgatagctatcggaattcaagtccccactcgccaatctcaaattacgatctgtccccagataattaaaggaaaagccgccaatcaatttttgattaaatgaataatcgatcatcaggctggtttgccgggtattcaattgaaaaccggtctgcccttcagcggtattgcgttcaccaaagctcccgccaccgctcagcgaaacccctacaggccctataaaaccagaagtgccaaatgatggcgtgcctgctaccgacgctgagctttgtagtaaaaaagaggattgttgctgacgtttctcagcagagcgacctgttagccgctgtatgctttcattcgtgctgcgaataaactgatagggagaagtaatcgcgatcgactcggcctgaatcgctgcctgtggagacagattctgcgcggtaatatcatttatcccgcccagtgcgaaggtgcaagctattgctaatgaggggtcttcacttgtgttttgtacacagataccctttaaattgtccactgcaaaagctcgtccgggtgtttgtacgggtgtttcttcgaatgattgtccactcgctgtcacaaatggtccgaaaccgagagttagtgcagtaaccgtatataaactcttttttaatcgacgaaccttgctcatgataatctcccctttgagtggataagctatggtgatccgataacctttggcgacgatattctggcgattttcctccttctcccttacctgtttcaaaccaaccaaaaatgtaaattacctgatgtcctcaagtctttttatgctttttatgggccgacaaaaaccaattgtcgtccgttctctgaaagggtaggctgtatgcaatactcaggacaaggaatcactgtctccggtatttgctccccgataatgtgaattttattgttcccttcttcattatcgagttcatcgaacatcggctgactttcgacaaatactttgacatggccgtaacttcggaaatctctactcagccgaaccgctgcagtacgatcttcttcattttccttatcatagggtaaaaacgttgtttttccgttggccagtgacagtacggctggtactgaattctgaagaatcaggactgatttggcatcacgcttgtcgaaaccatgaagggttatggagccagcgaggggataaagtactttttccccgtttccttctgtatccagttgcaccagtttattcccttttattgcaagaatctggctgctgccaggaatccataaaggggagtgataagtcccgtcacgggtaattggcactggtctgtgagctcccgttccatcaattttgctcagccaaagatttccttgcaaaatagttgccgcacctctaaccccacttggagcaacagaaatacccatcactcgcagtatgtcggagaaactacctgccatcacgctatgcgaaggtaataatattactatgcataatacaattattttttgggggaatgacatattcatgatcatttctttatccctcctcttttggtgaagtgctgccgaataaaaatttgaagatatgatcgtatccggtgatctccaatcgttgagtatcatttttaggtagcgtcattaagctccttttgtaatcactgccttgctgtttcctgagtaaaaaggttttgccttcatttccttcccaaaccagccaggcttgatcatctggtttaagtacacccagagtatccagtccatttacccggggcatcgatttatcaagcacaagaattccataattcaccggcagcaacagcaactgcacacccagcagaaagccgagcaacaatctggttatcccaggacgaatcatttgatttgggctatttctcaagatataaaaaaatatactggcagaaaccagcactccgcccagcaagccaataaaatacagtgtcatgggttcatcagtcctggcaagcaataaatagcgaagccacaaaggttcagcaggaagatctccagccagcagcagattactgaggagaatactttgccgcattaccagttgaattattaaaagagtaaaaagaatgcctgaccacgccagtcggttggatgcaagccaccatgaccggaagttttgccattggtgctgataaaaatcacccaactttacccggatgcctccaggcaatagtcgataaagcagataaatcggcgctactgctgataaaaatgacaccaggatcagcagcagcaaacttggtactaatgaaaccaaatagatgagaaatttattaccggtaaacaaatagcgttcatcaattaccgataaatcggtgcccacacccagcgcagtcagatgaaaccgcaatgccagataaccaatcacatacaaaaagaaactaaataaaacagtataagaagcccaatgggatgcaagattctgaattcccctgttgactgttgcccatagatcttcgcccttaacttccattttcatggatagcctgacttagtttttacggggaacgaaaaagaattcaccattattgtctcccgcattggggatccgccgataaacaggagcttgtttcatttccattgcactcacctgacgcactcggtcaaagacgggttgtttgatttcacgataaatatcttcggcactcataatcccttcgtttacttccagtgcctctgtgaatgcatctgcaaaaaccgagagcccgtttctgaactcctggtctattaccggctgaagtccgccagaagtcagctgtatacgcgaaggtaactcgtacagctgcttgatgataccaatcctgctttcagcagattccccaccgggttgacgtggtggcaagacaggttcaatttggcttgatacggtatatatggaatgggcagatcgagtagccagcccttgtggcaacgacacaataatttgttcctgcgatggctcaagccatgacatagccatcgcagcaccataacaagaatctgccacaaccagcacatgccgggcttttaacccccctctcccgcttttttgaaaccctatttctgtagtgatatcgtcggtggataaccaatttgcacggatctccgcatccgcatcctgagctaaccaataaccgcttctggcataaaactcgccatggcctgcaaaataaattagaagattgtcattacttcctatctttgtcttgagcttgaacaaagcactgaagatctcgtttctggttggctgaacgagcccatcatcagtcagcagaatcgtttcaaatccgtattttctcttcaatacatcttcaactcgtctggcatctttgacaggcgtttttagatcatcaagaggagatcggtaatcattaatgccgataatcaaggcataatacttacccacatccagtgcctttccaaatgctgcctgtgtttcggtcctggttaactgattttggaatgtagtgagtttctgttgagcatcagataattgttgttgaacagtattttcccgaagacgactttgagtcaattcatcttgcaatttttttacttgtacctgttgatctgttgctgtactgccgctttgctgcttgagatggtttatttcattttgttttctctgaataatctctctactttcgcttaattgcttctccaggttttttgttgtttggagcgcctggttaagtttggattccacctcattaatcttattttttgtgtatagatccaacttgataggcttaatctctcccatggcctgacggtataaatccagagcagattgcttgttttgaggaatacccaacccattttcataaagaaacccaaggttatttaatgcccggctgtaaccctgttcagcggatttgcggtaccactcggcagcacgctcataatccggtctgatttctccccagcttctgccataaatttcccccatataattctgagcaaccttatctccctggtctgcacatccctcccaaactttcaaagcggtttcccgtccatctttatcactggtcagtgcatactgtccgccttgcaccttacactcccaggcagtaatccttgctggtcttggcggagacatccactgttgatacatgccgagttgaatgagctggccaggcagcaaacaatccactgttaaaagatcatcaacatttttataggcctctggtggcagttcacgtgcttcagttttttgttcttgatttgccacgcaaacactttctacacctgtcatattctttgtgtcggtggtcgcacatccactcattaccccaagtagcagaacagcacacaaatatttaaaatttgatttgagtatcatgaccatgccttacaaacactaccctgttgattaaaccgttaccccattagggattagctgtggattcatccgatcataggggatggatcgactgctgtttctctgatcaatttgtccttctattgccctaagccgttctctgaagcgttctatgacatcacgtgctgtcgggtcaaactgctgcaatggatactggccgatacggttgacagtaaaatttgtctggaaataagtccaagtttgcgaatacgccgcccggaatgcgggttgaaacttcaacagcccggctgcatccatttccgtatctttccccaccggaggagaggcataggctgaatgcggcatattgggaacaaaacccggatatttgtactggttgaaatgaatacacgaatggaatgccgtgcatagaaaaatgatatgtccgatggtctctgccagttcttgccgggatgtaaacctggtgagaaatccaggaattctgccgcgatcctgcgcgctaatatcatgtgcccacgcctgaatctcgtaatcttcagccacatcagcatcagattggtaatagacatcaatatattccgtaacaaagctttgaattgcattccataacaacatgccatcgtcgcgatacggataaaaaagatcagggttatcgacttcccggctggcaatatcgttaggaaaagccgatgccctaaagtcaaaactcgtcatgccattagccatgcactgagtcgtcgcatcatagtctccggcaaacaattcaccgtaccggccaggccgccctttttgatctctcaggaaagtatgctgatgattgacgttgagtgtatgttgaagatgcggatttaataacacacacagcggatgagatttataaagctgtcggcgtgaggccataatgatggcctccatcacataatgaatgcgggtagcatgggtaaccagtatgtggtggttaccatccgcaacctgcgcaaatgttttggctgccaaccacaaattaccatcctttggggtataaacaggattgccaggcccggcatcttggtatagttggatggcaatcggccgcaacatgccatctgcttgcagaaacaacaccacgatcggagtcgtgacatactgtttacgaccaccgtcgatttgtccgggattgcgctgcaatatctccagatctgcatagtccaggacgtacacacgcttttgcgtaatcgcagttgcataatcaatttcattaatatgctctacgaaaatgcgctggatttcagattctgacaatttttgtggcagcggatgctgagaggtcacggcgcgcaatacagcaggatttacaccgatgacacgttgcaagccaaatatcagatcctgctggaagttatcaaccagctccggattcggaggactaaacgggtaaaagatataatcgtgataactttccagcggtttgccaagcaaatagcgtacataagttgccaacagtctcggcaagcttggcgtcaaccgtaacagattgataccgccgcgtagccagtacccaagccctggcacctcccgccacggcaatttgcgcacgacagcaatcgtattggcatactcataggcatattgatattgtgcttgccctttcagcagataatttttccgattctctgctgcgcgtccattttcctcttgttgcggcagcttgttcatcatgtgaggctcctttacaaaagataaaatttgcctggtttccaggactattccgctatcacttccacatttcagtcagaaaaaatagatgttctgaagcttgcaacgactttgtcgctgtccttgacgttacgtttaacaatatcctcgagcatgcttgtttcttcaataacggattgtccaactttcgaaaatgtcatttcagtgtgtacctgagtcgacataagtgggttggtcagggcgtgggtaaatgcatcgtaacccaccatccgcaccatcaggcgtccaagactaaatccttcatcatgatcttcagcgaagataccaaccagccactccagatcatcaatacgatcgttatagagttccttcaattcttgctgtagttcaggatcttctgttaattcctcaaaacttctcaatcgcggcatactgaatgcctcgcgataatcattgaacgagcgcagtttggcctgacgtcctatctccacactgcgctccataacactccggttatccgcaccaaccggtaacggatcaaaaaagaactgaggggtgttgtacaggctaatacgaccggctttttgccgtgaagcagccgatatcagggttcccatactatattgatgcgtgaccaaggaggtattgttacgaaattcatcaagcttgtagcgctgatcaccgacaaagtagtattctggcaccatcgaatgccaccggtagagcagattaaattccagggaaatccagttggtgcggtaccagcgttgtctttctgccatgcccggcgtgggatcaagggtaaaaccaaactgggtaaagtgtgagacgtaatcttgcaacactactttaatcagcagcacaatcatgatatttctggctgtctgaaacaggcgttcatcatcccaggcagggtgggcttctttgagcagatcacaaatccggttatgctcgcgcagcatgatggtattcatgagggtgtagccaatcgacgaattgccgtgctccaatccggtggcaaacatacgttttaaccgctcttccgggatattgttaaaaacatattccagaataaagcgaggatgcagattctcaaattccttgtcagcaaatacccaattgtctgtagttgtttcttccacgttaaaaaggtaaggaggaaaaatttccccatcgataacctggtacttcagctttccatcctttttcagccgcagcaaacgggtgatttcttcacgcaaaccatagatctggcacagatcaatttcgtgatttgatgtattttttcggcgatcacgaaaatctgtccgcagaaaactatcagtaaaccattgggcaaaaaaagaaaacaggatgctggtatcgactgacgggatttccttgttttcttttctgcgccacagatttacaacactttccagactcggaagatgctgttctccttccgcttccggcaagtatcgtccagtgaatgctctgtccgtcaatgattgccatgtggtgtagggcgcagccagggagaacggcctggggcgaggatttgtggcgtaggcctgccaattgacaaaggtgtcactaatccagcgccgtaaccacgttatgcgcgaagcaatccgaccaatccacgggaatctgtttacaagccaaaaaacaatctgaaaaaaaaattcgttcataactctctcctttttcattgcgttaaatggcaggtcattgataacttacgttcccgtcagttgttggtattttatttttagtgcatacgtggccagttgatggctagatctttttctccctttttcaaaaaatatttaaagatgaaaggacaatttatttaccctatcctcaggagaagatgaccaactcacccctgtgtcacctgaatggaataagcacctgttcccaaaggcgagtagtgtcttacacggacaaagtattcacccggtgaaagctggctgcggattagggcattgaaagagatacccgaatcatcgttgttagcgatttctggtccctgactgctcgggccatgcaagctcatgaaggtatccgttgtcccattcgtctggatggtataaaaacctcctgtcgtcacattaaaccggtatacgtcgctttcatttgctgcagaaatcgccgcattgatacttgcaccattcacggtgagctcaggggtcggagctgggccgggaccagggccaggagcggtgctgactgtgcgcacaccaaccgcataatttcccgtactgttcgggctgtacaggcgaatgcgcagatagtaagtgcctgctgacaaatttcggttgatttgtgcattaaaaccctcgcctgcatcatcgtctgacaccacctcgaaattcggatcattggggccgaacaaggtcatgaacgtatcggatggcccggtggtgtatatcgtataagcgccgaaagctggaacctcaaagcggaaaacgtcaatttctcccggcgtgccaatagcaactgccgttggattggctccgacaacaatgagtggtatttcctggggaggtggcgtaacaacaccgtcatacacaatacccaacgctgcactgtccagcacatcaatagggcgcgacccgacctgtcctgaaggggtgctacccattggatcggtcaggttttgaccaaaaggaccgccatttgctggcagatagccttgattcgggaaacgcagttgccactcgtgccagatcttgtccaccatgcaatggttcatgaaaaacaccggatcattcggggaagtcatcggcagcatggaacccccaacccagacatgaccacggttgtgcagattagggccaatccagccttccagctgattacggaagcttgggttgctatttatgttccatggtgacgtgtcatatggtgtgacagccatgacctggttgatttcagcttgtgtaggcaaggttggcagcccgttctgtccaaattcgcgcatcagcggacctgccggcaatccactggaattaacgatagtccattgcccggagcggaatggcccggtacggacaacaccaccggcatccccatttcctccgagcaagtcatcattccacatggaggcattggctccacctgatggccagttccagtagggtatcccgagattcgggttacctgaaacgcgctgcagttccagttcaagatcataaataaagcgacggtgccacggcaagaaggcagagcatcgatgaatatcgcccatactggcatttgcatgtctgagcacgaattgatcatagataccttcagccttcaacgcacgaatggcagcaacgaattctgcccgttcagcagcagtcagggtatttgcatcttttctgatagccatgagaatttcctccttatttttatctgtcagaactactctttcacattggaaaattcaacagtgtgcctggcgattcctcttgccaactccaacaacgaatcatattgggtatagggtagatatctcgaagaccatttgttttttgctgcatcgtgtttgtaatcaatttccttgccattaattgtgaggctggcgtcatcctttatatcaatcgtgcaaccgtcaaaaacttctgtgtggtgtgtcatttgtaaactccttttttggatgaatgacaattaatctgtctttgccgcaatccttgctgtgtcatttatccacggtgcattgcagattagcagtaataatgacattttctgtctcgcgcccgcgtgcacgaatcacagcagatatatcaacaaagtacccgtccagctcgtcgtaattcagatgtacaaaccctaatgttctgggaaaatctgatagcacattctttattcccgtattcttagtggtcagcaactcaagactcattattttctcaaaaggagacacttcatagtttcccgattttgtgacatcctcgaccatgaagcagccctcgtaacgtgcctttagtttaaaagtaccctctttcgataaagttaatatcccggaatgaagcgttgggaccccggtacagctattcatatttgctgatgtaatggagcacgtcatgttccccatatggaaagggtcctgcgatgccgccgtggtatttctgccaatcagcaatatcaagcttcccatcaggatcacagcagtccctttcatcgtacattcccttgataatccggtacccggtaataacccaacactccatctttacgctatttcacgcagatacctgcacagtcggcacctcctttagcaggatcacaatcatctgagggatcatccacacacttcatatctccagggcaagaaaagccggcaattccgccacacatttgtttgggtttctggccatcgtacgcagagcttcctttgggtgggtaatcaatgcgttttccttctcccggcttggcaggttctgtcgatcccagcttaacggtgtcgtgtatctttctcgattgaacggtttcaacgtcgatcgattgaacttctccttctgcaggtcgggcggtatatacccctaccacatccaatggaacgggactctttactaccaggaaaccttccaggaatgcaaaatctacgcatactccatcaatcggacaaaagtagctggcgatatcaaagcaatttactccgactgcaccgtccggttgcagtgtaattcccttgaacggcgtaacattgaaagggcctggctcagaacccatctgggtagaaagcgctaccttggcggcaacagtgattttcttattggcaggattatgaatattgacgatagtacggtatataccttttgccagagtgccgtcctggtgaggtagtaatagtgaacacgccactttcgcagcatactgatattcagtgttgattgcctcgtgtttcattgtttccatttctgcctgagcaccgactggattaaatccaagccataaccaggaaacaataaagaagagtttgatcgtattcagttgtttcatgatagccacctcaccgagtattgtgccctctacagataccatgttcttgacgtgcatcgcatctgcgccgagctaataacaggtctacctcatcttgttcaacctggaagacagagtagcccctcacgttaactgcaaaatatttttcacctccatttttctaaacaatataaagaaatgtatgtggtgcggcccaactacaataagcaggtgatacgtgcctcactgatcctgtctggtggcacatatacccgagcaatctgctccttcttgttctgggtcgcaggtatcatttggatcatcaatgcacgtttggccatccggacacctggttcctgtaatccccccacaaatttgtggttctggtgtcttacattcacccggatgatcaatggaaacacctgccgcagctgcttcacaggcattgccataagttttgccatcacaaccacaaaccggattgaactctctcgtacaaattgtcggcctggttttgcagacaccttgtgcatcggcaactttgcattgaccaatccccagatcacagtactgctcatcaggacatgctaatccctggatcgtgccacagacttgtggctgtggctgcggttgtggcaatttactttcctggcagcccgccacgatcagggaaacagaaagagcaatcaacaaagtgatcaatgcatccaggtattgtgttaatcccttcctggtcttacgcatgattgatggcgccgataaactccggacaaaattgtaaggaaggtaaagttgcgggctaaagctcgaatagctcggtctggataaacctaaagtagaggtaaattgcgtgaggggctgtttttctgccaaaacgcgatcattttgggcttgcgttctgccttgattttcctgctgtttcatttgttcctcctctccttagcgggcatccggaacgaatccccttgtgtctaattaagcaagaaactgttttcaggttttcagaataacgatgtattactacttcactctaaaataatctacaccctttattctggaa

SEQ ID NO: 1 - DNA, 2537572 bp, Nitrosomonas eutropha (residues 1,268,787-2,537,572 of 2,537,572)
tggtaagtaaatattatattgtcatgcgtggtttttttgcttccgggcttcttgtccagatatcgaacagaatgtgaaaaacgttaacgaagccatcaaagcaaggcaaaaacaggcgaggaagcacagctcatgtacgataaatgagcatgctgggactgtttctagtacagctagagctagataacagcaggaccgagtaaagcagcgagtattaccagccacatctggtgacgatcagggctattgttcacgaggataaaactttacttaactctattttctgtcctgtgattcggctgcaagaaagagctattgtcaaatctggtgtatagagaatcaagcggctacctgttttcgatctccattttgtttaacgccgttaacgaatttgacgccctgcataacatccgctaacaatttatagccccttagtcggaaccatttcttctgcgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacattccatcgcttttggatatttaggactaaaacgttcaatacagttatcaaatgctttataagccttttcctgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccgtccagctcgcttcagactcacgataaccatcagacaatgccagcagctccttacgccccgtttcatcagaaccgataatcaccagaagacataaccggtcatccatccgcacagtgctgtagataccatcagcccagacataagcataccgtttgccactcagatcgcggcgagtccagttttgataatcctgttcccagcaggtgttttaaggtctctgtgaaatctcctgttgaaatccctctcagatacaaccaaggcagaaattcttcaatgcttcgtgttcgtttcaagtagggagggatcaggctgccgttaaatttgatgccagaaccgctgcgatcacgtactttcggcactttgacttcaatatcaccaagcccggtttaaatcgagcgccccggtagataaccatttctgacaactgccgttctatcctcagcggttttcaaaccgccatgatgatggataaagctggttacttccgcttcaatcgctgccgacaacatcttacgtgcgccttctcgcagcacttcctgtaacggatcattttgttctggtttattcagattaaaaactttactatccgtcatgcggtgtttcccttgttttgttggtcgatctgccagatccttaacaacaggttacaccgcttccttctcccttgtcatacaccagaaataatcatagctctgcaagaaaatgaaatagataaggtaacagtagtgatggtttctcttcctgaacggcgtgaccaacattgttcaggataacgagttttgaattaggcagattttcatgcagacgtttgccgatggccaacggcacaatctcatcttctttgccccagacaatcaaggtagggacagtcaggccagcatagttgttcgcgaattgttgcaagtcagggggcaatatttgccgcgcagtcgtaagtaaagcatattttgcgcccggcttgccaaggtcagtggcatagtagttaatagcagcctgtggaatcagcgcatcatcgaaatatactttctgcagaagatccttcacctgaaaggtattgggaaggccatacgtgaccagtgggccaagcaccggggttgcgagtatttttataaagctgggtagttcctgtggataagcaatgctatcgatcagtaccaggcttttttgcagaccgggactggacgcagataaataaactgatgtaaccagtgcgaccccgcctccgtaggaatgcccaataatatgcagatgcttcagatccttttcgaggatgaaatttctgaccagcctggcctgctcataaacggaataggcatcatcgtgtggcttgggtgaatcaccaaaacctttcaaatcaatagtaatgacccggtatttttgtgccagcggttcaataatatgccgccagctatagctgcttgcaccgaaaccatgaataagcaataccggatcgccggagccgatgcttcgggatgccagctgaaattcatgcgttttatccggatcacggtactgcgcccaaccgggaatattcttatccataacaacacaaccgctgaagttaaaaatcatcagtaattgtgcaagttttgaaaaaaaatctctcatgccagcgcacgaacaagcataaccagatcaaatacaccgccagcaaagaatgtaagcgcaccaaaaacaggcagtatcgcaattacgttacacgctgttttcaagcgtttggcctcatcttcattttcaagcttcatgtgatccggaatggacaagatgacataactgatcaagctgagaaagataatgtttccgatgctcagcggcagcaggttggtcaggtagatttctaccggacctaacgtttgttgcaggcagtaaccacatttgtcaatcagctcaaagattatgtcgcgcctggcgttgataacttgaaagaaacttaacgtggtattgacagcaccccataaagctaccagtagaacaaaaggccctcccaatttttccatattgatctctctcctttctcagcaaaaaattctaccagagagggccgttgttgccatcagatccattcaaccttagcgtctgtctgtagtctgtagtggtctaattcaaatagacacctcgatagatgaaaaatcacctgcgttgggagctggcccaaatgctcatttgtttttaccttgctctgacgacttcgccaacattttttactcaccctgccagaatagtattatctttgcgaggtcgtgctctttatccgtaagtggaacatggtaggtacgatacaaaccaatggatataaaatactggaccgccaccacgctgctatgcaacttatgctgacagcaaaagggtaaagaaagtgcgcaccgttacttctcagcgttcttttaacccgacagaaccaaatttgttaaaattcgcctttttggaataaagtcatggcgttacttgaattgcgcaatgttattcggcgctttggcgatttcacggcagtggataacgttagcctgtcgattcaagcaggtgaattcttcacactgctgggcccttccggttgcggaaaaacaacactgctgcgcatgattgccggattcgatgtccctgattccgggcagattttgctcgatggccaggatattgctaatacaccgcccgaaaagcgccctattcataccgtctttcagagctatgccctgtttccacacatgacggtggcagataatgtggctttcccgctgaaaatgtccaaggtggcgccagcagaaatcaaaaaacggatggagaaagcactggaagaggtacagctctcccggttcacccaccgctttccgcatgaactctccggtggacaaaaacaacgtgtagcctttgcgcgcggcttgatcaaccggccgcgcctgctgctgatggatgagccgcttggcgcgctggacgcaaagctacgggaagatatgcagcgggagttaatcaatttgcaaaaagaagtcggcatcaccttcatttttgttacccattcccaggatgaggcgctggcgctgtcacaacggattgcagtgatgaatctgggaaacatcgaacagattggcacaccttcagccatttacggaaccccggcaaaccgcttcattgctgatttcatcggcaagatcaacctgatggaagcccgggtaacgcaaatttccaacacggccatgacgctggaaattaacggactgggaacaaccgtcctcccacccaaaaaagagatacaggcaggagatcagggcgtgatcgctattcgcccggaacaggtagcagtacacgcactggcgaagcaggcagaaataccccatgcccatactggcaaagtgctcgactttctctatgtaggcgacgtcaccacctatgtcatcgagttggacagcggcattcaaatcgaagcgctgctggcaaattcttcacccggacgcgcacgcttctttgaagtggatgatccagttattgtcagctggccacaggaagctgcacagtttctggtggatcggccatgaacaaattccgcctgacacgctggttgatcagcctgccaccgacactgtttctgctgatattctttgcggtgcccagcctgatcatgattgtgacttcgttccgcttccctggagaatatggcgggctggcaccgttgactgcgccggagacaactgccgcagaaggggattctggtttgtatggtatgacgctcgaagcctaccacttcttttttagcgatatcctgtacgcagaaattttcctgaaatcctttgtggttgcgacaacttccaccctgatctgtctgattatggcctatccggttgccatgctgattgcccaaagcgctaaaaaataccgcaacctgatgatattgctggtcgtcctgccatttgccagcaattttttgatccgcatctatgcctggatgattattctcgggccggaatcagcattcagccatttcatcaatagtgtactccaggcctttggctttgagccggtcatgatgttgttttctccgttcgcagtattggtcggaaccgtttacgtgcacctacccttcatgattttgccgctctacaccaatctggaaaaacatgatccggtgctgctcgatgctgcacaggatctaggcgcaaaccgctggcagcgcttctggctggtcacctggccacagtcgctgccgggtgtcttctccggctccgcactggtattcatcccggtgctgggcatgttcgctataccggatattctgggcggcaccggtgacattctgatcggcaacctgatcaaggatcagttcctgggaacacgcgactggccattcggctccacattgtccatcatgctcatgctggccgtgctgtgtgtgactggattattcactctactggctcgccctcgtgtacccaggtaaataaatctcctgttctgatatgaaacacaccaatctcaccctgtggcttgctgccagtctggtttatatttttctttatattccactggttattgtcgttgtttactcgttcaatgattcccgcctgaatgcggaatgggtcggctttacgctggactggtactacaagctatttaataaccaggaaatgctgctggccgcgcgtaattcattgattatcgctgtcagcgccagtctgcttgcaaccatactgggaaccatggcgggattagccattcatcgctaccggatcaaggtattgccgtttcttgcatttgcaccaattgccatgccggaaatcctgctgggagtttcgctgctgctgttctttctacaagtactgaatctgacgttaggcctggtttcgatcatcattgcccacacaacattttgtgttggtttcgtcgccattattgtgcgtgctcggctgcaaggtatggatgacagtatttttgaagcagcccgcgatctgggcgcaacaccctggcaaaccttcaggctgattactctgccgctgatcatgcccgcagtcatcgccggggcgctcatgtcgtttacgctgtcaattgatgattttgttattactttcttcaccaaaggcattggtgaaccgattctgccgattcagatctacaccatgatcaaaattgctgttacgcccgaagttaacgccatttctacattattcatgttgttgacactggtattgatcatcatcgctaatcgtctggattccggcatcttgcagggggaaaagaaatcgtgaaactcggctacaccctgatgggtctcttttgcctgctgatcatcgcgctgaccggctgcacatccgaagatcaggttgcgggtgatttgtccggcaaaaatggcaatattctgagactgttcaactggaataactacatcagccagcaaacaatcgagcgttttgagcagacctgtcaatgccgggtgacacaggactattactcagataacgaggaattgctcgccaaactggcagctggtgcaaccggctatgacttgctcgttccaaccggtgatgccatggacaccctgattcaccaaggggcactaaacgcgctggacaaatcacaaattcccaatctgaagaatattgatccaagctatctgggaactgtgttcgatccggataaccgctactctgtcccctatgcctacaccacgacattaataggatttaaccgtgaaaaactggccgaactaaacctgcctgccgatagctgggcgatcatcttcgagcctgagtatttgaaaaaaatcaagggacgtatcaccgtactcgacagccagcgcgaactgatggcagccgcactcaaatatctgggctattccgctagtgatactgatgaaaatcactggcagcaggcaaaggcactgattatccgggcaaaaccttactgggccgctttcagcaacactagctatatccgcgaactggcaattggtaacctgtgggtggctcacggctattcaaacgatatgtatcaggctgcactggatgcaaaaaaaaccggacgccgctttagcgtggattttgtcattccccgtgaaggcgcagtgctgtcactcgacagcatggtgctccattacagtggccatcgtcctgatctggcccaccgcttcatcaatttcatgctggaaggtaaaaactccgccgaactgaccaacctgaccggttccggcaaccccaatctggctgctcggccctatatccatcctgaaattatcgccaatcatgctattttcccagatacagcacaactgtcccgactggaaatgctgcatgatatcaatcacacacaacgccggctgctcagccgaatctggacagaaatcaaactgaggtgaaagcatgagctattatcaacatcacgttttcttttgcgttaaccaacgtggcaactgtgaaggctgctgtaatgattatcacgcccaggcaatgcgcgattacgccaaggcgcgcatcaaagaactcaaattaagcggcaaagggaaaatacgcatcaacaatgcgggttgtctcgatcgctgcaacgagggtccggttatcgtcgtctacccggaagaagtctggtacacctacgttgaccaggaagatattgacgaaattatcgaatcccatttgaaaaatggacaaatcgtcgagcgcctgaaaatctgatcactccttatccgaaaataacgaaaacctgcaaaaatcactccgctatcacggtaacaacggcaaacccagttccttgaggaactcgttgtgtcgcttggtggctgcgtcgatcttctggtcaagcgaaaccagttccgaatgcaccgcgccaaggtcaacttcctcctcggcctccgctgtactcacgtagcgcgagatgttcaggttgtagccttccttctcgatgcgttccatcgatacacgcatcgagtagcggtcttcctcacggcggtgctggtaggtatcgagaatcttgtcgatgtgctcgggcatcaacttgttctgccgcttgcctttctcgaagtgctgggcagcattgatgaacagcacgtcatcgggctttttgcatttcttcagcaccaaaatgcacaccgggatgccggtggagaagaacaggttggcgggcaggccgatcaccgtgtcgatatggccatctttcagcaacttggtgcggatgcgttcttctgcgccaccacggaacagcacgccgtggggcaggatgatggccatcacgccgtcttgcttcaggtagtggaatccgtgcagcaaaaaggcaaaatcggcggcagacttcggagccaagccgtaattcttgaagcgcatatcctcgcccagcgcttcggtcggctcccagcgatagctgaacggtgggttggccacaaccgcgtcaaaccggggctgcttggccgggttcatttcgcgcagcgcgtcccattcgttggtgagcgtatcgccgtggtaaatctcgaactcggaatccttcaccccgtgcagcagcatgttcatgcgcgccaggttgtaggtggtgatgtttttctcctgcccgacgatcttgccgatgccgtgcgggcccatccggtggcgcacattgagcagcaaggagcctgaaccgcaggcgaagtcgaacacactttccagatgcttgcgtttaccggtggctggctcctgactgtccagcgtgacgatgcccgagaggatgctggaaatctgctgcggcgtataaaactcaccggccttcttgccactgcctgctgcaaactggccgatcaggtattcataggcatcgcccagcgtatccttgtcggtagagaatttctccagcccatcggcaatcgccttaatcacggtgcaaagcgtggcattgcgcgcggtgtagtcttttcccagcttttctgagttcagattgatttcagagaacaagccgccaaaggtgctggcaaaagattcgttctcgatgtaatcaaagcctttttgcaacgtgtgcagcatctcgccgttttgcgtgcgcgccatttcggcgatgctgctccacaggtaagcgggctgaatcacgtagtgcgtcttgcggcgcatctgcttttcgaactcggctgcgtcatccgggttctgtgcgtaccacagcgccagcggtgcacgacggtcgcccgcgtccagcctggggtaatccgagcccagttccttttgcgccgccgcctcgtagttgtcagacagatagcgcaggaacaggaaggacagcatgtagtcgcggaagtcgtccgcgttcatcgccccgcgcaaggtgtcggcaatgcaccagagggtggtgcccagttgtttttgatcttgttcggtcatggtgtgttttttctgtttttgagttgctgttccagcgcttgcaaatcggcctggtcttgggcatcggcggcggtggcttcacgagttttgcgttgctggtcgtaattcagatagcgctggctgacttgttgctccatgtgggcgtgactgacagagccggcgttctccagcagcgcaaagccgttggactcgataatctgcgccacgttttgctgccagaacgccatctgaatcggctggcgatttttggcacgcagttcggcggtttccagaaagatcaccaccagccggttgagcgtgtcgatctcatcttcgctcaggtaattcttggccaccacgatgtcttgcttgcgaacctgtgcgcttttccatgtcagcaaaccaaaatggggatcggcagggttggcgcgggcgaggatgatttcggcggcggtgtgccccgtcaccgcatacagcaacaggttttgcactgtggcaaaaaattgctgggtggcagcatcggttttgtcataatcggcggccagggcaaacagatcacgcactttttggtagaagcgtttttcggaggcgcggatatcgcggatgcgcgccagcatctcgtcaaaataatccgggcggccatcggggtttttcaggcgctcgtcgtccatggcaaagcccttgagcaggtactctttgagcaccgtatttgcccagcggcgaaactgcacgccacggggcgagcgcacgcgatagcccacggccaaaatggcgtcgagattatagagcttggtgcggtagtttttcccgtctgcggcagttaccgaggattcctcggtaactgaagtggcatccaattcgccatccgcaaagatatttttcaggtgcaggccgatgttatcggtgctgaccgcaaacaactcggccatttcgcgctgggtgagccatacggtttgcccattggcgcgcagttgaatgcggctctgaccgtcgtcgctggtgtaaagaatcagctcgctcatgcgcgcgcctcatccagcacggggaaaagctgctgcatcaggccttttttgtgggctttgagggcgtcgattttctcggcttgggcggtgatttgggtgtcgagggcagagaggcagtcggcgattttttgttgttcggctagcccaggataataaagttgaaattttttaatttctgtcacagttaactgttgttgagcattcccaaaggctatgtttgtaatgtaagcacccagaagcgctgatttgcaaaaggcgtataagtaatcagagctaactttttttgttttcatccttaaaacaaccataccagagtttattcgtatattgtcgtaaggcacttcctcagaaaaatatgcaaattgaccaacagaccctcttgttgttaggacaatatccgcacgttgcaattttccttttcttaaagcatcgtcttttttctttgtgataaattgcattgcttcaaacttgaagccattcttagttacattttttgcattcaaaaagagacaatacccagaactactaaactcctctgctttaggataatttatccctctatcaccatcgattacttctacaaccacatcaaaagcaccaacaccccactcccccgcctcccgaaactcaggaaagcgcagtttgggcagggtttcgccttcggcggggaaaagctgctgcatcaagccttttttatgggttttgagggcgtcgagtttttccgcttccaaacggatcaaatcgtcgagggaagaaaggcagtcggcgattttttgttgttcagggacagtgggaactgctgtttgtattttctggatattggccttggataaacttggaacgccaccggcctcattgtgctttaaccaatcaatctgctgaaagatcgcaaagatgaatttagggatgcaatctttaaatgagtgggtgtaaaacagcgtatccaccgtccaaaaacgccccgtcaagaacattggattgtcaattgttccttttctgccgatgcaaacactttctccatcgtgaagataatcgttcaccgatagcatgtagccgccagaaccatacactggaacattcccagcatctaaatgtttgtagtctctgccgtttccgatggtgaacagtttctcgaatggtttattagtccacgcccccgcctcccgaaactccggaaaccgcagcttaggcaccaaacccgcattctgtttttgcttcgcactcatggctgtgcctcgttgttcattgctcatacgcccccagccctgaaatctcccgcccttgggcgcgttttttgagcagcggatcaggtcttccatcaacgctagctccgccttggtgcgtgctttccagcccaattcttgcggggcgaacagctcgcttaattgctcgccatcaaacaccatgcggcgcaaggtggtgtccacaaaggtttgcagggttgcgacttccaggctgtgtttggctgcgatgctggccagcgccttgacgtgcttgtcggctttgaaacgctcgaagccttcacggatggctttctcgtccagcgccttgcctgcttccagtgtgctgatgtattcggcgatgtcgtcgcgctcgtcgatgaacttggcgtcggactgaattaagctaatcaactgatcgcggctcattttctgcttgcccggcgcttcgctggcgtagcgagcaatcagcgccatgatgtagtcgtaatcaatgatgctgcttgcaaacagcacaaactcgaaatcaagctgctgcacggcggcgggggcctggttaccttgtttgtcctgaatttctttcaggcgtttggccgtttccagataggtgctgcggaagcttaaaagctggtctttgggcaagagcgcttcgattttggttttttgctcgggctccagatcggtgtattggtcgagctgggttttcaggcgctgcacttccttgaagcgattgacgaattcgatgcgggcggtatcgcccttgaggttgtaaacggcttcgggttcgcagacgaggtttttggttgccatgaatttttccatggctttgatggcgtgttcgtatttgtggatgacctcggcggcaggctccaccagccagatttctttggcgggtttgctggcttggccggagaacaggccaatggcggtatcgacggcttccgtttgctggcggaaatcgaggatgttgccgtagggcttggtgtcgttgagcacgcggttggtgcgtgaaaacgcctgaatcaggccgtggtacttgaggttcttgtccacgtagagcgtgttcaggaacttggaatcgaagccggtgagcagcatgtccacgacgatggtgatgtcgatcttctgcgcgtgcggcaggtcggcattgggccattgctgatctttgatgcgcttttgcacgtcctggtaataaagatcgaactcgccaacgctgtgattgctgccgtactgggcgttgtagtcggcaatgatggctttcagcgcggcctttttttcatcaggcgcttcttcgttatcggccttttcctgcggcaggtcttcctgaatctgctgcacgtctttattgccctcggcgggcggggaaaacacgcaggcaatgttcagcggctgaaagtcggcgccattttctaatttttgttgggcctgcttttccgcctgcaaggttttgaatagcgcgtggtactcgatggcatcgttgatgctggcggtggccagcacggcattgaacttgcgcccggcggtggcggcgtcgtgcttggcgaggatggcttcgacgatggcctttttggccagtgcttcgccaggtttggctgcctttttgccgtcggtcttgccatccggcttgtagtagtcgacatggaagcgcagcacgttgcggtcttcgatggcgtgggtgatggtgtaggcgtgcagttgctgctggaagatgtctgccgtggtcttgtagctggcttgctggccctcgatctgttgatagctggcgttttgatcgaagatgggcgtaccagtgaagccgaacaattgggcgttggggaaaaactccttgatcgccttgtggttctcgccaaattgcgagcggtggcattcgtcgaaaatgaacaccatgcgctggttgcgcaatggctccaggcgctccttgtagttgcgcttgttgctaccgtcgagtgccagaccgagcttctggatggtggtgacgatcaccttatcggcgtagtcatcggagagcaggcggcgcaccagcgtttcggtgttggtgttttcctccacgcagccttcctgaaacttgttgaattcctcgcgggtctgccggtcgaggtctttgcgatccaccacgaacagacatttgtcgatgtcggggttgtctttcagcaaggtcgaggctttgaacgaggtcagcgttttgccgctgccggtggtgtgccagatgtagccattgccgcagcactggtggatgcattcgacaatcgccttgaccgcatagatctgatacgggcgcatcatcaatagcttttgctcactggccaccagcaccatgtagcggctaatcatctggcccagcgtgcatttgacgaggaaggcgtcagcaaagctgtccagatgggtgatcttgctgttgtcttcgccggcaaactgatacagcggcaggaaacgctcgtcggcgttgaaactgaagtggcggctgttgttgttggcgaaataccaggtgtccgagcggttgctgacgataaacaactgcaagaaacacagcagagtcttggtgtagccgttgccggggtcgttcttgtaatcgacgatctgctgcatcgcccggcgcgggctgatggccagcgtcttcagttcgatctgcaccacgggcacgccgttgatgagcaggatcacatcaaagcgatggtggctgtagtccgtgctgatgcgtagctggttgaccacctcgaagttgttcttgcatcagtccttgatgttgaccagggtgtaatagagtggcgtgccgtcgtcgcgctcaaagctgttgcgctcgcgcaggtgcttggctgcagagaagacgtcaggggtgatgatagattccaacaggcgaacaaattcgctatcggtcagatgaacgcgattgagtgtttcgaagtgctggcgaaagttcttttccagtgcggcgcggtcacggatatccgtgcgataggtgtacttgagatcctccagcttcaagatcagatcatgctcaatctggttttctgttgttgccattggttatagttttttataggtatttctaaaaataccggttatgcgggatgtaaggtgcatggagtataacaacaagatataccaaatagataaacgtggcagtgagtatcactcaatgctgcggttcacctgaaaagccaattttttgaattgctggcacagcgtatcgcaattacgctggttaaaagataaggttaatcaatgtccctctttttaactgacaaatcctcaaacaggtatttttgacgtgactgctggttcaactaatttttcttcaaggccaacgggattcagcagcaaaaccacagttactcatgcacgctttcccacagtttttgtaggcgtttgactgatacaggcatgggggttttcagttcctggctgaacagggaaatacgcagttcttcaatttgccagcggaatatttccagattcgggtcggttacgctggcctggtggtgtttatgcaagcgttgttcgtactgttcacacagtgcggtgatgatttcggtttgttcctggtcacgttccggatttttgttgtatttgtcgaggcgcagcatcatgcctttgagataacgcgggaggtgttgcaggtactgccagcgggttgtgctcaggaatcccggataaatcaggtggtgcagctgtgtttccagatcttttttcaggaaagccactgatttttccagagtggctagtcgctttttcaattcctgacaaggctgggcaatcgcatggatcagctcagccatttcctgcgaaacagttcccagccgtgtgcgtgcacgtgtagattgtgcggtaaattcatgttcgttacgcggtagcggatcatctccgatcaaggccagatcaataatggccgaatggatgtcttccctgagcctaccaatctcgatcagattgctcatgagtaatactgctttctgatcgacgggtaaatttttttccagttgcctgattctgtccttaagtgcaaggcataacaaacgccgtacaccttcccgcatactgtgctgcgcaccttcctgtgtatcaaatatacgaatggcaacactctgctcctgatcaaccagtgccggatagccggtcagttgctgactgccccggttaaaacgagtctcctgcggcaattctccaaaatcccattgggtaatgccgtcacgttcgattgaattgggttctgccccggcgccatgcgtaaataattgctgtgctgtctgaccaaattgtgcttttaattcagtcagattatgtcccatgcccagtgtggtgccggtatcgtcaattactttgacattcatttgcaaatgcacgggtaacggtttgtcatcccaactatccagcggcaccttgattccggtttcgttgcggatgaatgtggacagggattcaacaagcagcacggcctgatccgggcaggtgtccagccattccagaaagcgggtaacgaattgcggcaccggaatggcatgacggcggatcggcttgggtagcattttcacataccaggtcactttttcccggattaaccccggtaccagccgatcgaaatgaaacggcataaattgattgagcaacggcagcgggatggtaactgttactccatccagaggatgaccgggatcaaagcggtagctcaagggcagatcatggccagctactaccagtgtttcaggaaactgctcgatggttgctgcatctgcagcttgccgcatcagcatttcccgcgtcaggtacaacagcctggggtcaatctgttctacctgcttgcgccatttttcaaaggtattaccactactaatatctgcaggaatacgcgcagcataaaactcgaatatctgctgatcatccaccagaatatcctgccttcgcaccttgctttccagttcgcagatttcatcaatcaactgctgattgtgctgcaggaaaggtgcattgcttttatatgctcttgcgaccaatgcttcacggataaaaatttcgcgtgcatgggctgggtcaatcgggccataagccacgcatcgtttgggtacgatggtcaggccatacagggtgacacgctcaaacacgacagcttgtgcgcgctgtttttcccagtgcggatcaaagtagtgttttttacacagtttgccagcgattttttctagccagattggatcgatggcggctacacaacgtgcataaagtttggtggtttctgccagctcggccgcaactacccatttcggctgtttttttctcagggatgatccagggaaaattgaaaacttgattgcacgcgcaccttcgtatatccccttctcatccgatttgaagccgatattacctagcaggccggacagcagcgcccggtgaatttcatcataactggcaggaacctggttaggacgtaaccccatttcctgaatctgcgtatgcaactggccgtgaatctcgcgccattcccgcattctgcgatgggaaataaaatttttctgacattgttcaatcagctttttattggattttttgtgtttgagcagatcgttatagaaatcccacaatttgagataaccaatgaaatcggagcgatcatcgcggaatagctggtgcgcttgatcagccgcctgttgatgttcaaatggtcgatcacgcggatcctgcagactgagggcggaagcgatgatcagcacttcggtcaggcagttttcttgcctggcggcaataatcatgcgggcaattttaggatcgatgggaaaccttgccagttgatgcccggtttgtgtcagccctttttgctcattcagcgcaccaagttccgataaaagctggtaaccatcggcaatcatgcgcgcagcaggcggctgaataaacggaaactgttccacatctccaattttcagcgatttcatgcgcaaaataaccgccgctaacgaggaacgcagaatctccggatcggtatattgcgggcgggcagcaaaatcttcttctgaatacaggcgaaaacatacgccgttcatcaccctgccgcatcgtccagcacgctgattggccgaagcctgggaaattttctcgatcagcagctgctccaccttgttgcgatagctgtaacgattaatgcgtgccaacccggtatcaatcacatagcgaataccgggaaccgtgagtgaagtttcggcaacgttggtggccagcacaatgcgtcgccgttggccaggcataaaaatacgcgcctgttctgtgtgggacaatcgggcaaacaggggcaagatctctgtgccagccctgctaccggggccggaaaaggtgtgtttacgcaagatttctgcggtttcccgtatttcccgttctccgggcaggaataccagcatatctccctcccccatgtgcatggcttcatcaaccacattcagaatgactcgggacagatcacgctcctcaccatctgcctgatcgttgaacgaccggtaatggatctctaccgggaataatctgccagatacctcaatgacaggtgcattattaaaatgggaagcaaagcgctgggcatcaatggtggcggatgtaataatcagcttcagatccggacggcgcggcagtaattgcttgagatagccgagcaggaaatcgatattcaggctgcgctcatgcgcttcatcgataatgatggtttgataggcgcgcagcatgggatcttgctgtgtttcagccagcaagatcccatcggtcatcaacttgatacgtgtatcaggatgcgtctgatcagagaagcggactttatagccgaccagttgcccaagcgggctgttcagttccgtggcaatacgtgcagcaacggttctggcagcaatacgccggggctgggtatgacctatcagttttttggcaccccgctgctctccaatactatgttccagttccaggcatatttttggtaactgcgtggttttgccggaaccggtttcaccacagataataacggcttgatgctgcacgatcgcgcgcgcgatttcttcacgtcgcgcgacgaccggcagttcttccggataggtgatgcgggtaattgattcggagggaggtaccaataaatgttacttgccgacgatgatggtctctttctggttgctgagtgtgccctgctcaataatggcaacggttagcttggaaacagcaacacgcttgccagtggcctcctcggtaatgtccgtttgccagacctggatgcgtctgccgacatgcaacggcgtacatacaccaatgacatttccttcagccactgcccggatatggttggcatttatttcaatgccaacagcccggtaaatttcagggttgatcgtcatccacgcggatacgctgcccagagtttcggatagcacgcagctggcacccccgtgcaaaataccaaaaggctgggtggtgcgatgatctaccggcatgctggccttaaggaaattcgggccaacttccaggaagcgtataccaatatgcacacccatattggcattacgcaacccttccagataatcaatagtgtagtttttaaaccagatcgcttgatcagaactcatattgtctccacatacttaacaggtcggggctcaggaatttgcagcagaatggattgggatcaataccggttcggcgcgatgtttacctctgcgcttttccactgcttcggccagatcggaaagtacctgttgtgttgtctcgaaatcaatacagccgtctgtaatactctgtccgtaaaccagctctttcaattgtttgccttccacattctgccgacctgccaccaggtggctttcaagcatgacaccactgattgagcgattaccttccgtaatttgtcgtgcaacatcagcagccacttccggctgacgccgataatccttgtggctgttcgcatggctgcagtcgatcatcagataaggaggcagtttagcttttgttaacgcctcaactgcagaagcaacatttcctacatcataattaggtgatcttccgccacgcaggatgatatgacaatcctcatttcccctggttgtgaaagtggccacccgtccttctttggtgactgacaggaaattatgcgggtgggaggctgcactaattgcatcaattgcaatattcagattaccgtaggtgccattcttgaaccctaccggacacgaaacaccggaggccagttcgcgatgtccctggctttcagttgtccgggcaccgatagctgcccagctaatcaggtcggccacatactgcgggctgatcagatcaagaaattcagtagcagccggcatatctgtattgcccagtttcagcaataaattgcgagccagtcgtaaccctttgtcaatattgaaactgttatccagatccggatcattgatcaggcctttccagccaacggttgtgcggggtttctcgaaataaacccgcataatgatatgtaactgacctttcagctcctgacgcagacgactcagccgagaagcatattctacggctgcatctacatcatgaattgaacacgggccgcaaatgacaagcaaccgatcatcctctccccgcaatatgtcatggcactcctgcctggcagtgaccactgtttccgttgcacgctcggtcagagggtgctcacgaagcagttgcactggcgtgatcagctcatctcctctgataatgcgccgatcgtcagttttatgttccactgataattcctcgatgattatttctctccatttgtcctcgctactccacaaaaacgtactatccactgttcactgttacattatgtggttcagctctgccttaacaagtaggtctattttactgcgatgtctcgctaatctccatcattcctgtaacgaagccagatgactggccacatcttccttgctgaaaccgattgcactggcaatacggtctgcatggctgatgcgcgagacacccggaacaagccggtgtgtcggcttctctgaaacgaattcaacttgcagatagtctccgatttcttcctgctgcaaacgttcgcacaattcgtgattatgggtcaccagcagcgtggtggcacccagctgatgaaatcctttcagcacatactccgaaagtgtcattttttcttcaaaggtggtgccttccgccagttcatccagtatcaccagagaacgtggtgtcgaattgaagaagatttcgcgggtttgtttcagctcatgtgcaaaacgccccattccttcctccagttggccgggagcaggaatctgataaaaaatatgctctgcaggcactattcgtgcttgcgttgctgggatatacgctccggcttgcgccagcagctgaatctgagcaaccgttttgcagtaggcggtttttccaccgctgtttggccccgtcacgatcagcaagcgtttattgttatccagcgtaatatcgttgggaacataatccggatgcgtccgtaccagcaatgggtttttggcggcagaagcaaccagtgtgtgacgttcgttcctatagatttccggcagaacggaatctcctggtatggaatgcgcatgccgacgcaatgccagcaattcatcaatcatccccagtgcttcaattgctctagccaattccggactactccgaaacagtttctgcagcgggtagatgaccgaatcccggtcggatgcactgactgcttgtaaaatgatcggaatgatcggcacaagcaggatcaaaaccccatagccaatgtagctggcactcagctcgctcagtgtactctgaaagaaaaaaagcagaccggccataaaaaccagaaagaaaccgataaacggccacttgaacacagaggggcgaaaccgcggaataggtaagcgagatttttcttctcttgtcagaaattttctttccgagacatagatgggcccatgcatgagtgaataagtacgtgtccgggcaaaatcacgcaacgcttgtaccagcgtgcgcaggtaattactattgggagtgggaagcgcttctgcctgatccaccatatctacggcaaaaccagtgccatcaacaaactgacgatagccgtatccaccaaattctagtctttccttaccggttttatctttgggatcatcggtcgtcagtccgcctgcaaactcgccgtaaagcaggtggtatagtgaggtttcatcgaacgccattcgtttgatgtacttttccagggcgtctaacagctcgggactggattcaagttcacgcaacgcttcctgcttgctttgtaataatgcagcatcggtcaccgggcgcgcaattgagcggtacaatacggattgccctacccgggtctgtgcatggttgatttcatcaaacagggcatcagcctccaccgcaacaaaagtcttggcatccagtgccccgtaattatctgcagtgggttttgtatcccgtatctgcgtctgacgtttgccggatgacaaaatgaaactttcgcgccagacagaagcagtaacagcttgtgatgtatcattcatattcttatatattgatggattgcaattgaacttagctcgtacaactttagacgattttactacctcatgcagggattaatggtgataaaacctccctcatcgccttactattaattactagtaattaattttttcgggcaagaatcatgctgcgtaaaatttttaaaaaatatctgccttctcacgaaagtatccagcagagccgctttgtgaaattttttggcacgctgctgtatcatcataacctttggcatttacaccgccgttctgttgccggaggagtagctgccggtctgttcgccggtttggttccgggcagcaatccggtgcagttcttttttgccactctgttttccgtgattttcaaggtcaatctgcccatcgctgtatttacgacgctgtactccaatccttttactatcgtaccgctttatatagcagcgtatttcttgggtagctgggcgaccggcagcaaggtaagtagcatggatgacctgcctccgctggaattgcatttgctggacaaacatctttctgaatgggcccccgtgctgacggattatctggcaaccctcgggaaaccactgattgtcgggctgtttttactagcctccctgctatctgtcaccggctatttcgcggtacgcatgttctggcgttactacgttatccatgcatggcataaacgagccaagcgtaagcgtcactccaacaataacccctaacctttcatcttcatgcctggaacacgtttactgcttcgcatagcaggcattgcgctactgattaccgcagcagggtacatcacttggcatttaaccagaagccagcctctggaagtggaactggcgaccgttagtcgcggtgccgttgaagccacggtggtcaatacgcgtgctggcacgatcaaggcatgccgacgagccaaattatctccacaagcaggtggccagatcatccgtatggaaatcagagaaggagatcggatcaagaaagatcaggtgctacttgaattatggaataccgatctgcaagcacaacatgatctggcaaagcagcaattggctacagcagaaagccgacgacaggaatcctgcatcctggctgacaacgcacaacgtgaatatatccgcacccaacaactggttgagaaaggatttgttagcgtacagcgagccgatgatgcaagcgctactgccaaagccaaccgggcagcctgtgccgccacgggtgcagaagtcaggcgagcgcgtgcacagattgcagtcagccaggccaacctggatcgaacacagcttattgctccttttgctggagtcattgctcagatcacaggagaactgggcgaatatgtcaccccttccccaccgggaattcccaccccgccagcagttgatctgattgatgactcctgcctgtatgtcagtgcgccgatggatgaagtcgatgcacccaaaatccgggtgggacaagttgcacgcatcacgctggatgccctccctggccagatttttgaggggaaagtacgtcgtattgccccttatgtgactgaagtcgagaaacaggcgcgcacggtggatgtggaagccgaatttgccaatcctgatcaggctgttttgctggtgggttatagcgcagatatcgaagcaattattgatcatcgtgaaaatgtgctgcgcgttcccacccaggtgatccgtcagggcaacaaggtttgggtgctggatcaagatagcaggcttgaggagcaaacgctgaaaacaggcctggcaaactgggcctataccgaagtgcttgaagggttgtctgaaggggatcaggtactgctgtccggcgatagtggagaaatcaaaacgggcacacaagtgacccccaaatctcctcagccatgatacagctccagggtatcacccggatttttcatatgggggatcaagctatccatgcacttgaccatattgatctgacaatcgactctggtgaatatgtttccatcatggggccttccggatcgggcaaatcaaccctgctgaatgttatcggtttactcgaccggccggacagcgggcattatctactggatggcagagacgtcaccgcactgtcggaaaccgagcaagcacaggttcgccgggaaaaaattggttttgttttccaatctttccatctgatcccgcgtttgacggctgcagaaaacattgaaattcctctgatactgactggcatgccttcaatagagcgcaaggagcgcatcgcagaaaccttgcaggcattcaatttgagtgatcgtgcacaccaccgaccggctgaactatctggcgggcagcgccagcgggtggccattgcccgcgcaacgatcttgcgtcctactgcattgctggcggatgagcccaccggcaatcttgatcaccgtatcggctcagaagtagcaacgttgctggaagcattgaatcaaacaggtaccacgcttatcgtcgtaacgcatgatcgcgaactggcattacgcgcccggcgccgggttgccatgcacgatggtcggatcgaaaccgacgaacaatgagactacaggatctcctgcgtttttcccttaaaactattaccagctaccctgctcgctcgtttttgatcatactggccatggcattgggtgtggctgcagtgatcattctgactgcattgggcgatggggcgcgccagtatgtcgtcaatgaattttcttcgatcggcaccaacctgattattgtcctgcctggtcgttccgaaacagcagggagttttccaggcgcagtcatgggccagacgtcaagagatctgacgctggatgatgctcattgggtaggaaggctgccacaagtcaggcgttacgctcccctgaatgtcggtgtggctgaactttctgctgcaggcaagctgcgggaagtcacgctgatgggcaccaccgccgatattttcccaatccgtcacatgaagctttcacagggaaaatttctttcaagcgcggatgaaagcagtgctcagattgtattgggtgccaagattgcacaggaatttttcccggatgggaatgtactggggcagcgcgttcgcctgagtgatcggcgttttctggtcaccggcgtgatggcggaacaaggcgaatccatgggatacaattcggacgaactggtcattattcctatccagcatgcccagacattactcaacactaattcgctgttccggttgctgattgaaatccgccatcatggcgaaatcgataatgccagggaagcaattcgtcaaacgctcattcgacgtcatgacggggaagatgatgtcaccgtaatcgcccatgatgctgtactggctacatttgaacgtatcctgcgtgcattgacactgggggttgccggtatcgccgtcatcagccttgctgttgccggcattctggtgatgaatgttatgctggtatcggtcagtcagcgcacggcagaaattgggctactcaaggcaatcggcacgccggctgctgtcattcgctatatttttctggccgaagccgtctggctatccctggcgggagccctggccggattcatactgggacaggcaggcagctgggcactacgtctggcatatccgctgttgcccgcctggccaccactctgggccaattttgccggggtaggagtcgcagtattggctggcgttctggcgggattattaccggcaatccgtgcggcgaaactggatccggttgatgcacttggcaagcgataaagtcgatgaatcttgttgaatccctgagatttgcactccgcgcattaaccgcccaccgaacgcgcacatttctgtctgcatccggtattgccatcggcattgccgccgtgatcctgttaacatcaatcggtgcaggtatccagcgttttgtgttatccgaattcacccagtttggaaccaacattgtgaatatcacacccggcaagactcgtacgcgaggtgcttcgaccggatcaattagcagtgtgcgcctgttgacaattgaggattcgctcgcgctgaaatcctctcgccatgcggtctataccaatgcaaccgtcaccgggaacgcggaagtacgcggtaacggccacagccgacgagttactgtatatggccaggggccggatttcgatcgggcatttaatatgcacactgcgatcgggcaattcctaccagcggacgatccgcgtaatccacgcgcctttgctgtgctcggtgcaaaagtacacaaggagctgtacggcagtaccaatccgcttggctcggtactgcaggtcggtggttcacgttttcgtatcattggtgtcatggcctccaagggccaggtactgggttttgatctggatgatacggtttacattcccacagcacgggcattggaagttttcaaccgggaaggtgtgatggaaattcaggtagtctatccgccagccacaccactggatgaagtcacgcaagatatcaaacgtatcatgcttaaacggcacgggcgtgaagattttacgataacaccacagcagcagatgctcagtacactctctaccgtactgaatgtactgacttttgccgtcgcggtattgggaggaatttcattgctggtcggagcggtggggatgatcacactgatgcacatcactgtgacggaacggatggccgagatcggcttgctgaatgcattgggtgcaacccccatgcgtatccgtatcttgttcctgctggaatccaccgcgctttcgacgctgggggggattgtcggattaatcacaggatcagggattgccggactactgggaatactggtcagcgatttgcccatcagcatcccgtggcgctatgtcatcgcggcattgctcctgtcaggggtaatcgggctggcagcgggcattgttcccgccatacgcgcagcccgtcttaatccggtggatgccctacgcgctgagtaaagcctggcttcagtgattttttacgtaatccactaacttctggaaggaaaatagattgtcctgtttctgtaacgggttatgacattgtgcacaattcagatcgttatcctttactttgccatttggttcatacaaggcaaacccccagttaccggagcgatcttctgctttaaaagtgccatcccagtcacttcttttttccataacacctacagcagccagtttgtcgatgacaaacaagccatcctcacccgattggattttgccctcggcatctttcttgggtatatatatttccatgaccacaactgaaccgggagcagcctcctcaccttttttgtagctatccacggcaatcttatttgcatagaattttgctaactgtgtttgattagcacggttagcggtgccatattgcgaaaatatctcagtataattttccggaaacttaacaaactccgggtttcctcccccaaaggcagggaatgacaacgttaaaccgatcagtgcagacaaacctaaacttgatttcattttttctctccttttaaaaatcattctgcgggcaaatcaccagcaaacatgatttactttgtttttgagcggaaaacgaaacatacgtgtaaaacacgcaaattccactgacattatagacgctccccatacaaatcatgaaacctatcatctggatgatgatactcatcacagaaattcctgcagagtcagaaaatacccatccttaatcatcttgcagagtgaccggaatatctctccggacatgcaaaacgtcaatataaacggtggaaatcgaaccacaacgctgataatgacattcaaacttatgaaaacagctcagaaaaaatggttttgattaagcggctgaaaattgttagcagatgtcgtttccggcgttaaatttgtgacgcgattaaacaaaatagagattaaaagcagatggctacttgatcctccatacattcaatttgactatcgctcatcgcaaacacaatcagcccttgcttagtctgcgctacaaatttgatagtcagcaagtttcgggtcgtgtttatgaaaattcacttttattctatggggataggaaggatagaatataacgcgaaggataaaaatgatgatcgatcaagcgcaaactcattacgaccgtattgtcaaagcaatcggtaaccctaaagcctccagagctgtcggtacggcaatcagccgtaatcccgtcgcatttctcatcccatgccacagagtcatccaatccagtgggcagatcggcggttatatgtggggggccacccgaaaatccgcgatgattagttgggaagccgcgagaacgggagcatgaacatgcaagacactctgaaaaagatagctgcggcgaattggcaacatgtggctgatgacatgcacgaaaaaggctatgcgatcgtgcccggtattttgtcggctgtgcagtgccgtcatttcattgagctttacgactgccctgacagctatcgcaaaacggtaaccatggcgcgttataggtttggcttgggggagtataaatattttgcctacccgttgccggatattattcaggccttacgggaaaagctctatgccaaactcgttcctgttgcgaatcgatggatgaacgctttgaatatcgaaacgcagtttccagaaaaactggcagacttgcataagcagtgccgcgaccatcatcaatgtcagccaacccccttgattttgaaatacggcaaaggcgggtttaacaccttgcatcaggatttgtacggggatatttatttcccgattcaaaccgtattttttttaacggaacctgatgaagattttaccgggggcgaatttgtcttaacgcagcaaacatcgcgagcacagtccaaggcaatcgtgttaaaacccaggaaaggcgacatgttgatgatgacgactcactttcgccctatgaagggaagtagaggttattaccgcgcgaatatgaaacatggtgtcagtgaagtgcatagcgggcaacgctatacgatgggtattatctttcacgatgcagtaagttaaagatcaaataaactcaggcagggagagtgacgaatcctggctgatggtacttggagtagatgatttactgaaatcaatcgcattttacgaaaatgggtttgtacccccatattttgaacacctaatggaaaatgtcacgccccctaaatttacccctaactctgttaggtggatagacccagaaaatgattcggcatagtgaaattagcgatcaggatgtaaggcgagggataaaagccctgcacattcaatttggcggcaacagtcaactgcaaatctatggcactttgggatgtcaatctggtaaaagaatgcagcgcaaaaatcgggtgttttttgccagcgctcaagcagccatcgaggcaggttatcgcccttgcggcaattgtatgaaggaagcgtataagaaatggaccgggtcacgcatactttagatgcccctgaaaatctgttaccccaagcgggggaagtcaattattacgggccaattttatcgctggaagaatctgatcgttatttagcgatacttctgaaagatatcgcgtggcaaccggatgaagcgattattatgggcaaacatattttgaccaaacgtcatgtcgcctggtacgcgaattcaccctttcaatacacgtattcgaaaatcaccaaacaggctctgccatggacgcaggatttattggagttaaaaacgattactgagcaggtaagtggggagacattcaattcatgcctgctgaatctttatcatgatggctccgaaggcatggcatggcacagcgatgcagaaaaagatctgaaaagagacggagcgatcggctccttaagcttgggtgcagaacggaagtttgcatttaagcataagcgcagcaaggaaaccgtttccatcctgttggaacatggtagcctgttagtgatgaaaggaaccacccaaacccattggcttcaccggttgcccccaaccaaaaccatccataccccccgcgttaatttaacattccgcatgattgtgaatcagggtattgaggtggcgtaatagaatttttcaaaacaatggaatatctagccaaagattccatactgaaaatacgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctctgaaaatactgcctacctacccatttctgtgaataggatgaacaggctcgcaggcgcagcaacagttacctgttacagcttagcttagcgtttaaagtgcaataatcggttattagcgggcatgtcgtgatcttgctgcaagttgaagccagccttagcggcaagggcaatcacatcttcaatattacgaatgcccattaacggatcgcgttgttgtaaatgctgattaaaactagcattactggtactggtaaattggccattgtagttaaaagggccgtaaatacacagctgtgcttcaggtaagcaaaattcatttaaacgttgaaacagttgttcaactatctgccacggcatgatatgcaaggtattagcagtaaacagcgcatccactttttcagcactaaacaccgagctagtaatatctaaagctagcggggcaggtaaatttgctaagttagcttgttggatccgggcgctaaggtcggataaataagccggttgatcgctactttgccagtttaagtgtggtaagtgcttagcaaagtggacggcatgttggccggtgccactgcctatttctaacacccgcttgctatgctgaaatacctgcgtcaacacctgcagaataggcgctttgttattttcacaagcttgagaaaatgctagcactatttttttacctacttaggttattctgccgcaaagcgttgctgcaagtaggcaataatatcgttagattcatacaaccattgcacctctccgttatcatggctaatacgtaagcaagggactttaatccgacctccacccgctttgagagcttggcgatgggttgaattatccagggcgtcgtacttaacaacattcaggcttaaccgggccatttctttacgtaccctaatacaaaatggacaagccttaaactcatacaaagctaactgactgcagtctgcatcaacttgggcttgcgcttcactatcacgatttatgcctttaggtgtggttagcttttcggctattagcataaaaggggttaaaataattcgaataagtttaaataccaaacgcatatattgaccacctaaaaattcaaataaaaattgttgcacattatgtcataaccactgctagataatgtagtcacaagatatctgcccagagggcggacatctaatttgtacggcggcaaggaaagaagaggtatttttggcgtgttttgtagcaacgccaccttttgagatggaggaaagcattttcgacgaaatgcctcagtttatacagcgcttgatcataatatcttggcgtctcccggttcttctttggaggaataacaacctccactccccgtttttccgcctgttcaataatggcattactgtcatgccacgatctgctagcagatgatctgcatccatcccttcgatcaagcggccaacttgcgggcaatcagcagtggtaccttgtgtaacaaggattctgagcggcataccatgcgcatccacggccagatgtatcttggtgttgagccccctttcgcccgattcatctcctgattatctcctctggccccactggcatgtgggtgaaccttgccgtgactggtatctatcatcagccattcataatccggatcatccatcaggatttccagcagtttttcccagatacccttgtcacgccagcgaataaagcgacggtgggtattactccaccccccgtagtccggcggcaaatcccgccacggggctcctgttcgcataacccagaaaacagcattgataaaccgacgattatctgtggctatccctccccatgccccttctctacctggtaaatgcccctcaagtagcgaccataccttatctgaaatatcatgcctgcgatgggatggtgtcatgcaaatctcctttaatttcttaaaaggatctcatatttcttatctcatgactacactatctagcattaagaaaccattttagaatcaagtgaatgctcgaaaaccctgattaaggaacccgatagctttgtgaccaaaccctaatgggtagccctatggctggtttctgtcgagaggaatgaggtcaaaactcgggcaaaaatttaacttttagcctgcgcgcgaacaactagcgtatcaacccttccttctgcatggtttcgataactgctgggcgcgcagcgatgcgggtcatataatccgtgagtgctggccacttactcatatcgacctgatgaaacttggtccaacttagtgtcgtaaacaggtacgcatccgcaatggtgaacaggtcacccagcaaatattgcttaccatcaagctgatcggctaaaaaattacagtgcttgctgaaggtggcaagttgagcagccttccattctggcgtaatgttgggatgaaaaagtgcacccagtgttttgtggatctccgttgcgatgaaatttagccattccatcaaccgataacgctccatgctgccaaacttcggcgctaatttagcatccggcttttcatcagcaatgtattgcaacagtacagcgacttcgctcagaatctcgccgttgtcgagtttaagggtgggtacataaccattgggattgatcttggtgaagtcttcaccgtgttcagtctgcttgctggcgagatctactttctccagttcaaagttaagacctgcttcacgtaacgcgatgtgaggggccaaagaacagctgcccggtgcataatatagtttcataatagtctccattggtcagaattgtgattgacggacaattctggattttgtcgcattatgcgcaaaaatgtatctttagggtgggctgacatgccgtcactttaagcgagacatggttgaataaactgggcttagcgtcgagaatatagtctgtgaggcacgatgctgagaaattttacctgtaaaaaaacaatcccctatcagcacaacgaagtccgtcgtcttaagatcaaaaaatctcgttatcaagtgacaaactgatacaagtataacaacggattacggcgatggggtgatatcccgatttgatttacgaaggcagcaatcgctgagtggcaccccgtgaaaacggcagctcacggtaggtaatacctgccgcgaaaaacaaaagcatggatgagtgcatctgcactcaacaaaatggctaagccaggtgtgccggagtctataaaaatctagaaattaacgagcgaatgagcacttgagctcaaatcttgatttattccaccaccctaacgtttcaggcaatttaaacgggtagaaaatcttaagcatccacattaatccattttctgtgtaccagtaatttttcaatttccaccacaaacaacaccaacgacgataatgcgaaacccacgattgggcaccttgaataacccgaggttttcagtaaatccggtcgcgaaatgatgagtgcgattgaattcgattcaatttccatgacaaatcaccgcttttcctggcgatgttgcgccgtttttaccctgaatcgccccgggcattggcgatttggcccatttcgggtatcaaaaggccttgattcctgtctctctgaagtagaccaatcgcttcaggttgtagtagaccgccatcatcgtcatcgcaaagttggatggaatacacccaatacttccagcacaataaaaagggagctttgctttgcctgaaggccagggtcagtttacaaacggtttcatggttatccatggcaatcagcccgagcttttgcggcagttgctggtgcactggttcaaggtacattcgctagatccactggaagatgaaatcattcttgtgcaaagcaacgggattgctcaatggctcaagctcgcgctggcagcaaatacaacagatactcccggcagtggttgtggtattgcggcagcactcgatatgctgctgcccgcccgctttatctggcgggtttatcgggccgtgctggggcctgatgctgtgccggacatctccccatttgataaaccgctgctcatctggcgcttgatgcgtctcctgccagacgttatcccccttccgggttatgaacccttggcacgttttctggaacaggacagtgatcttcgcaagcgctaccagctggctgaaaaaattgccgaccttttcgatcagtaccaggtctatcgtgccgattggctcgccgcctgggccagaggggaacatgtactgtacaacactcaccatattgctcgcccgctcgatgcgactcactgttggcaggctatgctgtggcgcgctttacttgaagacgtgggagtcgccagccagagcagccgggcagttgtgcatcagcgttttctggatgccgccaagaaactgaaaaaccggcctgacgggctgcctcgtcgtgtttctgtatttggtctgtcttcactgccgcgtcagtcgctggaagtattactggccatctcgcctgtcacgcagattcttttgtgcgtccacaatccctgtgagcattattgggccaatcttctctctgaaaaagaccacgcccggcgaacctcaaaccggcatgctcataaaaacaatacacctgcaactatcacggaagatgctttgcatctgtatgcccatccattactagctgcgtggggaaagcagggccgtgattacattgccctgctggatgagctggatgaacctgatgcctaccgcgcccgatttgaacaagtcggcgagcggattgatctgtttcagagccatggagaatcaacgctgctgaaccagttgcaggacgatatccgcctgctgcgaacggtggatgaatcacgcgatacctggccggcaatcgaccctgccagcgatcgctcaattcgctttcatcgcgcgcacagcgtacagcgcgaggttgaaattctgcatgatcaactgctggcagcattcaatgcagatgcaacactgcggccgcgtgatgttatcgtgatggtgcctgatgtaaatgcctatgcaccctatattgaagcagtttttggacaagttgagcattctgatgcgcgttatattccattttcaatggctgatctcacgcaacgccagcaagcgccacttatatttgccctggaatttttgctggatgtgccagaatcacgcttgactgtcagtgacctgctcgatctgcttaacgttccggctgtcagacagtgtttcgggatcggcattaatgatttgccacgcctgcatcaatggatcagacaaaccaacatccgctgggggttgagtgcccgccatcgcgcgaaatttattcaggaaagtcttgagcaaaatacatgggcgcaagggctcaagcgtatgttattgggctatgccgtcggctgtgatcccaccggacgcgaagattacagttggcgtgacattgaaccctatggtgaggtttcagggctggaagccgcgctgactggctccttgtcccggttgctgatccaacttgaaacacttaccgaaacctttgcggagcctgccacacctgccatttggggccagcggttgcaattcctgcttcagggctttttcaagagcgagacagcagaagacacagccctgcttttgcagttgcaaaccagcttgcatgcctggcttgaagcttgtacagccgccagttttaccgaaatgatcccgctggctgttatccgtgaacactggctggcccagattgatcagcctaacctggcgcaacgcttcatggccggcgaactgacctttgcaaccttgatgccaatgcgtgctattccgttccggatggtctgcctgctcggcatgaatgatggtgaatttccccgtacccacccacccgtcgattttgatctgatggcacgggatatacgcccgggcgatcgttcccgccgggaagatgatcgttatctgtttctggaagcgctgctctccgctcgggagaaactgcatatcagctgggtgggcaaaagcatactggataattccgatctaccgccatccgtactggtcagccagttgcgggatcacatcgcagcctgctggcaattggcggattccccggacaacgatctgctggctgccctgacggttgaacacaagttgcaagctttcagccaggattattttggcaaagatccggccacctcagcgttgttcacctatgcgcgcgaatgggagcgcaaacttatcagtccagcgactccagctgctacggagcctcctttgtcattgcctgttttcaatagccctgtctcgctcggacagctgatcgcctttttgaaagatcccgtcaaaaccttctgccgtgaacggctgggtatttattacgaaatggatgacctgaccagcgaagatcacgagcctttcattctggatggactggaacagtggtcactccaggatcaattgattcaggctcgactagatgctgtcaatcatgaaaatgacgaaacagccgcagtggaacaacaactggatcgcgcccggcgacgaggtgagctgccgcttggcggaatggcggatttgctgaaagcaaccctggccgatcctttggacaaaatgtttaagtgttatcgcgaagcgattgccagttggccatttccgctggaagaccaggcatttgagtatccatacgtcaccactaatggtctggcaatcactgtgcaggggcgcatcacacagcgctactgtatgcatgatgcaagcaacacgagcaatacaagtaatggtgataaatactgccggatcgaactgagttccagcgatttgctgaaaaataacaaatgccgtcatgacaaactgcttgctgcctggatattccacctggccgcacatctcgatggccagccgatcacaacacggatcattggcaaaaatgatccggtacaaattaatccactgacgccgaatctcgccaggcagtacttcaacatgattattgaagcctacgttaacggcttgtgtacgccactgccactggcgcccaaaaccggttttgcctggctggaaaaagaaggaacaccttttaacggctctcttgcggcatgtaagcaaaaggctgttggcactgcccgcagccaatatgaagatggctaccagcgtactggtgaagccagtcagagcacctatctgcagcgattttatccagcctttgcacaactgtggtcaaacggccgctttacgcagctttgtgatgatctgtacgcgccgttgatgcaccatgccggcacacttgaggtaaatgccaaaaatccggaataagggccagtacacaccatgagccagaacatcacaccacttgatctctttaccctccctttgaccgggagccatctgatcgaagccagcgccggtactggcaaaactttcactatcgccatgctctatgttcgcctgatcctgggacatcagggggaatttgccttttccggtggcgcattgacacccccagaaattctggtggtaacttttacggaggccgccaccaaggaactacgcgatcggattcgcgcacgtctgacagaagccgcccgcctctttcgagttgacccgacaaatgcgcaatcactgaacgatactgatccgctgcagcagttgctctttgaatactcacctgccgaatggactgcctgcgcccgcaaactggaactggcagctgaatggatggatgaggcagccatctcgaccattcatggctggtgcaaccggatgctgcgggaacatgcctttgatagccaaagtctctttacccaggagctagaaactgatcaaacagaattacgggcagaagtggtacgggactattggcggattttttgctacccgcttaccctggaagagattgtccggattaatggttattggaaaagccctaccgaactggaaaaggctgtcacccccctgctcgattatgtgaatcaattgcctgatttatctgctacggatccatcggccattatcagtgtcagccaggaaaacaaacagaatctactgaccaagctcaaacaaccttgggcactctgggcagatgaattacaggtgctgtttgatgctgctgaggcagccggccagattgatgggcgcaaactgcgtgctgactggtacaccaattggttgaataagctgagagattgggccaatgatcccgccatggatagcgtagacattggtaagggttgggagcgtttgacgccggaagggatcacgaaagcatggaaaaaaggtacctccccccatcatcccgcattcgatgcaattcctgtgctaaaggaagcacttgataacctgcccgatcccaggattgaactgctaagccatgccgcccgctggattgccggaaaatttgacaccattcggaaacaccgcgcccagatcggtttcaatgatctgctgaccggccttgaaaccgccctcaccggcctttatggcgagcggctggctcaagtcattcgccagcaatttccggttacgctcattgatgaatttcaggataccgatcctgttcagtaccggatttttgaacatatttatgagatttccggcaatcgaaatgattgtgcgctcatcctgatcggtgatcccaagcaggcaatctacgctttccggggagcagatattcatacctatctcaaggcccggagagcagttgagggacgactttacacactgaatacaaatttccgctcaacccaagcgatggttaatgctgtcaatcattgctttgcatctgttgaaaaccaggcggattctcgcggcgcattcctgttcagaaccggagacggtaaccccgtgcctttcctggaagttcaggccaatggccgcagggatacattccagattgagggaaagacattgcccgccatgctgctggctgtttcagcccaacagatagaactctcaaacaccgattacattgagcagatgtctgccctctgtgcaacccggatcgttgactggttgaacgatgggaaatctgcaaaggccgggtttgccagccaggacatgcctttccgggcagtcaggccaggggatatagccattctggtcaataacggaaatgaagccgccaacatccgccaggctttgctgcgacggggcgtccgttcagtgtatttgtccgataaggacacggtttatgccacccgtcaggcaaccgaagtccatcgctggctagccgcctgtgctgaacctgacaacgatcgcctgctacgcgctgcgctgtccaccacatcgctgggcctcacactagcagagcttgatgctctcaatacggatgaagcggcgtgggaagcccgggtgattcaattcaagggctatcgcgagttatggcaaaagcagggagtgctcccgatgctgcgccgcatcctgattgattttaaatgcggcgatcgcctgcttgcgctcaaggagaatctcaacggccagagcggagaacgcatcctgactgacctgcttcatctggcagaaatattacagcaggcaagctttacgctggagggtgaacatgcgttgatccgttttctggccgagcaaattgctgcccccgagggggaaacagatagcaaaaaacttcgtctggaaagcgatagcgacctggtgaaagttgtcaccattcataaatcaaaggggcttgaatatccgctggttttcttaccgttcatctgcacaacccggcctatcaaaaatagtgatatcccgctcaaatggcacgacgatcagggcacattaaaaatttcccttgctgctcaccccgaaatcatggcacgtgccgatctggaacgcctccgtgaagacgtacgcaagctttatgtggcattgacgcgtgcctgctatctgacctggatgggtttggcacccatcaagaacaagtcaagcgcggttggtcatttgttcagattgaaagctaccccggctgaacaatatcttgacgctctccagtcttttgtacaggaacaccctgatttctgcatgacggacaaaccggacaacaatcttgagcaatacgttgcagaaacccgatctgccccgccgggtgaggcttgccgcccgctgcgggtggtgagagaaaactggcgcatcagcagttattcggcgcttcgggttgatggtaatgttccatccacgcgaatagctcgggaagatacaccgcaggcagaaaatctcctggaagagcaactcgaacgctcattcatctcactacagcctgtttcagaacaaccggcaagcgtgaccattcatcattttttcaaaggagctgaagcgggcatctttctgcatgaactgatggaatgggtcgccaacaccggctttactattgtatcgagtgatgaaaccgacttgcgcgacaccattgagcgtcgttgcaagatgcgccactgggaaacctgggttgcaccacttgttgactgggtcaagcgcatgctgtccacatccctgccgtttggctcaattggaatttgcctcaatacgctgactgttgttaaagccgaaatggaattctgggctggagccagcaacgtcgatctgactctgctggatgccgccgtgatcgaacagacactggcaagtcgcccgcgtccgcatctgacgcagagtgagttaaacggaatgctcaagggttttatcgatctggtttttcaatatgatgggcgctattacgttgcggattacaagtcaaactggctcggtgccacagatcaggattacactgtggctgccatggacgaggtgattcgtgccaaccgttacgatctgcaatacgtcatttatctgtttgccttgcatcggctccttaaatcccgtctgcccgattacaattacgaacaacatgtgggcggtgccgcttgcctcttcgtgcgcgggattgatgcacccacagccggtgtccattttgaacgccccccgggaacgttaatggacacgctggatgagctatttgccgggaagacagaaggtagcgcatgagcactccagcaacaaacccgcaggaaatactggctctgctggaaagctgggttacccgtggctggctgcgcgagctggatcttgccttggtacgttttttaaaaactgaagttcctgctatggatccggtattgatgctggcaaccgctctggtcagtcaccaactgggacgaggtcatgtttgtctggatctggacaatatcttaagcgatccttgtacggcgttgtcgttgccctctggccagaatgaaccctctgccagaaaagaaattcagcatatcagcgttcttctggcggactggaaaacatccggctggtttatgcaaccacaaacggaactgatcagtaagggtgagaggaatacgccgctggtgcttgctggccctcgtctgtatctgcgccgctactggcgttatgaacgtcaggtggaagctgctatctaccagcggctgaccagtagtcagcagattgtcagccagttgcctgaaattgagttcaaagacaaactgaatgcactttttccacccagcggtaccacgtatacacaaacagactggcaaaaaatcgcttgtgcacttgctgcccgcagtgcattcagtatcatcaccggcgggccaggaaccggaaaaacgaccactgtagttcgtctgctggcactgctgcaatcgattgcgctcatccagcatccggaatgcctccttaaaatctgcctggccgcccctactggcaaggcagcagcacgcctcaaggaatccattaccggcgccatcgacaagctgcccgcttttattcaggacgataccacgctgaaaacgagcatcccaagcaacgtgacaaccctgcaccgtttgctgggctcgcgtccggattcccggctgttccggcatgatgcacgccacccgttgccactggatgtactggtgattgatgagggctccatgattgatctggaaatgatggcagccgtactccttgccttgccccctcacgctcgcctggttatcctgggagacaaggatcaactggcttctgttgaagcaggttctgtgctgggtgccttgtgccaccgggctcagcaagggcatttccagcctgaaactgcccaatgggttgaaacggccaccggagaaaagattgatcccgttctgctggatacaaacggcttgccacttgaccagcatattgtgatgttgcggacaaactggcgatttgatgctgccagcggcatcgggcaactggcccgtgcagtcaatactgctgattcggaaaccattcgcacaatctggacgcaaggctatgatgacttgttccgtcataatttacctgatctcgaagatagccgcctggcaaccatcctgctcggccaatctggagaaaaagatacaccgcaaggaattgcgggttatctgggcatcattaaagcagagcggccaccactggatgcagaaaaagttgcatttgatgcctgggcgcatcaggtgttgcaatcgcacggccgttttcagttgctgtgtgcgctcagaaatggcccatttggggtcagcggcatgaatcagcatattgaagcactgctggccagacaccagttgattaaacctggcagcatctggtatgaagggcgcccggtactggtcacccgcaatgattatgcgcttggtttgatgaacggggacatcgggatagcgctcagctatcccacgcctaacaggacaaccggaaaactggaatggggtatacgggttgcctttgccagaggaaatggcagcggtggtattcactgggtgctgcccagtcgtctcttgtcaatcgaaactgtttttgcactgactgttcacaaatcacaaggctcggaatttgagcattgtgccctgctgctaccacccgaactgaatcccgttctgacacgagagttgatctataccggcatcacccggggaaaacgctggttatccatcatttgtaccggaaacagcaatattattgatcaagccgtttccagaacggtccagcgctccggcggattgtttgccggatcatcctgatcaggagcggctggtacgctaactcaataaaaactgcttcaacactttgatcatatattcgtgatcctgcacgcccgcgctctcccggatgctgtgcatggcccacatcgggcaaccgatatcaatactgcgtatacccagtttggctgaagtcattggcccgattgtgctgccacaaggtaaatctgagcggtgtgaatagcgctgataaggtacatccgctgcttcacaccagtgaatgaaatgagcggcagaaatactttctgagctatagcggtgattggcattgaatttgattaccggcccctggttcacggataccttgtgatctgcatcataagccgagggaaagttggggtgataggcatgtgccatatctgcgctgatgagaaaactctgcgctagtgcacgcgcagcatcttcgtgatctggagaagtggccaggctgatccgctgtaacaaatctgtcaagaaactgccgcccgcaccaatatggctttcactgccaatttcttcatgatcaaaaaatgcgcaaacaagcgtatttgcggcatggttaagcgcagtatcatccagcattgcctgtaatccggcatgacaggacgccagattatcaatctggctattggtataaaactcctggtttgccccccagaatgcccctttctgtgtatcgtaaacagccaaatcccaggacaggatttgtgaagcaccaattcctgtcatctgttccagcagcgccaaaaaacaggattgcggcagttgatcgttggttaattgcgcaaggaatggcaacaattcattctgtttgtgcagcttcaatccttcttcattgacgccccggttcatgtgaattgccaggttcggtatgcgcagcaaaggatgatcaatacgcactaatttatgtgcaagatgtccctgcccgtaggaataactgacgcgcccggccaggcttagatcacgatcagcaaaagtggcgagaatggggccgccataaacttcaacccccaaccggacaataccatcactggcagttgcggcattgggtctgattcgcaatccgggagaatcggtatgtgcgccgataattctgaatccagattctgccggtggtgtctgtcccggtacgaataatataattgaggaatcatctcgcaccacatagtagcgcctgcccggatgtaactgccatctggctgtttcatcaagccggatgaattgaaatttttcgatctctgcttcgatcgaagcaacggcatgccatgggcttggacttttgtcgataaaatccagcagattctgcacatacgtttgagctatcatgatctctgtttttaaagggaagttataaaattacaatatgttgttggcttgcacctgaaacaatgtccgggttcaggcgcgaatcgaagctgacaaaacggcaatgatggcgtacagcgagccccagcaaataactgtcaataatttgccaatgaccaagcatttgttgccagtttacttgttctgcatccagcagactgtaatcatctgctacaaatgcatgggttggatgcgctatagcctgtgctaatcggctggccacagcagccagtgacaatgcttccggataggccggctgagtcatgatgcgcagacacccgttttgggtgagcggacaagaagcccaaccgtggatgatctcctgctccagccattgactggcacgaacatgatggacatggcccgcatcaagcagggcaatcaacacgttgacgtcaagcaaagcgcgcatcaaataccttcttcatcacgcaggcgattaataagttcgttgctgacaattacgccacgcgatggaaatggccgaaaaccggttacagaagaggcatcgtcaggagaagatacttcggcaacatggccagccagagcctggcgcacaagacgtgatataactttgccaacgcttacattttccgtacgggcaatttcctttgcggcggcaagaacatcgttctcaatatctatcgtggtacgcacaataaactcctttgactgatgcagatacatcatgatgttatcacaccatgcgatcatgccacccaatcctgggagtgcaggctgttatttgcttctttcgaagtgcagtatgacgctgagtcccccaacaggatggttttcaatcaataattcaccgccatatacctgcatgatgtcgcgtactatggccaagccaataccgtggccagaggtggattggtcggcacgcgcaccacgttccagaatgcgggcgatttcatgcggtgggataccggggccgtcatccctgatttgaatttctacttgatttccctgataaccggcagataaatgaatgctgtaacggcaccacttgaatgcattgtcgatcaagttcccaagcagttccatcagatcgccttcgtcaatgcgcagacggatgctgttatcaatgttcactgtaatatccggatgcttgtggcgataggctttggtcaccgtgttgatgattctgtcgatcatcgggcgtaacaagatcaaccccatgcctggtgagctgccggcagtcgcggcacggcgtaattgatactggatggtgttatccatgcggtcgatttgctcttgaattgttttgtgccggatgacctcctcgtcctcaccatgaatcgcgccttgcagtatagcaagtggtgttttcagactgtgcgccagatcagcaagaccgttgcgatagcgcttctgctgcttgtgttcatgggtaatcagggaattaatgctgtcagtcagcagtttaagctctctgggatagatacccttgaggctttcctgtcgaccggattcaattgcggcaagctccacggaaactttgcgtaatggcagcagcccccagcgtaataccagcatttgtgcagcaagcagaactactgccatgacacccaaccaaccccatagatcttcacgataacgttctatctgggcatcaagcagcgtggtatcggttatgacgttgaaagtcagcgggtaatcgccagagggggtttcccaagcaatgccgtagcgatagataaagtgtggttcgtcattgagcaggatctgctcaaatattttttctccctgtcccagtggggcaatagccggaatagatttattcaatgacgagatggaacaccaaatgatcgtgttggcagggccgatgatgaaggcataagtatgcgagttgacgtgttcaaattccacatccagctgattgacaggcacatccagttcgccgtcttccacttcggcatcacccatcagcattaacagttttgcaaataggcgatccttcacccctatgcgtgcactgtcgtagaaagcgcgatccaatgtaaacgtaatgccgccaataaaaaccagtaataccagcgttgcactgagcaggacacgctgattgagcgacatcatgccgatttattacattccagtatgaaacggtagccacgcccacgcatggtttcaattggctttaatgtaccagcgggatcaagtttgcgccgcaacctgccaatcatgacctcaagcacattgctgtctcgatcttcgtcatgtggataaagggcgtctgcaagtatttgtttagaaagcacttcaccacgatgacgcaccagttcttccagcaagcggtattcaaatgaggttaattcaatatttacaccattgatggaaacctgttgtgctgtcatatccaccgcgatagggccgcattccagcaaggtctgcgggatgccgttggcacggcgcaataatgctttgacccgggcttgcagttcttccatttgaaatggcttggtcaggtaatcatccgcacccgtttccaggccgcgcaccttgtcttgccaactgctgcgcgcggtcagaatcaaaattggcaggagactgccccgctgtcgcagtgccttgattacatccagaccggatttaccggacaggccaatatcgataatggcggcattcaaacggtattccgtagcgagaaacaacccttcttcgccattgttgcaagtatcaaccatgtaacctgctgcttccagttgctgacgaatctggttttgcaaaaggaattcatcttcgataaccagaatgcgcattcaagcctcttgtctcacagggtgacaataaaatgcgttgaattgaatcatgaaatttactttgaagattaatgcgtggatacaaccgcgccattctgtgcattgatcagaacggtatgcactatgccctggtcactcagtattttaatgcggtagagattatcagttcggttgattgccagcacacgtcccctgaaatgttgttgtgcgatggcgattgctcgctgttccgaaatgccgtttgctgaactgcctgctttgctgcgctcactggctgtattaggtcggctggcggtggtgtcggatattgcagcgatcatgattagcacaaccaataacgcttgctgccatccattcataaacccttatccttgcacgccgataattaaaatcaggcggaagcagaataagtttttaatttagatctgcctctcgcctttcgcatcagaaacgtaacataaaatccacattcccggcactgatccccatattcattcggggtggtacaacatataccggagccggggggtaatagttgtaattgtaattatattgtgattgcgggtagtgttgctgataatagacaggcggctgactatagatgtgcatatgcccgttagagtgccggtgatgatcatgatcatgatggtgatggtggtggtggtggtgcttatgcttatggcgcttatgcttatgatgggaatggccatgatgtcctctatcagcgtgcgccaaggagggtgttgccagactggcagtcaataatgtggttagtgccagaccaatcagttttttggttttgacgttcatgatatttctccttggtattattcttttcaggttgattcctgatgctaccaatgttaggacacccagcctgaacccaagctgaataggaaaacccactacccgaccgttgttcaattagtgtaatttctatcgttttaagcatggcaccccactggaatcacaatctggtttttcccggtttttgagggcaccgtgaaccagatcacacatctgagaggcgttaaaaccaggtgtaataatttagtgattcgagatatcaggtttgcacgttaacttttcgaaactcgatagcatggtaatgaaaatatacacagaggttctgtcattctggttccaggaaatcaaggaaaaactctggttttctgctgatgcaaactttgatgaactgattcgccagcgtttctccagtttgattcagcaggctgctgctgccgagttgttttcatggcggacgactgcgacaggccgtcttgctgaaatcatcgtgctggatcaattttcgcgtaatgcctatcgtgatacaccacaggcatttgcccaggatcccatggcattggcgcttgcccaggaagctgtcgcttccggcgcactgcagtcattgaatcagaagcaacgcggtttcctgttgctgccttatatgcacagtgaatcgcggcagatacatgtcgtggcagcagcactccataaggattttgcctcggcaaaaagctattactacgaacagcgacacaaagccatcattgaccattttggccgctacccgcacagaaataaaattctgggacgaatttccacgccggaagaacaagcgtttctgaagcagccactctcacatttccattaaggagcctgtaaaaaactacctgtgctgccatttctgcgtttaaagtttgctcaaaagcttccattcttttgctaactttgtccttgaactgcctataagcgttaggcaactggaaacattctgaataatcagttttacagatgatccagcgggctgatcacacctttgccacctttgttcagtacatgggtataaatcattgtggtggcaacatcactatgccccaatagctcttgcactgtacgaatatcatagccagcttgtaaaagatgcgtggcaaaggaatggcgcagggtatgtggtgtagctggcttggtcactcccgctgccagcactgccttcttcatcgcacgctgcagcaatttttcatccatatgatgacgtcgctctacaccactgcgcggatcaactgaatagctcttggcaacaaaaatatactgccaaatccagtcagtcgccgcctttggatattttcgctccagtgcatccggtaaatacactgcggccatatctttggccagatcatcctcgtagagcaatcgccggtgtcgtatatgctcattcaaaaccgggatcaaactttgcggcaacattgttacccgatcttttgcccccttgccatcgcgcaccagtatttcagctcgctcaaaatccacatctttaacccgcaaacgtacacattccattaaccgcataccggtgccatacagcaagcgcgccattaagccatgtgctcctgtcatccgacccaacaccgcatgtatctcattatgcgtcagcaccactggcaaacgtgccggccgctttgctcgcaccacgttgtcaagccagggcaaatcgatttccagcacttcccgatataaaaacagcaaagctgaaagtgcctgattctgcgttgatgccgccaccctgcccgatacagcaagatgtgtcaaaaaagcctccacctccccggcccccatctcctgtggatgccgtttatcatgaaataaaatgaagcgccgtacccactggacatattgcacctcagtccttatgctgtaatgctttaaacgcagcttgtcacgaagctgatcaagtaacttaggtgaagtcggcgcatgagatggtggcattttattcatacttcttttaaattcattgtgttatcaaataataaatttgttatacaccttcttgtgaagaagtatacaccgcttgcggtgtatactgaacgttagcggttgagcagtgagccaccgtacgcctcgttttactaattacagcaaggaattgcagtgacattattaggagcctcaatgggcagcccagaacagcaaagcctacttgacccgctcacgggggagctgctccagaaaaaaaccgcggtgcgttctgctcggtctggaacatttacagacaatatgaaactgcctgttcatagatggtatcgctactctgcgggattttctgccgagtgggccgaacaactcatccgccaacactccccatcatcagttctcgatccatttgctgggtcgggcacaacgctgcttgctgctgaggccgcaggtgtattggcctatggttatgagagccatccatttgtagcgcggatagcaactgcaaaaactcactggaaccaagcagaggggaagctgttagaagcgaccaaagaattactaaacactgccactcaaagccagcctcctgacgtgggggctattcctgatcttctggtgaagtgctacacgcccgaagtgttgcaacgactttattctcttcgtgatgcgtatctttcttgctctgatcgatttgatcctgaagtttctaagctactatggctggcacttactgcgatccttcgatcatgcagctttgttggaacggcacaatggcaatacgtccttcccaacaagcgcaagtcgaaatcgttagacccgttcctagctttcgagcaaaagatttctgatatggtcgaagatatgcgggttttacgaaacacgggttgtcgtagtgatgcaaagatactttttcacgatgcccgcttcgtaccagatgatgttcccgtcaacagcgttgatctagtagtcacatctccaccttatccaaacaactatgactatgctgatgcgacccggcttgaaatgacattctggggagagattcgtggatggggcgacctgcaagaggtcgtgcgccaattcattattcgatcttgctcccagcatgccacagctgagaaactccaattagatacattgctggctgattcttctatagattccattcgcgaagaactatcaagtgtgtgccatgaacttgccgaggtcagacaaacaaagggtggaaagaaggcatatcacactatgattgcggcctatttctgtgatttatcaaaagtgtttcaggcattgcgccctgtatgcaaaacgggaagcacggtttgttttgttattggcgattcagccccttatggcgtatacgtgccagttgacgactggcttggaaggttggctattgcagcaggatttaagtcattttcatttgaaaaactcagagatagaaatgtcaagtggaagaaccgcaagcacagggttcctctgtttgaaggtcgtctttggattaaggggtagcaatggctaattcaccatctcatcgtttcggtcaaataattggagatttgctggaagaaataatgaccccacagtttcagtcgttctgcgacgaacgcggtctatttttagacaaaaagggaacgcgggggaaagcacgaaccggaaagaaggtttcatggatagataaatatggcaatagccatgatctcgactttgtcattgaaaaaggtggcagtgaaaacgttcttggacggccattggcgtttattgaggcggcttggcgacgctacacaaaacactcgcgcaataaggctcaagaaatccaaggggcaatcttgccaatcgctgaacaatacgattgggacagaccttttctgggcgttattctcgctggtgttttcaccaatggctctctcacgcaaatgagaacttctggttttgaagtggcgttgttcccatatgacagtatcgtcgctgcgttcgcggcggttggtattgatgccaaatttgacgaagaaacgccagacgctgtttttcagaatacgatcgatcaaatcgactccctcactccgcagagtcgtgcaaatttgaaacagcgccttgttcaaagtaatcaagctttacttgaccaatttttcgctgagttacaggcgacacttgataggcaaattgagcagattattctcattccactgcatgggcagcagagcgagttcggaaccattgcagacgcaattacattcgtaacaagttatcgggaagatgagttgcgtgacggtggcttcaggaaatatgaaattattgttcgctacaccaataacgacaaaattgacgcttccttccaagataaagaaaaggcaatagcttttctgcgctacgtcgggcaaggtgcttcctagtaaactcggagattgacacggtgattggatgtactggaccgttccgagaaagaaccgctaacaaatcattcaagccgacgccgcttcgcggcgcggcttaattcaggcgttaggcgccacaggattcgaggcatgtcaaagcaacagacggagcggcagcgttacttgggttttggtatcagcattggcgttgccattgggtgtggcctcggaataatctttggcaatctcgctctaggtatcggcccgggtattgcgatcggcgccctgtttgggattgcgttgggcaaaaagcacgcagccaaatctggcaccggcagcagcggggacgatgctggcggcgtctaacatttcgttcgaggcggacggcttcgccgccgctcaactccagcgttagatgttctcgttgctcacacactctctgaaatgacaagactaattctttttgtaagattgttttaacctatcgaaaagctttgatcttggagtgtgaaatgaagagctggattttcttatgtgcggcaataatttttgaagttgtggcgacagctagtcttaaatccagtgaagggtttacaaagttcacaccgtctttactcgttgtttttggctatggtatggcgttctactttctttctcttacactcaagtcaataccgataggcgtcgcttatgctgtttggtctgggcttgggattgtcttgatttcgttagtagcatggctgttgcatggtcaaaggcttgatctttgggggcttgttggtatgacgctaataattagcggtgttgttgtattaaacttactttccaaagcaagcgtacattaaaggcgtcgcacacatctaacaagtcgttcaagccgaccgcgctacgcgcagcggcttaactccagcgttaggcagtaagcctgaattagggaataatttaaaaggagagccaaaatgaaaattcttatggtgctgacatcccacgatcagcttggggatacgggaaacaaaaccggcttctggcttgaggagtttgcaaccccttactatatattcaaggatgcaaatgcagatgtcacactagcctcgccagatggcggacaaccgcccctagatccgaagagtgatgaacctgattttcaaacagaagcaaccaaacgtttcaagtgcgactctgatgctcaaacagcattggcaaatacattaaaactatcagaaatttcaccagagaactatgatgcagtgttttatcctggtggtcatggcccactatgggatttggtggaagaccgcaactctataaacctgatcgaatccatgatctcatctggaaagcaagtcgccgcagtctgtcatgcgcctgccgtactccgtcacgtgaaggctcctgatggctcccctttaatacgaggcagatccgtgactgggtttagcaacacagaggaagaagccgtccaactagccgatgttgtacctttcctgctggaagaagaattaaaagcgaaaggtgcaaattattcaaaagctgaagattggaatccatattcagttactgacggtaccttgataacaggtcaaaatcctgcatcatcaggtctagtggctaaagcattattggagaaacttaagcgataactgcctaacaagtcgttgaagctgacagttcaaagcgtcatgcttttggcaacaagcagccaaaagcacgccgctttgccctgcagcttaactctgcgttagatgttctcgttgctcacacactctctgaaatgacaagactaattctttttgtaagattgttttaacctatcgaaaagctttgatcttggagtgtgaaatgaagagctggattttcttatgtgcggcaataatttttgaagttgtggcgacagctagtcttaaatccagtgaagggtttacaaagttcacaccgtctttactcgttgtttttggctatggtatggcgttctactttctttctcttacactcaagtcaataccgataggcgtcgcttatgctgtttggtctgggcttgggattgtcttgatttcgttagtagcatggctgttgcatggtcaaaggcttgatctttgggggcttgttggtatgacgctaataattagcggtattgttgtattaaacttactttccaaagcaagcgtacattaaaggcgtcgcacacatctaacaagtcgttcaagccgaccgcgctacgcgcagcggcttaactccagcgttagccaacacggagaaggttatggcactatttaggcttgctcaaaggacttctttggcgctgacgaagcagcccgaatccggcatgggatttcaagttgtccgctacaacggttcggggctaatggtattcaacgcgactattgctattccaattaatgagcttcggtctcggaaattcacggaagaagaatatttaagccttgcaggtgacccaaatgaggcactaggtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacaactagggactcggtttgaagagctcgagctcgataactttcaggttcaattttcaatcctcgatgctgaagtacgaacggatgattttgggctatcgttttcggagacctccgcagagccacctaatctagcagtcagatcaggagtgccgcattcgtactatcgcttttcgtcgttctatcgggataagcgagttgcaagcgacggttcgttcttgtgcggcacgtacgccacaacctacgcggatattcatcacgttccaagtggtttcgccgccgtaggaagatatgcgctaccgtgccctgcatctgctagatttattttccagatcgttacaacagaacggccatctttgatggggacagccacgcccaactttgggcaggcgggagggggcgtagaagttttattcaacgaaggcgcttcgccagcccctggctgcagcttccagataagtgttggctaacagttcgctgcagccgaccgtcatcccgctgcgcgggctgtcggcggctgagctcaggcgttaggctgcttccgtagtggttaaaaggagtcaaatgaaatacaaccggttaatttccgctggcttttcgataattgctttattggctctgcccttctttacagctacggcatttgctgcgggagcaatgcatccccttgacccgctcgatgaaagcgaaattgcgggtgcgatcaaagttttgcaggctgcatcaaatttccccaaaaccgcgctcttttcaaccgttcaactgaacgagccgcccaaaagtgaagttctgaatttcaaagccggcgccgcgttccgtcgagaagccttcgcgattattctcgaccgagaaaagaacagaacgtacgaagcgattgttgatctacgggccaataaagtcgtctcgtggaaagagatcgcgggcgtgcagccgctcatcttcttcagcgaatacgagactttacaagaaatcgtcaaagtggatgcgcgctggcaggcagcaatgcgtaaacgcggcatcacggatttcacacaggtggcggttgacggctggacggtcggacaggttgacccacgatttacaggtcggctgatgcgcggcctctcttatttgaaaggcgattccgcgaactattatggccgcccgattgaaggcgtcgtggctctcgtcaacatgaacacgcacaaggtggttgacttaacggataccggcgtcgtcccgatcacaccgagcagtcaggattttgacgaaaaatccatcggcaaactgcgcgaaagaccgagacctctcttgattacgcagcccgaaggcgccagctatcagatgaaccggcaagagattcgttggcagaaatggcatttccgctacaccatgcacccgcgcgaaggtctcgtcctgcacacggtcggctacgacgatgagggacgcgtccgcccagtcctttaccgcgcctctctttcggaaatggtcgtcccctacggcgacccggacgcaaactggcgttggcgggcggcgttcgatgtcggcgagtatagcgtcggccgcctggcgagcccgctcgaaccgaaactcgacgcgccggagaacgcgcaactcattgacgccaccttcgccgacgatttcggcaagccgtacactttagaaagagccgtcgccatttacgagcgcgacggcgggattttgtggaaacacttcgacaccgtttcagggaagaatgaaacgcgccgcgcgcgcgagctggtcatgtttttcgtcgccacaatcggcaactacgattatgccgtcaattacattttcaaacaggacggctcgctcgaagttgatttggctttgacgggcatcatgctcgccaaaggcgtcacccagaagcgcgccgacggagatcatgcgatgatgtcggacacggccgaacacctagtggccgaaaacatagtcgcgccgcaccaccaacattttttcagcttccggctggatttcgacgtggacgggacgcaaaactccgtgacggaaatgaacacctcggcgatgcccgcggggacgaacaacccgtacctgaacggcttcgtgatgcgtgagagcatctttaaaaccgaaacggaggcccggcgcaaaatggagatgcaggcggcgcgcgtctggacggtcacgaatttttccgccagaaacacactcggacatccgacgagttttattctggtgccgggcacaaattcattgccctacatcgcgcctgaatctctggtgagaaaacgtgcccaatttatcaacaatcatttctgggccacgcgctacaacccacaggagatctatgccgccggagcttatccgaatcaaagcaggggcagcgagggcttgccgcaattcgccgctaacaacgagacacttgaaaaccaggacgtggtcgtctggtacacgctcggcgtgacacacattccgcgcccggaagaatgggcggtaatgcctgtaacgcacgttggattcaaacttatccccggcggatttttcagccgcaacccggctttagatgtacctaagtagcaatgcaagaagatctttgggcgaagggggcgatcatagaagcggacgtggttctgttcaaagtcggcgcccaacaacggcatgcacccgaccgcgaataccggagccttcatccgccagaaaccatgcttgttgcgttataaatcgtcccgggtttcgtggaggctgtttggttaaagtcaagccaccggaatggcttccttggcgaattgcctatagtagtttacctcagcttctgcgggagggatgtaaccgattggttccagcagccgctggttgttgaaccaggctacccattccagcgttgccagctccacggcctccctggttttccaggggcgcgcttgtgaatcaattctgttttgtacagcccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggccccaaggccatccatccgccccggttgccgggcatacagcgcttgttccagggcatccagcacaaagttcgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaaccgatccagtggacacggcagcgccttgtccggaactgtggtgcgcacaaccttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccgctgtatctgcggcagcagttcatcatcacgcaggacgcgggcactgcgcaaagccggattacgctgtgatccgtccgcctttgaaactcgcatgtagccaatcagcacctattcctcttgtcacatatacgttcgattatggacagtgcgtaccggaaagtttagaccgccaaaatttgtcacttaacccgtcatttattctaaggaatgcaaagggttcatacggcttgtaatgtgacaaaaattcaaggggaatcccctcctttgcaaacgtgacacgcaagcgatccaaagactccaggccttgccgccaattctgttttctgaagcgacccacaaacgcctcaacttctgcgggtggcaagctcaagttttgattggtattcatcttcgccactcctgaaaaaccggcgttagcacgccgaggttgtaatcacggcacctgttgggccgcgtgcttcactctcaaaatctcgacggtgcgcgcatcgtccagcacgcgataaaaaacgatgtagttaggatacacgaccagctcgcgcaggaagtccggcaggccgggcctgccggtgtggccaattcttggatgctgcgcaagcggcaacaccttggcgcgcagctcctggccaaattcctcagccttgatcgggttgtcctgggcgatgtagtcaacgatgttgtctaagtcggcctcggcaatcggtcgccagacgatgctgtaagaagtcttaggcttcgtcataggtcagttagttggcctgctggctcatgcttacttcgctcctgcggccttgtggcgcgcaatgcgcgcatccatccgggccatgacttcatcatgctccacgctcggccgtggatcgtcgatggcctcctgaatctcggcggccagccactggttataggcggcggcttcatgcgcttggcgcatcgcttgggcgcggctatcccggttctgcgtgactactttctggtcggggttccagttggtcgcgtcgagccggacaacagcaataccaagatcgcgcaatacgattagcgcggaattcggactaccgaagcggcgcggctcggtgctgcgagccttcaccaaaaaagcgtcttgcccgctgcgggtggcaatctcaatgaagaaaccgctgccctgccctttcaaggtgacgccgacaacgccgccggcgcgagccgtggcacgtagctgctctagtgtcatgctttgcatgattcgctcctttataggttaagcgtgttttcctagccttgattgtgcataatctatggaagtcatgcaagtgtttttaagtcggcaaacggtcgtttttcggacagcaatctgggatttaaataaggctgataattttagaaccgtcgacagcgacggttgtcattttcatgaagacaattgcaccagttggtaggcacgagaaagttcaggccgttacgtctgctcagtaatgggtgctcctaccgcgatagctgtctcaacaagttcacaactgagttagttggggacatttaagcaaggctcaactcgcattaaatagtgaactcacagtgaaccgccccgggttttgaggaggctccaatatctgagaagatggagccatgaacaaatcaaataaatattccccgaagtaagagcgcgcgcagtccgtctggtgcaggaacaccgcagtgagtatccctcgttgtggtcgacgattgaatccatcgcgccgaagatcggctgttcagcccacacattgcttgaatgggtgcgcaaacacgaacgaaaccgataccggcttgcgagacggtgtgaccagcgaagagcgcgatcgcatcaaagccctggaacgcgaagtaaaggaattgcgcaaggcgaatgagattctgaagctggccagcgcttttttcgctcaggcggagctcgaccgcaaactcaaatcctgagatcgttcatcgaccagcaccgcgacgcccatggggtcgagccgatctgcaaggttttgcaggtcgcctcatcagggtatcggcgatattccgcgcagcagcgtaatccggctttgcgcagtgcccgcgtcctgcgtgatgatgaactgctgccgcagatacagcgggtctggcagaccaacatgcaggtctatggtgccgacaaggtctggcgtcagcttaagcgtgaagatgtccaggtggcacgctgtacggtcgaacggctcatgaaacggttagggctgaaaggcgccaggcgtggcaagattgtgcgcaccacagttccggacaaggcgctgccgtgtccactggatcgggttaaccggcaattcaaggcagatcgtccgaaccagttgtgggtgtcagacttcacctatgtctcgacctggcaaggctggctgtatgtggctttcgtcatcgatgtatttgcccggcgcattgtgggctggcaggtgagcagctccatgcgcacggactttgtgctggatgccctggaacaagcgctgtatgcccggcaaccggggcggatggatgccttggtacaccatagcgacagaggctcgcaatatgtctccattcgctataccgagcgactcgccgaagccggaatagaaccctcggtcggcagcaagggcgacagctacgacaacgcgctggcagaaaccatcaatgggctgtacaaaacagaattgattcacaagcgcgccccctggaaaaccagggaggccgtggagctggcaacgctggaatgggtagcctggttcaacaaccagcggctgctggaaccaatcgattacatccctcccgcagaagctgaggtaaactactataggcaattcgccaaggaagccattccggtggcttgactttaaccaaacagcctccacgaaacccgggacgattcatgctggcactggcccaagcacggcggaagaatgggctgatgtagaagcatacatgggcctcttcgagcactgcgaagtcatgcttagcgagaagctgattgacctaaagacattcaagtcgatctatgggtaccgcgtagccaatattttggaaaatgctatgattgttgaggagaagctcattgtccgtcgagaccattgggcgactttcctggctctcgtccgcagattgggtatgaatgaacctcaatctgctgcataaccaatcactcaagccgacaacgggcttgcgggtcttgcttcgttcacgctaaagtgtttccttgcctcgtacgaccgctgcgctgcccgttgcggcttagttcaaccgttaggccgcagtaattgacctactcacaccaggagtaacactatgtccagctctatccgtacttgtctctggttccgagacgggcgaggccgcgaagccgcagaattctactgctctctgatcccgggaagccgagtcgagaggaccttttctggcgatgccggaaatggccctttctcggtaattgatttctcgctcggcggggtgccttaccagattctcgacgctgggccgcatttcaccttaactgaggcagtatcgatttcggtcgaaacggccgatcaggccgagactgatcgactgtggaccgcgctgaccgcagatggtggcgaggaaagcgtctgcggctggctgaaagatcgctacggggtttcgtggcagattttcccgagaagactaacggaattgacgatgaatgcagacaagaatgtttctgccaaagcgatggcagccatgatgaagcaaaagaaaattgacatcgctgcaattgaagcagcagcagttcgtgactagaagtccgcggcctaaaattcattcaaggtttttactttgtgaggaatcgtcccataaatcatccctccgtagttggttatatgttacaccagcacaccgtgggactaaacatcctaagacccttaactaaatatcttttaataacttttaaattcatttttatcacaaattattttttgcaacagatctgaaaacatggcccagttcatcaacagcaaagaaagcatcgtcaccgaagccgtcgatggcctgatcgcggcgtctggcggtaagctggcgcggctcgacggctatccgcatatacgggtagttgtacgcaatggctgggacaagtccaaggtcgcgttgatttcgggaggtggatcgggccacgaaccggcacatgcgggtttcgtcggggaagggatgctgacggctgcagtgtgcggcgacatcttcgcctcgccgacagtcgatgcgatactggcaggcatccttgccgtgacgggatcgtccggttgcctgctcatcgtcaagaattataccggtgaccgattgaatttcgggctggcggctgagcgcgcgcgccagtttggcttgattgtcgagatagttatcgtcgacgatgatgtggcgttgccaggcttgctccaagcccgcggcgtcgctggcacgctttttgtccacaagatagccggtgcgttggccgagaatggtgccgacttggcgtacgtcgccgcggccgcacgcaaggttgtgtcaaagacaaaaagtattggcatgtcgctcagcacctgcaccaccccaggttcaccaaaggaagatcgcatcccgcccggcatggccgagcttgggcttggcattcacggtgaagccggagttgagcaggtcgagttcaagggcgcgagcgaagctgtcgctgccatggtcgagcacctgtcagttgcaatggaagaaaagccgcatgtcgctatggtcaacaatctcggcggcacgtcgatcatcgagatgtcgatcatcctcaacgaaattcggcggtcagcgattggcgagcggataacccacgtcatcgggccggcggccatgatgacatctctcgacatgcacggcttttcgatttcggtctatcctgccgacgataccgagatcgccctgctcaagcagcacacgccgctggcaacatggccgcgaatctcccggctgggccaggtcgctattcaggtgcttccggacggcctgacgcctgtcgttgcgatgccctcgaagcacaagccgaccagggagttcctgaccagatgctgcgaggttctgatcgccgctgagaacgacctcaatgcgctcgacgcgaagtcaggcgatggcgacaccggaagcacgctagccggcgcggcacgcgccctgatcagcgccatgggccgattgccgcttgccgaccatacccaactttatcgcgctattggcttggagctttccaaaaccatgggaggctcgttcggagtgctcctcgcgatcttcttcgccgcaacgggtgacgccgcgtcaagcggcttgccaatgtacgaagcgttgcaggccggactgcggagaatgcaggagatcggcggggcacgtccgggtgaccgcaccatggtcgatgcccttgcgccggctcttgatgccctggaagagagtctgtccgaagcggcgaaagccgcgcgtgcaggtgccgatcgcactgcccacatgagtgtggcgaatgttggtcgcgcttcctatgtcaatgccaagcattgggtcggtcacgctgatccaggtgctgaggcggtcgcgcgactgtttgaacacttggcctaattttaggtagtaagcatctatttaaaacatgtaatgaaaccacgtcactatcagatccgctgtcagacgaatgagattgttaacgtcccgggccaaaatcccttgcctgctatttcgaaggtggtactgctttctcatgagatctaatgcctgaattaagccgcgccacgaagcgacatcagcttattgccagccagtcacttcgtagcctttttcacgtaaacagcggtttacaaaattcatataggcagaagctggctgcgatgtaccggagccaaacacacctgacaataacccataagtagcaccactggcagcaccaaccatagcgccacgtccgggagcaccagcaatggctccgccaaccgctccactggctgctccggcgcctgcgccaacggctgttcttctcgctgtattgccagtgcttccgcttccttcccttgctccggctgattcagccagttgtctgcattctctgatatcccggtctgcaatagttcttccgacagactgatagtaagcattgggatacagtacaggctgatagctcgcacaggcagacagtcctgatagcactatcccgattcccactatttttctagacttgctgatcatagtattccactcctaatttctgatattagcgctcaactggtacgatcttgattgtcttaagttcttttcctcgctgaaattgcagcactactttttctcctgctttcatggttgtaagaatatctgcatacgacttcaaattggtgatgggttgtcctgccagtttaatcaagatatcgcccggctgtagctgtgcttgttgtgctggggaatcggcaataatatcttccactcgtacgccttccccctgccaggcaaaatccggcacggtgccgaggctgattttacgtttagcatttgtctgcgcaggcgtctgtgttaaacgggatggctgtgcaagcatggcggtcagcggctcgatgcgattggccagatattcagcaccttctttgagaatggctgccactttgatcaacccggcggtatcgattttatcgacagtatcacccggcgcgtggtaatcctcgtgcgcgctgccaaagaactggactgctggtattcccgccttgatgaaagctgcttggtcgctggaaccaaaatcgctcgccacagggttgacgggaataccggtaacaaaaccggcaccccggaaaacatgcaccagctcacgtgccgtacccgtgccaaacagcgtgacggggttatttcccagtcggccaacagtatccagattgagcatggcgctgattttttcagatggatagccggatactggattgtcaagataacgggtagaacccagcagaccggcttcttcaccagtaaacgcaataaaaatgatagtacgctgtggttgccatttggttgcaacctgccgtgccaattcgagcatgacggcaataccgctggcattatcatccgcaccataatgaatcttgccacgattggtggcgcgtacatccggccagcccataccaaggtgatcataatgcgcgccaatcaccagactttgcccgtccagttgcggattagtgcctggcagaatgccgatgacgttacgcagtgcgattttgcctttgggcacgccaacatcctgctgccaagtctgaaaatagcttttaccctctcctccgggttgcaaccctgcctgctggaattgttgtgcaatgtattccgctgccttgtccagttccggactgcccagttcacgccccttgaacgcttcgctggccaaataggtaatatcctccagcatgtgactttctgaaaacaagggcggcagctccgccagtgcccgacgcggtgccagtgtaccgacgtgattcgaggtaaacgtcgcgttatctttttgggtgatcagctgcgtcagcggtgaatgggtgattggccattgccccttgctgatgttattcagctcatctccttcaaataccagatagctgtatttgcggtaatgcggcaattttctggccagttctgcgatcgctgcgggctgatcggctgccacccatagcagggttaaatccggattggtcggttggcgtgtggtcagcaccacagcgtgcctgctctgttgccagattttaccgcttagctgcagtgtgccttcttttctggctacgccttgctctgccagggaatcaatcaattggttgctgaacttgttttgccagcccagaacccaaatcgtgcgatcagcaggcaatgcttgcagttgatcatcccggacaatttccagcgaaccgacttgcgttttctgccaattagtggccagtgattgataagcttgcatcagttcttcactgacgttggaaggcaagatcagcaagggggtttccgcaccaaaaccttgcgataaagcggaaggaatctcgcgactatccaaacgccggaatacatcaaactggggatcaatatcaatacgtaccggacgtgccgggaaatccattttaataacattacctggttgatcgattttaatttgactctgtcgagcagccgcttccccttccagatgaattgccaccggcacgctcaattgataaggaacacccggttgggtttgcttaacaacggctttaagcctgaacccattgcctacaggttcagcctgggcgctttccagcagcagatcaggcgcaccactctgatacacccattgctgaaagaacgaagaaaaatccctgccggtttgggtattaaaagttgtcagcagatcttcaaacgtggcttgtttgaactggtattgctggtagaaggcgcgcagcacccgggtaaagtcttgatcccccagctcctgccgcaacatgtgaaacagcatcatggttttgccataaccgatggcttccgtactgggactatggcgcgaagtaaactggacaattggaaaatccttttccttgttgacaaaatcagcatatttttgcaacgcatcgcgacggtattcttctcccttgccactctgttcgctgacgagatgatcggccagataagcagtcaatccttctgaccaattacctttgcggtaatcaacaaatacgccgttaccccagtagttatgcaaaatttcatgcggataggaggtatgcagaatgaaaggaaaacgcacgactcgcggtcccagcaaggtaaacgaaggcataccatatccggtttcccagaaattttcgaccagtgcaaactttgcgtaggggtaaggcccgatcagcttgctgtacatggcgatgtattgcccggtggcatccagatatttttgtgccaatgcctcatccgcgctgcgcagataaacataggcctcgaccggcccggctgtttgctggtaacgctgatagcgcccggcaaccagataaatatcatcctgtggatggttttcttcccagataacatgccgggtggttgctgtggtctgctcctgcaacagttttccctggctgacaacatcccaaccggctggcagctgaatatccaggtgaaatgacaccatatcttcatcaaaccggggataccaggcagttgagctggccagaaatacgccttcttccgaaatcaatccaggcgaatagctaaagctgcgtgcgtattccagactgggatcacgcactgcatggtgaatctgtccgttaaaagccagtgagaaagattcctgccctgccggtaacgttatagtgtaacgcttcagcggtaccgggccggcatagcccgcagccacatcagctgttcgggcgacaatatctactcctttatttgctgtaaccgataaacccgcatgcaagctgaattccagacgagtagctgctgttggattgagcgcatgttttgggacatgaatctgatccttgacctgaatttccgaggtgtccggtgagagtatgatttccatccggtggtggaatgtctggtcattagccagcacaagcacactacaaagcaggttgataaagatgaagcagcacaggataaaaaaacggattgggagtgtcataactgattaaaaattatcggaaactgaattgaatagcgaaccagatcgttcgggctggtttgatgattctttattatgatgcccttgtaacgggtgggttcgcttacctttgcttatctttttacgggaactatgcttaaatgatttttatttactgacgaggattatgaaccaaatgaaaaattttacacagccaatcaacctttccggtggcctgccacttgctcgtaatttactggcaaccgcctgttttcttgttatggctcaggcaggagcagccggtttcattaccgatgccaaacaggtttcggggcaggaagtcaggtcaggtgaagggtattaccgtactgatggtaactggctggtttatcaggcagaagttgctggtgagaatcctttttaccagatttatctgaaaaatcttgccagcgagaatgtgcagcagatttcacctggcattggcaaaactacttgttcgtgggtacatccttcccaggagaaggtgttgttttcttcaacccatgacgatcccgaagccaaagccaagatggttgctgagattgagcaaagaaaatctggccaacgcagggcgtatgcctgggattatgacgaattctatgatatctatgaagccgattttgaaggtaaaaatatcaaaaatctcaccaataccaaaggatatgatgctgaggcttcctggtcaccggatggcaagctgattgcatttgcttccaaccgccgggcttacagcgagccgcttaccgaagaagaaactgcactgttcaacaataacccttcttccctgatcgatatttacatcatggatgcagatggttccaatgtaaaaagactgacgcataccaaccgctatgacggtggcccgttcttcagtccggatggaaaaaggatcgtctggcgtcgtttcttggaaaatgggcaagaagcagaaatattcaccatgaatattgatggatcggatcaaaagcaacttacccggctcaataaaatgtcctgggcacctttttaccacccctctaatcagtacattattttcgcagccaacgttgaggggcaccggaattttgagctctacgtcgttgatgttgatggtaaaaaagaacctgtacgggtaacagaggaagaaggatttgatggtctaccggtatttacaccggatggccagtacatcacctggaccagcgatcgcacacctgataaaaaaggccatctttttcatggcaaatggaaccatgaaaaagcactggaaagtctggggttgaaataaataactattggttaaaatcaatggttgtttagtctggctgatagtttaaaaaataaaactgtcagccagcgtcaacccagcccgacttcagaattcatttccccggctgctatcaacctcttccgggcttaccaaactgccaagatttccccaggtatttctgatgtaggaaaccacccaggcaatttcattgtcgcgaatgatgtgctggaaaggcggcatgccgtaagggcgcggattacccgccgtgacgggaggaaatccgccatacagcacgctgcgaatggtgttgtgtggtgaagtcatagtgacattacgattacctgccagcggtggataaatgcccggcacgccttctcctgattcaccgtgacaaccttgacaatgtttttcatataccggtttccccagtgccaggtatttgctgactcgttccggcatgggcgggatttttttcagtgcctcattcccgctacgcttctcaccaatagattgcaagtaaaccgccatggcacgtatatcttcaggagacagatattgcaggctttgctgaacaacagtggccatggggccggaagttaccgcatgctcgtttataccagtggataaaagtttgacgatttcatctattgaccattcccctacccccgcttccaatggggaaatcagcgaaggggcataccagtaggtccccatgatttcaccccctgccagcttgctatcctgagtggcaccccatacattgcgcggggtatggcaggcattacagtgcccaagcccttgtaccagatagttgccgcgattccattcttcacttttggaattatccggctcatgcaccccctccttaaagtaccatgtccgccacaggaatagcagaaactggttatcgtagggcgggttgatcttgtgtggtggattggtctgcgcaaccggcttcaatgaacgcagataagcgaacacggcatctgcatcctcgcgcgtgacctttgtatattcggtatagggaaagacggggtacagatagctgccatcgcgcgctttcccgaaatgaagtgcctgccagaaatcttcgccactccagcggccaatgccagtttcattatccggcgtgatgtttggtgttacaaattcaccaaatggtgttttcagtgtacgtccgccagcgtaaggctctccgcctcgggtcgtgtggcagcccatgcaattcgcagcacgcgacagatattcgccacgcttaacttgctcagcatctggggctggaaactggtttgcagcaacaactgacaatggcaacagtaggctcgctgcaaaaataatagtttgccatctcccggtaaatttgaatttatttgataatttcattggataaagccctctccagatagaatcgtatgacaacgctgtataagttccggagtcagctcttccatttctgcgggctcacccgttactggctgggtaggcagccacatggccaacgcatttacttcctcctgcgtcatttttttggctatttcagacatacaatctggtgtttgtccacgcatgattccaccgttgcgccagccgccaaattgagcagccagataggcatgcggcaaacccagcaaactgggaataaagggtttcgtccctgttaatgccttaccgtgacaggcactacaggcgggaatatcccggtcagggtcgcccgaatgaatcagtgtttccactgcctgtgtttcatcgggtgaaagtgtgtttgctgtcggttgtggataggaatatttcagggaggagaaataatgggcaatttcaagcagatagtcatcagacatattttccagcaaaatcgccattgcttggtaataacgtcgcccatcacggaaattgcgcaactgattgaatagataaccagcaggtttacccgcgatatgcggataatatgcatcccgccctgctctgtcctcatcaccatggcaaataatacaaggcttgacacgctgctccagcgtatcaggaatttcagatgcccccggctctagcgcattggccaagccgacgatcgcccataatagaataaaaacaataaatttcatttacactcaactggtgaaaagttatcaaaataaacgaaatactcctgcatttttatctgaaagtccagattggaatcaggccattttgcaggatagaaacacaaagccaactatactttcaaaagaactggttaataattaccttgctgcctggtaccagataaggattgatacaacccgcttgatcatgctgcgtattggcagccaatccaagtctgttgcaacactactacaggcaaccgggaaccagtatgcagcgtatatcaccgcctgtaaccccgccagccaaatggtaacgcctgaagaaaatcagtctgccacgatccagttatatgagcaacttgccggctattcaaagcacatatacccgggagagagtatcgatcccgccagagaatggcctgccgaagcaggttttctcgcattggggatcgatcttgccacagccagaacaatcggacatgcgtttggacagaatgcaatcatctggatgaatactgacgcaatctcccgattagttttactgcgctgaagagacagtttcctcaacaatgatgctacgcttcagctcttctatttccggctcattcaatgtttcagtttccagtaattgctccgccgtttgatcaagcaacggccgattcatatccagaattttaatcgcacgctcaagcgcttgatcaagtagtgcacgtactgtcagatcgatcttgtgagcggtttcctcactataatcacggctttgtggcatcgggtaattggtttgcagataagtcatttgctcccgatcataaaccacatttccgattgcctcgctcataccatagcgcaacaccatcgcacgagcgatatcagtggcacgtgccagatcatcggaagcgccagtggaaatctcactgaataccagttgctccgccgcacgcccacccagcaataccgccatcttgttttccaattctctgcgcgtcataagatagcgatcctcggtggggcgttgaatggtgtaacccagcgccccgattccgcgtggaataatcgaaaccttatggacttcatccgatccaggcagagcaagcgctaccagggtatgccccagttcgtggtaggcaactgtacgcctttcatcaggattaatcagtcggttacgtttttccaggccagccacgatacgctcgattgcattgttaaaatcttccatggtcacggctgttgcatcacgtcgggtcgccaacagcgcagcttcattaatcagattagctaaatctgcaccggtaaaaccaggcgtcagcgccgctatctgctcggtattaacatctgatgccaacgtaattttaccaatgtgcacagccagaatctgttgacgaccctttttatcaggccgatctaccagtacctgtcgatcaaaacgtccggcacgcagcaaggcagcatccaggatttcgggacgattagtggctgcgagcaaaacaatgccactggagggatcaaacccatccaactcggctaacaattgattcagtgtctgttctttttcatcatggccaccaaatccgcctgctccgcgtgcacgccccagtgcatccaattcatcgatgaagatgatggcgggtgccatctggcgtgcttgctcgaacagatcacgcactctggcggcacccaccccgacgaacatttcgacaaattctgaaccggaaatcgagaagaacggtacgcctgcctcccctgccaccgcacgcgccaataaggttttacccgtgccgggtgggccaaccagtaaaatacctttgggcgctcttcctcctaatcgactgtattcagagggatttctaaggaaattgacgatttccatcaattcttccttagcctcatccactccggcaacattggcaaaagtgacttttgtttcttgctcaacataaaccttggcacggcttttgccaatcgacatcaacccgcttcccatcattcctttattcatccgccggataataaacagccagataccaataaaaattgccatcggcactatccaggaaagaatatcgcgcaaccaggtgctttgcaccacgccagtataggtaacactatgtttgtctagcatctccgccagatccgattcaacccgcgtggtgacaaattcggtaaatttctcaccagaagtatccttgagtttgccaaagatctgttgatcagtaatagctacttccgctaccttgtcctcctccagtaatgtctgaaagcgactgtagggaatcggctcaatttttgtatattgtgtgtaaagattttggatgaagagaatgcccattaccgcaatcaacacataccagaagttgatctgtgtcttcttatccattggtgactggtttttcatgaatcctcctttgtttgtctgattctattttttcagaaatcgggttcgcaagctgctaaatcatacccaatttagtcgatctaaaaccgggaagtggtacacttacctttcatccggcctttcgcaaagaactagattgcacggccgtgtcagtcacatacaatgactgctttcatcaaacttctcctaaaaggatgatctccgtcatgaaaacacatgcagcagttgcctggcaggctggccagccccttaccattgaagaggtcgatcttgccgctccgcgcgcgggagaggtgctgattgaagtcaaagccacgggtatctgccatactgattactacacactttccggcgctgatccggaaggcctgttccctgcaattcttggccacgaaggtgccggagttgtggttgaaacgggtacagatgtcaaatcactgcgcccgggtgatcatgtgattcccttgtacacaccggaatgccgggaatgcaagtcttgtctttcgcgtaaaaccaacttatgtcaggcgatccgtgcgacacaagggtgcggcctgatgccggatggcacttcgcgcttctcgctcaacggcaaacctattatgcactatatgggcacttcgactttttctaattacatcgttgtccctgagattgctctggctaagattcgtgaagatgccccttttgacaaagcctgctacatcggttgcggggtgaccaccggtattggtgcggtattgttcaccgccaaagtagaaacgggtgcaaacgtcgctgtattcgggctaggtggcatcggcctgaatgtcattcagggtgcgcgtatggtcggtgcggacaagattatcggagttgatatcaatccggagcgggaagcattaggccgacaattcggcatgacccatttcatcaacccgaaggaagtagaaaacgtagtggatgcggtaatacagctgacggatgggggtgcagattacagctttgaatgtatcggcaataccactgttatgcgccaagcgctggaatgcacacacagaggctggggacgcagtatcattattggtgtagcagaagctggcgccgagatcagtacccgcccatttcagttggtgactggtagaaaatgggagggtactgcttttggtggcgcacgtggtcgctcagatgtaccacgtattgttgactggtatatggagggaaaaatcagtattgatccgctgattacacacatcctgaaactagaagacatcaacgaaggcttcaaattgatggaagccggagaatctattcgttctgttgtaatttactgattacttaaaaacatgacaatcaaactggaaattcgcagccagcaccgctgttttggcggtcttcaaagttattatcagcatcattcagaaattatcggcttaccgatgcgcttctcagtgtatgtgccgcccgaagccggtgagcagcgtttacccgtactgttttttctagccgggctgacctgtacggaagaaactttcatgatcaaggccggggcacaacgttatgctgccgagctcgggctgatgctggtcagtatggataccagcccgcgcaataccggcattcctggtgaagcggatgattgggaatttggatcaggcgccgggttctatcttgatgccacagaatccccctggtccaaatactttcacatggaaagctatgtgacacaagagctgtacaacatcatactgggtcaatttccagttgatccgaaacgtgtgggaatttcaggacattcaatgggaggacatggtgcgttaaccctggcgttacgccaccctgagctgtaccagtcagtttctgcctttgcgccgatagcagcccccattcactgcccttggggacaaaaggcattcagtcgttacctgggggaatcgccagaaagctggcataaacacgatgcaaccgctctgatcgaatctggtcaccgactaccaaccccgttaattgatcagggactagacgatccttttcttgctgagcaattacatcccagctattttgaagctgcctgtcagcaagctgaacagcccattattttgcgtcgccatgccggctatgatcacagctacttttttatcagcacttttattgaagatcatttgcgacatcaccacactttcctgacgttggatccggttgattcagcaggttgattcaatctggattttcttgatatatctcatcgtcattgtgcgacagcttttcgagcatgttcgtgcgaagcaatacagaacggttacaaccgggataaggatagtctgctaattgttttgccttatccgccgccacactacactcgcggctgaggcctacggatttcacaatgacgatgctatccaccatccttaatacggatgcggcaagtttgataaaaatgccgccatctcctctactggcatggcagttcatggctccatcaaaccacaatgacatctggcaatgggaagccgttgaaattgcttgcatacgacgttgtgtaagcgcctgcgttggggataaaaatgaaatcatcttcccgcacatcttcaggcagcatctcgtcgtgcatcagcacatccacagaatcgcatgtcggaccagcaactgaccagggaaccaaagagccattgcgttgagtcaatatttcgtaacgcaacccctcgcttacctcaatgatgccgccgaagatccctgcatcccaatacatccaacgcttgccattacgggccgcagtaccgaccacgcggcacacaaaacacgctgagtcggatactagataacgtccaggttctgccatgatgcgaatattttgcggcaaatcagcaatggcctcgttaataacctcggcaatgatttcaatggatgggatcggcttgacgtaacgcaccggataaccgccacctagattcaacaaccggggattaagaccggcttcgcgcatgctggcaaacacggttttggcacgttcaatcccaacccgccagttctgtggattgcggcattgggaacccacatgaaaagtaacacctgccagatccgcattcagcttcacagcttcatcaataatttcgcgcacgtctcccagatgtgttccaaattttcctgccaacggccagtcgctgccgatattgggagtgtcgatccgcaaataaagcttggcatccgctttgatgctgacgatcttgcgcagctcctcaacgctatccaacacataccactccacgcctttcgcagcagcatactggaggtaggcgcgtgatttcatcggattgctgtaaaaaatttcggcagccggcacgccaaaacccatcaggaggtcaagctcggcaatcgacgcgatttcaaacccaacgccttcttcaatcaacgttttcagcacgcgcggatcaggattggctttggctgcataatgcggatgtacgcgtggcatggctgccttgaatcgtcgggctttattgcgaatgatggcggtatccaccatcagaaaaggcttcagataaccttgttttaacttggcttccaccaaggagggatcgatactgatttcagggtgagtatcgaaaatggcattttctgtttgttgctgtacggctgcggatagttttttcatgagggtttctcctggaatcgctacgtttcgggaatatgaatttgaacccaatcagttggaacaaacaggtttatcttgcttctcatgatgacctccttatgggctgctggaatttctaaaggcacgcattataggcttgattttttcagaatcaagtatttttttgcattatttttattaaaataaacgattaataatcatcatcttatatgacagaaattatcttcattatttttgatggctgtttgcaaagcccagcgactttataaacagcaatcttcatcagaaaaaagagccaattaacaactttttattgggtttttctgccgaccaatttatattggacaagaaaatacaggcaatattttttcagggtacttaatgcctcgattcgcctgaaaaatagttttcagaagaatcttttacgcaaaagatttgcacatgaacaagcgcaggactaatattttgaacaaccagctttataagagagttggtatatccagataaaccggaaggagatcacgatgaaaaaaattaccggagcagccatcctcaccgcaaccatgtttttctcgttcaatagtgcatttgctggtaatgaaggattaccagcagatcaggtaatttcagccattcaggcagccgttgcagcaaatcccggaaatatccacgaggctgaagttgaaagagaacaggggaagctgatcgtcgaggtaaaaatcatcgacgccaacggtaaaaaaatcaaagtaaaaatcgatccggcaaaaaatgcagtcatcccgaacaaataaccttgactaacaccccctgataaaactgctgctggattttttcccgctgcaggcattcgcgcaataacatcctgcctgttatggtaaggctctgtctttgagccatctgcacataactccgttatggtgaatgtcgcaaacatgaaacaatccagtagagtcggtaaccaaaaaatcagaccattattctcactccctcgttctactgaattctgattttttcataaggacctgttcaatatctcactgaagggcgcattacggcgttgaaattgaactcaaaatgctcacatacttcaagtatgctccgctttctcgttcaattttgccttgcactgcatccattgatcgagatcttgaacaggttctaaaatgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacatctaagaattgattgaactggcggaaatcttgtgcaatatatcccccagtggcaccataccgcctttaatccggagccaggaaagcggtgatggatataaacctttgtatatacggaaatctgaatgacatctaccccatccccacaaccccttgcaattccgcgcgttggttttgtatcacttggctgtcccaaggcaacggttgattccgaacgtatcctcacctgcctgcgagcagagggttacctgatctcgcccaactacgccgatgctgatctggtggtcgtcaacacctgcggttttattgatagcgccgtggcggaatcactggaaaccattggcgaagcactaactgaaaatggcaaggtgattgtaaccggctgcctgggtgcaaaagaggatgtcatccggcaggcgcaccccagcgtgctggcagtgaccggcccgcaggcaaccgaggaagtgatggccgccattcaccatcatttacccaaaccgcacgatccttatcttgatctggtaccgccacagggaatcaagctcacgccgaagcattacgcctatctcaagatttccgaaggctgtaatcatcgttgcacgttctgcattattcccagcatgcgcggtgatctagtcagtcgtccggtgggcggcgtactgcaggaggcgcaaagtctggtcgaagctggcgtcaaggaattgctgattatttcccaggataccagtgcttacggggtggatatcaaataccgcaccggcttctggcaaggcaaaccagttcgcacccgcatcaccgagctggcgaacgcactgggggaatttggtatctgggtacggctgcactatgtctatccctatccacatgtggatgaactgatcccattgatgacggaaggcaagctcctgccctatctggacattccttttcaacacgccaacaaacgtatactcaaactgatgaaacgcccagccaacagtgaaaacgtactggcacgcattcagcagtggcgcaaaatctgcccggatattgccttgcgcagcacttttattgttggttttcccggagaaaccgaagccgaattcgaggaactgctcgcttttctggaagaagcacaactggatcgggtgggggcatttacctactcgccggtcaaaggcgcgactgccaatgcattacctgaccctattccgcctgaaatccagcaagaacgattggaaagattgatgcaacagcaggaaattatcagcaaacaacgcctagccgcgaagaaaggccgacagctcagagtactggtggacaccgttgatgaagaaggtgccatcgccagaagctatgccgatgcaccggaaattgatggtgttgtttacattgatgatgcctcaacccttaaaccgggtgactgggcagatgtacgcgttaccgatactgacattcacgacttgtgggcagagaaaatctgacgcgaacacagagactaccaggttgccaactgcttcactacgttctacgttcgcagtcgcgacacgaaaacaaaggagatgtggggtattgtgacaaaaccaagggcaataatgacgaccaggatacttcaggctaaacaacctgaaatatcctggtcagttatttcacccgttatcaggcaaaggaggagaaatatgcactgttacgacggcggacgcagaagaacacagcacctaatcccaaggacaacagcagcaatgtgccgggttcgctcacttcggctggaggattgcccggatctttttcgcgccaggtgattagtccctgacttggcgatggatctttagcagtcagtacataaaaatcccatgtggtactcctgtaattactggcaacattagcagcgtttaatgcagtcagccagctgttggctgtggttctagcaccgctgaaagaggccgatgtaaatacccctttttttaaatttagcgtatttgatgaattttcattgatgatctcccacagcgccagctgcaacgccacatcattaccggtattagtaccaccagggttacccccggtataagagtcaaacagccagtttactcgtgcaaatacggggtcggccaatacatttgtaccatttgccagcgcaatgttgtatgtaactttcccgggcactaatgtgttggcaatatcgatacaaaaagccccgaaagtagtattagctccccaattggagttatcgctgctgttaacggtaaacttaaactggccagcatgaacactggaataaccggtaattgctcctgtactatttccgccaacgtaagtgccgttgcgtgtcatcgtaatcacgtctgcccagctggctgaagcggctgttattgaaacgattgcagctgtcatgacagccgccttacggataccctggctaaattgcttgttgtttaaaaaagatttcattgtattttcctttattggttttttaagtgatccccagttactccggatatctccaccttctgttaagcactaaccgtgccacaataaaatatctttaataaacaattagatataaaataagtttgcaatttttattatgtaatgtaaaacaacctgacagcccaacaattggttgaacccgttctccaggaagaagtctcaacggaagtacatcaatttgagccaggaaataacaacagaaggttgcaataaacatgacagacatgaagaacaggattgaaagcaggctacaatcgttacaaccgcagtttctggaagtacttaatgaaagccatcgtcataatgtcccggcaggatccgaatctcatttcaaggtaacagtcgtatccgctgtgtttgatgacaaaccgctggtggcgcgtcaccggctggtcaacgccacattgacgaatgagattattcgctccattcacgcactggcgttacacacattcactcctgcggaatggcaggaacgtcatgatgcagcgcgcacatccccaccctgccttggtggatcggctgccgaatgaaaccgggagtgataacctcacgccgcgaaagcacccatcaactttcagagaggtttttatgcaaaaactgttaagttttctgacacttgcctgcgttctgctgctcagcggctgcggctacaacaccctgcaatcgactgatgaacagatcaaatcaagttgggcggaagtagtcaaccagtatcagcgccgggcagatctgattccgaatctggtcaatacggtaaaaggctttgccacacaggaaaaagaagtgttgctgggagtgactgcggcccgttccagagcaggcagcattcaggcgacaccggaactgatcaacgatgcggaagcctttgcccgttttcagaacgctcagagcgagctgaccggtgcgcttacccgtttgctggcggtggcagagaattacccgcagctcaaatccagtgccaatttccgtgatctgcaggcacagctggaaggtactgaaaatcgtattgtggtcgcccgtaaccgttacatccaggcagtgcaggaatataacgtaacggttcgctcctttccgagcaacctgactgcgatgctgttcgggttccaggtcaaacccaacttcacggtggagaatgaacaagcgattgctgttccgcccacggtagaatttagtgctccggtaaccgctcaataaattgattaaataagcaagaagcaagcatgttgattttatttacaggaatcaagcggcatatcagtttgtcgtttatagcgctgttatgtgttgctgccaccggggcgctggccgatgttgctattcctccgcttaaatcacatattaccgatctgactggaacgctcaccaaaacagaaactactcaactggagcaacaactggctaattttgaagcaaaaaaaggcagccagatcgccgtgctaattgttccatccacacaacctgaaacgattgagcagtattcaattcgcgtggttgaggcatggaaactcggccgcaaagggattgatgatggcgtattgctgctggttgccaagaatgacagaaccttgcgcattgaaaccggctacgggcttgaaggtgcattaccggatgccatcgcccggcgcatcatagacgagggaattactcctgaattcaagcacggtaatttttttggcggattacagacaggcatcaggcagattatcagtgtgattgcaggcgaacctttgcctgttcctgcacggcaggcgagagaatcagccggtatgaaccttgtgctggaaaacattattcccgttttatttgtcatgttgatgctgggcaggatgctgcaagccacgtttgggagaatgaccggtgcaaccataaccagcagtattgcaggattactgatctggctgatttcctcttcactgctgatcgctgtcctgattgccatcgcggcatttgttatcagcctgtttgaacagacagggagaatcattcaccaaggtgggttcaggagcgggcgcagaaactggcctggagggggtggtttttctagcggtggattccgtggcgggggtggtggctttggtggtggcggcgcctcgggaagatggtaatcaggagaaattaatgaatttgatgcgcatcatccgccatctcgtcactggtcaatcagtcgtaaaacgtgcatttccaccggatacgctgaatacaatcaagcaggcaattgcacggtctgaaaccacacatagtggcgaaattgtttttgcagtagaagcggcgttggatatatccctgctgttgaaaaatcatttcagtcgtgaacgggccattgatgtattttccctgttgcgagtctgggataccgaacagaacaatggtgtgatgatttatttattaatggcagatcacagcgtggagatcatagcagatcggggtatttacactcgcatggaacaggcggaatgggacgctgcttgccatacgatggaaactgctttcagccagggacaatttgaacagggtattctcaccggaattgatgtaattaccaaagtgctacagcaatactttccagccgacagcgctggcaaaagaaaaagcgagctttccgattacccggtcgtgttataagcccgtcctccacttccctgaaagacaggtcagccggatcagaataaatccaatcgactctggttttaccttggctcactacctgattctatgcgcctgctggacgacaggaagttataatattgctatctcttgctgtcgttctgtataccttctatgtatctgataatggcgatggccgttgcattaccgaaaatgaatcataaactccaaggcaggttattctggctactcggcaagaactttctgattttctgagcgaagtcgagctgcgtgcatacaagcaagcgttattcgcggtgcaggatgaacacactgcactggatatcgtgcaggactcaatgatgaagctgaccgagaagtatgcgcataaaccgcctgccgagctccctcccctgtttcagcgcattctgcaaaataagattcgtgattattatcggcgacagaaatcccgttcactctgggtgacgttgttctcggcatttatgcctgcttcaagcgaaaaagatactgatgaatattccgatattcccgaatctctgtcactggcgcaggatttcgaccagaaaaacaatcctggtaccgcagcggagcaatctcaactgatcgaactgatcagcaaggcgctagaaactttaccgccacgtcaacgagaggccttcctgttgcgttactgggaagagatggatgtatccgaaacagcaaaaatcatggattgctcggaaggaagcgtaaagacacattgctcccgtgcgacacacacacttgccgctatattagagggtaaaggagtcaagcgatgaataaagaggaaaaaacggggagaacgatcgcaagattgctggatcacagcctgcgtgacattaccccaggtactctgtatcaactgcgagctgcacgcagagccgctttggaaaattatcaaccagcagaaaaaatgctgcatgcaggcgcgggaatatcagcccggaacgggtatcactggcttgccaatcatgccggcaaattattattatcagccagttttctgctgctcctaataattcataactactggcaggtaaattacaggattgaagataaatcaacggcatcgcacgccatattcactaatgatgcacccgccgaattattcagtaccgaggatactgccaatttcgaagaagaggaggatgctaacgatggaacttctgatgaaacgcctcctcacgaagccgaaaataacaataattcggaaaatacgactgatgtttcagaaaccgatgtcaatgaagaagcaaattctggtgtggctactgattccgtttaccccggtgaaattcaggatcctgactggatgggtgaaccttccgatagcaaggatgacaggaattcagaaacagatgtcgtccctgatgaaaccagtgatgttcaggattctgaggaagagggagacgctcatgatgcagaatccccggatacagattccgaagacagggatacgcaggatacagaaaccgatagcgagatatctgccccatagcccaaccaagatataatccggatttgatccggccgcttcggtttcattccggaagataaaatttatttctgcttaagcaccctaccccagctaatgcactccaacaccagcgatttactccaccttgttcctgctgatttcccatcagcctggaacaggcaaattgagcctacactgatcaatcatgaacaggtaattacctggctggaaactgacctcgatcatcagttacatttttcaccagggctgattgtgattaccacccggcggattctggctagaatagtggacgatgagcactggcaggcatggcattatcaaccaaatatgaagctagcttatcaggagcacgccgggatttgcagcatcgaactgtctgacgccagcgcccgcctggcgcgctggtattgcacattgagcaaacaacaggcagcggatcaactgattatccactttatccggctgattgatacgcttgatacccaggcagccctgccagcaaaagggatggcagaacaagccagcagtaaccagaataccgctggcaacgatgacagtagtgaagcggcatacgctcatcacgatcaggaagcaacctccactccaccctctacctggacattgtttcgcctgtggcgctttgccagaccgtataagtggcaattatttaccggtttcatgctaatgctgggcagtacggctgctgcattggtaccgccctatctgaccatgccactgatggataatgtattgatcccttatcagaacggccatccgattaatgttgatctggtgatattttatctgtccggcttgctgggagcggcaatagtagcctggattcttggctgggcgcgcacctatgtactggccaggatatcagagcgtatcggcgctgatttgcgaacaacaacttacgaacacctgctcaaactttctcaagcctatttcggtgggaaacgtacaggagatctgatggcgcgtatcggtgcggaaaccgaccggattaacctgtttctttcgctcaatctgcttgatttcgccacggatgtgctcatgatcgtcctgaccgtcattatcctggtttcaatcgacccatggctcgcgcttattaccctgctcccattgccgatcattgcctggctgattcatctggtgcgtgatcgtttgcgtgtcggctttgaaaaaaccaatcgtgtctgggccgaagtcaataatgttctggcagataccctgcctggcatccgagtagtcaaggcatttgcgcaagaagtacgggagatcgaacgcttccgtgcagtcaatcagcgtaatgtggaaatcaatgatcgtgtcaacaaagtctgggcattgtttacccccacggtaaccctgctgacagaatgcggtctgctggttgtgtggattttcggtatctggcaggtatcacaagatcacatcaccgtcggggtacttaccgcttttctagcttatatcggccgcttctatctgcggctagattcaatgagccggatcgtttctgccacacaaaaggcggccgctggaaccaaacggatattcgatattctcgatcacgtttccagcgtgccggaaccggtcaagcccgttcatctgccagctataaaaggccatatcgagttgcgtaatgtcggtttccgttacggaacgcgccgggtgatacaaaatttcaatttcgcaattgaaccaggcgagatgatcgggctggtcgggcacagtggctcaggcaaaagcacactcatcaacctgatctgccgcttttatgatgtgaccgagggtgccatcctgattgatggtatcgatatccgctcattacctatcgcggattatcgaaaacatatcgggctggtactgcaggaaccttttctttttttcggcacgattgccgagaatattgcctatggaaaacccgatgcttctcgcaaggaaattattacagcggcacgcgctgcccatgcccatgaatttattttgcgcctgccttacggttatgattctctggtgggcgaacgcggccaggcactctcgggtggcgaaagacagcgtatttccatcgcccgggcactgctaatcgacccacgtatcctgatactggatgaagccacttcatctgtggatacccagacggaacaggaaattcaaggggcactcgataatcttgtttccggccggacaacccttgccattgctcatcgcctgtcaaccctgcaggaagcaaacaggctgatcgtactcgaccacggcaagatcgtggaaacaggcaatcatgcggaactcatggcctgccagggacattactaccacctttatcagtcacagtcacgtagcccagataatgaagagtcctctgttgaacccggtaacctgtctgatatcagaggaaatcgtgtatgaaactatctgaatacaaactggagaggaatgctttcggtcggttggtagctataggcaaagatcagatctacgaaagtgtcatacccgtacgtgcatttccaattactgccgcggatgagggagtagctctggtcgatggtcacggccatgaagtggcctggattgataatcttgttgaattacaggaatcagagcgaactttgatcgaagaagaactcgccagccgtgaattcatgcctgagataaagcgcattgacaaggtttccagcttcgcaacccccagcacctggcaaatacaaacaaatcgaggggaaaccagcctcatcctcaagggagaagaagatatccgtcggctgtcgctcgctacattactgatcaccgacagccacggcattcacttcctgattcgagaccggttgatactggatcatcacagcaacagattgctggatcgttttctctaaaaatgtaattatttcatccggttaaccgattagaaagattgttcagccaagcccgattttttctatgataagacgcatactggcccaaacaaacccatcaaagaggaactgtcatggccatgaaccatgctggtgggccatgaaccatgctggtgggccttgatatagctactattgatgaaaacccactccatgtcctgctcaaccaccagagcctgaaataccttgagctattctccgccggcagaccgggcgttaaatcgtttataaaccttacttcagctcccgaatgccttgggtaactctctccagggacaaccggtacgcatgcggtacagtatgccttcgacagtcatagcaaatcttgcttgttgtagagatattattgtgaagcaaaatggccagcagcttcgaccagagctcatcattgagcagtaatttggccattgcaagctcgtattgctgttgtgtgaacgctacaacgataaaaattttcttctttaaatcaatagcttgaaataaaactggaacgggccctggcgcaacatcaatgaagtagaatttgccaccctgaagtgggtttgactggttaaacaatggcaggctgctggagttgattgaaaatattctaccaacaaaattgaagtggcatattattgctaactgggggagtcagctgataaagcttactcaaactaaaaatctccggaaaaaccgagccaatctcactacattgatattgttatgcctggtggattaatggttgcctgatcacgccgccgcgcccaatatctggcgatactcaggagcaatacaaaatgatgcctccaataaaagagcctgacctggccctcgcgggagtggctttgctcgttatgtttgcatttttgatgtggcatgacagcccaatcaagaactcacgccctcttgatccatacgtccaacatcaagacccacctattaccggagattcttatgaaagttggctctggcaggatcctttcgagtacgatttaaattcttgtatacaaagtgatcaatcttctactacatgcgttgatggcaacgcagaagatatacaaaataaagatatagacaaaaaaaattacgcaacaatattggctccggtgttaaaagctcccaatacattgcaaaacaaggagataagaaccaggtatcgttacgcagtcattgcaggactaatagaatcaggctatcgcccccgagaaccaaaccgtttgtatttctttcctagtcaaaagaataagaatagtagcggtaatgaatatgatgtgcgctgggaacgtttctataaggaatctaaaccaaacgaatgtaaatcagatattgttgttgtctggatgaatagcgagatatttactaataaggataagctcacttatgtgtcaacgaatctaccaaaatttataggtcgaagtgatgaggtccatatttataatcgggatagcattcttgatcagaagcagagagaggcgtcggaagcattagaagcattagaagcattagaagcattattcatcaatgataataaaaaaatcgaggttatcccgcctctcaacgacgagaaaacagttacagaacttactgaaaatctagctaaggaactcaagcggcgtaacattatcgagttatctgaagtcgggatcattacagaacaagattcagaaaatgcacgcaatttggcgggtaacttccgtgaatcgctctgtgactcttttgacaaacctgatacttgtaaaacaagtgaaataaaaaacgttttctatctaaaaggtctggatgccaaccagccaataattgataaacaagataaaaatggggattatcaagcagccagcaaacaagctgattatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactatagatcgccgtgctgttatcgatctacatgatccatcgccactacccgttggcccgagtcaagtggattacctgcatcgattggcaaaggaaattaaagattctcataatgacataaatatagacaagcgcgatagcggcataaaagctgtaggcatttttggcagcgattttaatgacaaactgcgaatccttgaagccttgcgggcagaaatgcctgagattctggtttttacaaccgatctggatgcgcaaatgttttctccgcagcattggcaagcggccagaaacctagtggtcgcctcacacttcaatctgcaacttggtcaaaaatatcagaaacattttccgagttttcgagatagccaacagaccaacattttttaccatactatcaagctcttcaaggatggagtcacaacacctaaaaatattccacccaaaatttttgaaatcggccgtaatggtcctgttcatctgatacaagagaaagatgacgaaagttctattgaccctctcgataatgctcaggagcaagccacaaagcaactaatgctgctgggtgggattactatttttcttatcttttttctttggcaagtacgtcccaattccaattatataattgcatggttggcgattggttcgctcataatattttccatcgctttcgtttttgctatagatgcatcaggagagccgctcagctttaaggatggcaccagcctctggcctaccatattcatacaaatcattgcgaccttgctggcatgcgcatttatcttttctacgaaacgtattcttgaggacaattctaaatacataaatagacaatattttggtgctaactctaatacagcagttcgtagtaatttagtcgacatcggactagcaattatagtgtgcatcatttttatagtttctagtctcgcttatacagttaatgacgtatatccatcaaaatttccgttcatcccttgcatcggggggcttgttgttattgccctctattatgtaataatagttccatataaagaaggagagaaatttctatttatcaaagattgggtagaaaaagaagattctaatatccttgagttaaaggacctatggcgggaatattgtgcctgcggccaattcgagcaccgtgcaggtcgtgttgtcgcaatatggctattctttgcaattattgaaaccctccttatttacttactgccgccctggccatcgccatgccggggcgacacttgtgactgggctgcctgggtaggggtaatcagttttgtagtgatcatgatattgctcttttttatactggatgctgtaaggctgagctatttctggattcaaaagctgcgtacgaagcatcccctgctcgttgataaaactacgctaaaagaagaggatgacttaaagacatttgatgacgcaagaagaaataaagttgcttcacttagggcactcgagcagattattgacctggtcgcagtaagaacattgaaagtcgacaggcttatttattttccgatgctttgtattatgttgatgttatttgccagaactgcatattttgataatcaggagttcccgcttagcaagggcattacctttgctgcaagcatctcattactcttttttgcaggttttatgcttcgaaatgaggcaggacaccttaagcattccgtcattaagtgcgccgaaaatctgggtaaagattatttttcttgccaaacagaggccgatgcagttattaatagggcaaaaaaaacagaagtcaatgaagttattaataggataaacaacgtcaataagggtgcttttgaacccatgttcgagcaacctgtcatgcgcgcaactttaataatattggcatctattggtattttcgctgccaaatatctaaagttatttgaataatccgttggcatctaataggtataagttctccgatatagccgctgtcgcacagcagactttggacctgccctagactctgcttgcagtgttttagggctgcggtcagtcacttccgccgtcgtcaccgcaatggcatgcggcaagccctgggtatcgatcacgatatagtgttttgatgcccgataccttcttgcctgcgtcatagcctggcccgccgtgtccttcacgctctgcgcgtccacaatcaagaacgtgctgcaagcgtttcgcctccgtttctcgcgggccgcgccaactctcggcggaaaatagaaggtatccaaaaattccagatttcctgtaaaccgattgaatatgtctcgcgttaattagagggtgtacattcgattactcactcatgttgattcaatccgattttcccgcttgcagtaaaaaagattttaggtttcttgacattcgttatctgaatggccccaacatgtggacgtacaaccctgttctgaaggcaattgttgatattggtgagctggaggattatccatcagatacgatccctggtttttatgagcgcttgtcagcctggttgccatccctgattgaacatcgctgtagctatggtgagagaggtggatttttacggcggctcaaggaaggaacctggccctgtcatattcttgagcatgtgacgcttgaattgcaaaatcttgccgggatgcagggaggatttggccgggcgcgcgaaaccacggagcggggagtttataaagtagttgtcagtgcgtggcatgaggaaataacgctcaaagctttgtatttggcgcgggaactggtactggccgcgatggggtttgaccaggaacagccagtttatgacgtagaaaacgctattgggcagttgcgtgacatgattgattcactctggatcggcccttctaccgcttgtattgtcgatgccgccacagcacgcaatattccgttcattcgtttgctggataaaggcaatcttattcagttagggcaaggggcatgcagtcgatatatctggaccgccgaaaccgaccggactactgccattgctgaaagtatttcacgtgacaaagaactgaccaaatcactgttgcgtgcttgtggcataccggttccggaagggcgtatcgtgactgatccggcagatgcctggctggccgctgaagatatggggttgccagttgttgtcaagcccagcgatggcaatcacggacgcggggtgtttattgagttgagtacgcgcgaagaaattgaatctgctttctcgattgcacagcaggaaggcagtaatgtgttggttgagcgctatattccaggaatcgaacatcgcttgcttatcgttggcggacgggttatcgccgcagcacggggagattccgcgcttgttactggtgatggcgtttccacaattgcagaattgattgagaatcaggtcaatgccgacccgcgccggggcactactgaaaatcacccgctcaatcttgtcaaactggatgatgcagtcaaaatggaactcacgcatcagggctgcacctatgattctatcctgcctgctgattcaaaaatacgggtacagcgtaatggcaatcacgcaattgatgtcaccgatagcatacatccggccactgccgatctggctacgctggctgcacgagttgttggtctggatattgccgggattgatctggtggtggaagatatttcacgcccacttgccgagcagggaggagccattgttgaagtcaatgccggtcccggtttgctgatgcatatcaagcccgctatcggcaaaccacaaccggttggtgaagcgattatcaatcatttgtttccggatcagaatcagagccgtattcctattgtcggcattgccggcagtcatggcaaaaccactatcgcccgtcttgttgcccgtctgttcatgcttgcaggtaaacgtaccggtttggcatgcagtagtggactttacctcgaccacaaaaaaattgattacaacgactgtgccaatcacaaatcggctcgtcgtattctgatgaaccgcactgttgaagcagctgtttttgaaaatggtttcaatagcatgcttgaagaagggttagcgtatgacagttgtcaggtaggcattgttacccgaattgagcccgcacagcatattggttatcgggggattgaaacgcctgagcagattttcaaggtgctgagaacccaggttgatgtggtttctcctaccggaggtaaaaaagatgacatcttgccagaggttgtgccgtcaatcggtacaactattcttgatgcggaagatcctgtactgatccggatggcagatttatgccacggtgaggtcatttacatcagtcgtgatcccgaattgcccacgataaatactcaccggcgagagggaacaggtccaactcgtgggaaacgggttgttactgtacgtaaccaggagattctactgattgatggttctactgaaacacctcttgtccggctggatgagctgcggtcagaaaccggtaatcatatcgtggaaacggtacatcttctggcgggcgttggagccggctgggccttgggcatgtcgcccgatctcattaaaactggtttaacggccttcttgcaggatcaggaaggccatccaccgatatatcaaactctcgaaggttagataatttaaggaaagtattcatgaaggtattacaagttcgtgcattgcggggacctaacgtctggggtaaacataccgccatcgaagctacgctagatctggaacagaataaacacacgcctaacactatttcctccctggaagagcgtttatgtaactattttccggatattgcgcagctgcagccaattgactggcaagagacaacaccagctaatattctggtatttattgcactgaaattacaaaaacaggtcggctgccccgtaagcttcagttgtgcggtcagaatggctgaaccgaatatttgtcgtgtcgtcgtggaatatactgaggaagccgttggaagactggcatttgaacaggcttttgcgttatatcaggcagcagcagaatctgccccatttgatgttgctgaaacaataatccgtttacatgaactgtacgaagacgttcgtctggggcccagcacaaactcgatcgtgcaggccgctgtccgacacaagattccataccgtcgtctgactgacggaagtctggttcaatttggctggggaagccggcagcggcgtattctggcttctgaaagcgatcaaaccagcgtggtggcagaatccgttgtgcaagacaaggatttgaccaagatacttttacacgcagctggcattcccgttccgaccgggcgaccggtaaccagtgctgatgatgcctgggtagcagcctgcgaaattggtgcgcccatcgttgtcaaaccacaggatgggaaccatggtagaggagttacagccaatctcactgaccgagatcagataaaaactgcatatcatgtcgcggcagaggaaagcagcagtatattggttgagcgttacgtaagcggatacgattaccgattgctggtcgtaggcaacaagttggttgcagctgcaagacgtgatccaccccagattgtcggtgatggtattcataatattgcctggttggtggatcagatcaatagcaacccgttgcgcagcgaaggccatgcaaatctgttgaccaaaattcatctggatgaaatttctcttgcacaccttgtatcgcaaggattgagcgctacctctgtccctgaaaaagacaggaaaatagtattgcgtaacaacgccaatctctctaccggggggacagcaagggatgtaacggatgaagttcatccggatattgctgattgcgcagtgatggctgctcgaatggttggcattgatatctgtggtatcgacgtaatatgcagcaacatctcgcgaccactggaagaacagggtggcgcaatcatcgaaatcaacgccgcaccgggtttgcgcatgcatctgcaaccttcatacggcaagccgcgcgcagtaggagaagccatcatcaatcatctgtttacacaggatgaagatgcccgtattccagtgatcgccgtaaccggcactaatggaaaaaccactacggcacgcttgattgccaacatactggaacacaaccggatgcgggttggtattgcctgtacggatggtgtatttgttaataatcagtgcgtggatacgggcgattgcagcggccccaagagtgccaggaatattctgtttcaccccgatgttgatgctgcagtattggaaaccgcacgtggcggtattctgcgtgaaggtctgggttttgattattgtgatgtggcggttgtcacaaatattggccggggggatcatcttggtctggctaacattaatacagccgaggaattggctgctgtcaaacgcactatcgtggaaaacgtcaatccggagaaaggcgttgccgtgttaaatgctgacgatcccctggttctcggtatggccagccactgcccgggttctgtcacatttttctcctgcaatagccgtcatccggtgattctggaacagcgcatccagggaaaacgtgtgatctacttggaagaacaacatattgttgtaacggaagccggaactgaacgacggatatctctcagtaacatccagttgacgaagaatggaatgatcagcttccagattgagaatgtcatggcggctatcggtgcaggattagcatccgggctggattggtcaattatttgcgcaggcttggctgattttgttagtgatgcgcagactgtcccaggcagatttaatctgtttaattatcgtgaagccacgctaattgcggattacggacataacccggatgcgatggaagcactggtatgtgccattgatcatatcccggccaagaaacgtacagtcgtcatcagtgcagcaggagatcgccgaaatgaagatattcggctacaaacgcagattctgggtgatgtatttgacgaagttgttttgtttcaggataaatgccagcgtggacgtgctgatggcgaagtgcttgggttattgcgagaaggcctggaaaatgcaaaacgcgtacgcaaagtcagtgaaattcgtggtgagttcaaggcgattgataccgcattgaccaatctggaagccggggagctttgccttattctgatcgatcaggtggagcaggcgcttggatacatccactctcgtattgccgctgatgctcgtattgccaccgatgctcgtattgccgttgcctgacaatgacaaaagaaaaaccgcctgtgaagcaatactcggaattcaggcggttttattattatgttgctatcctgaagaggatatttcatggagccctgaaacacgcagccccatgatgctgcagttacgtaatgttattacagtagcttatctgaccaggatattgtcacccttgccagcttccggatcagcatcatcactgaacataattacagcgattgcaccagtcaatgcatgattcatggcatggtcaacgattgcattagcacctgcaactggagaaatcagatcaagcgttgccgcatcgcctggcccaattgtataggactgcaatgcatactggacattcttgggatttccactggggtagacattttcccagatcccagcgataggatgcagtgaggaaaactcattgggtccagcgttgacaaagtagatacgaacccgctcacccggcttggcttgcaaccagcgtgtcgcttccgggtcatgtaccggatcgtacttgaagacgccaccattaaaaacggcattggaccactgattcttcatcatggctgttttgtcatccggattttcgtagtgctcggcctgaatcagcacatattcacgatcagccttaggcaaagcattctcatccttcggatcgacaataataacgccatacataccacgcgcaatatgctgaatcattggatccgaaccacagtgataaaagaatacaccgggattatcagcagtaaaggtgaatttttttgtttcgcccggtttgacagaatcaaaatccgtcattacgtccactctggcggcatgaaaatccatgctatgtgagtttttattgctttcttcattcaccagagtaaattcgactgtgtcaccttcagtaacacgcacaaccggacccggtacaacaccaccaaaagtccacgcatgataggtgctgcccttattatcgtaggccacatctttttccactgcatggatcgtgaccggtactgttttagctacagcttctgcatgaaatcctggcagggcaacactggctgccagcgcagcaaaacttgcattaaataattttttatatttcatattgtcttttcttcctctactttatttacagatcagcttttaattaatttgaaccacacttacagatatgacgcaggtaggcggccagctgatcaacctcttcatcactgaaaatttctccccaggctggcatcaacactgatttattggcggcaagacctcctttcttgattacttcaataatctcgtcgttgggaatatcacccataccctttggatcactgtgatcgcgcggctgaacagatataaaagtactgttaagaccattgccatcacggtcggcaccatggcattgtgcacaatacgtatcgtagagtttttcggcatgtttaaactggtcatccgctgcagaagctggcgtagctagtgatcctaaaaagatcaaactcattcctgcaagcagtaaaacagaacgactgatattcattatttaccctcctttcctttcagttgagcaatatagccggtaagattctgcagatcctgctcggaaattttgagttttggcatccagatacccttatcaattttctgcggatctttgatatagctgtaaatgaaatcaggctgcaaacggtcaccggctgtttctaggctcgagccagacaatccaccctttccaccaccgattgaatggcaggcataacagccacgcagtttggtgaagagcatttttgccattggagatggtttcttgtccgcatcgtattttcctgtctcaatcaatccttctggtcctttcagggccatcaaggcatcagcagctgcttcagcatcggcctgtgccagttttggatgtaccgtgagcgtagactcatccacaacatcccccttatcgcccttcttgatatgtttgcgatagaactcaccagccgggcgaattctgaccggatcctgcagccattccactagccatggcttgttaaatttaactccggcgtaataaagatccggccctttacgttcccacaaacgatccagggaagtattttccggctgagtcagcgcatggcaggaagcacattgtgactgcagtattgcggaaccgtccgcagcagaagctgttagcgatgatgcaagaaaacccgcaccaaccatcgccgcaagcaaataggctttcatcatatttcttctcctttggttgttgtgttacacatacacatcattcttcgatgagttcccctttgaagactttcgaattatgcattccgaagtcttttttcagagattcttcatagtagaaatcaggtacaaattttttgtctttccatacatagaaatcgtggtcaagtccgacttcctcatactcgatggttgtcataattccaccgtcaggcttgtctccattggtagtatgcgtatcaacgtgatcatgtatcatccataaaccagggttatccatgttgatgataacgtcataacgctcacccggcccaataagaacagtgtcggccttaattggattttccaagggaaaaccatccttgaatacgatgttagagatgtggccatgagtatgaatggaatgaacttgatcacccgcaccaaagaggcgcagccttatgacatctccttttttgactcgtataggttgcgtttcaggaaaagatttggcgttaatcgtgtaataatcgaatacatctcccggaataccgccctcacccggtttgttcgcccaggctgatacccaatcggaaagcatcatgatgtattctttggttactgttttctcgattggaagaggattcttcggctccacaatgagtggcccccacatgccgcgcatggtgacgtgttcgttaacattgacgtgacagtggtaccacatggtgccggaaggttcagccttgaatttgtaagtaaacgtatcaccgggttctatcgcatgctgagtggcgtgaggcacaccatcgttctgccaggtaccgcgctgaagcattccgtgccagtggatggtatgcggcagcgtggtcatgttagttacatttactacaacgtcatcaccttccttgacgtgaataagcggcgctggaacctggccattgaaggcaaatgtgtgaaaatctctcttgccgaccagaacgatccgggtgtcttcgattgacatatcgaattcacgtttttcggcccagcttgttgcaggaatcatcaccagtgcatacagtccaacaacgatgctgatgatgaatcggtaatgcgaaaatatcgaatttgaatttctcataaatcggtccttttagtgtatatttaatacgcctttgatgcacaaaactcttttacttttagatacatactgtggtaatacctcatcagcacttgatagatccctccttacagcgataaagatatatttgaaatgtatctttgtgcggattttacttatatcaatctaattgtcaataacttttatcgggaggaaaacgaaatgatcagcccggtgctcccggtatctatgctttccgggctaaaataaaatgtgggggtatgttgtcatccgcgcctattattaaagggggtatgcctcatgaaactgacgaattacagtgattacgctttgcgtatcctgatttatctcggtttgaaaagagagaaattatctactattactgaaatatccgattgttatcgcatttcacgtaatcatgtcgtcaagatcgtgcatcatctgggtcagctcggttacctggaaacgctacgtggaaaacacgggggtatccgtctggcacgagcacctgaaatgatcaatatcggtgaagtaatgcgtcatacggaaacttctatggatctcgttgaatgcttcagcgatcagaatgcatgtattatctgcgacagttgtgtgttgcgctcaatcatcgcggaagcgctcgcggcgttcatgaccgtgcttgatagctataccctggctgatctgatggttcccaaacgtcaattaaaaaagcaactgcaagtcatgggaatgttcgataacctaacggatcaatcaaactgaaagtcataaaatagatcaactgcgctatcatctcctgcccgggtcactactgaaacatgaggaaacaaactgtaggtcagcttggcgaccccagccgatgcagaagtcaacccatgctcgaaacttaggtaggcgcgtgatgaaagccgtttaccgatcatacctacctggtcggttaaagaaccgccctcctgctgccggattgaaaaatcatcaatacccaacccttgggtaatgctgtccagaacaccctcatcagatcctcccagaatgctaccggccgcactcaacaataatccgctgtccaggccgcttttatcggtaggacgtcccagtacgatccaggacagtttctctgaatcgggaacctcgggttgtgataccagcttgattttgggttgtctcactgtccctgttatttctatgcccgcttctacctgcaaaccgctacgcactgccaagatattgagtcctggattatcaagcggtccatcaaaattcacaattccacgccggacgagcaaattttggctgtatgccccaaaatgggtgtcacgagttgcaatagttcccactgcattgagtaatcgtcccggttcactgtgcagacgcaactgtccaaccagccgcccctccaatcctgaagcacgcagaaagaaccgctctcctaaatccagtgttgcatccagatttattttaaaaacctgtgattctggctcggaatcagtcttgcccgtaatgatgatatcctctgccaagttaggcgttccggcctccggctgcttgataaagccaacatccgtcatgatttttccggtaacatcaagcacgttatcactgaaaccaaccaaactggttccagaaacgacgatccagcgatcttcttgttgtgcaacaggcaaatgatcaatttcaatggcaagattactttgctggttatggatattcacactaccatgcgcacttagccggccagacttctgcgtcaacttcagtcctttaagcaatttatccttcgtgggtttctcaagtggcgcagtaaaattgagcgtttcaagcaaaactctatcctggttaaaatccacagcaagcttgccttcttttaattgcaacccctgatccagcagtgcaatcaccaatgcatctcctgtcacactgccctgcagctctggttgttcaagcgttcctgccagccgagcgtgtgcagcaagctgaccttcgctacgcagattgtcacctataaccgagccgacccaggtgagatcaggcagattcaggtgtagatctccattcagtggggcatttttctgaatttcccagacagaaccggctggttgcaacgggacactaaccctcgccgtggcttcgccgacgtgcgccccgcgaataaccaactgtccgtttagattattattttcagctagcagattgaatgcaagcgtttgtaaacccaatgcaaacggagtttctgtcggcaggataaagtcccctttttctcgctgtacatgcaaacgcccggttaattgctgatcagccgcaaactgccaatctccgcccagtttcagaggttcataattttttggggacagcccgcccgattgcaatgcaataccggagaaattaccccgggtagaccattgtttgggggtccagtgtgcatcaagaatattaatatcgcccgcagcaacctttatacgagtatgccccaatacaaccgcctccggactgatccggacgcttggctgagttaccagatcgaggggtaccgagccagtcagagcaagtttattaatgatcccatcccattggaaatgctgcgtatctccgggacgggtgatcaatcctccttttgcctgaaattgtgcttcagtcgtttggtcaatctggctgttgatcaatagctggtgatttgattgagtcccatccaatccaactgataattgctgcaagaatatttctgtgcctttttgataggctcctgtctggagatcaagttgaataacggttccacgcaaactgcctttggctttgagttgggcaagttgatgttcttcatgaaaattgaaatgatttgaattaagctcaaatgccacatccggacgatcaatcttaccgcttagctcaatccgggaatgcatatcgccttgcagcccgaatccgatctgagtcaatttgggtgcggccagtaccactgacagatgatcttctgcgtttcctaatgccccctttatctcaagctggttatcccccagatgcaagcgggcatcacttttaacccgcctggattgcagcaaagccaaagttccttggccagtcactggctggttagagaagtgactttgatcaatcgagaaattaatattagcaatcggttgtggtgccagctgcccccccagattaaatttggcattgagattggaggatggcacatcagcaaatgcagaaatgtcaaactgcttgagtaatccctcaaacgtaaaaggctgcgattcatccagttgtaatacaccgtgacctgacagactggaatcccctcgggcgagatcaagtttttcgacggtgatgactgaagcagcacgcgccaatgccatatctatgtccatttgcaacgcttcatcacgcaacttgatcgtgccatgctgaacatcctgatcgcctgcaaaatgcagatttccagacaaatttgctggatgtaaaccactttttaaagaggctggattcaattgccggacttgaatgtctgcctgccctgttttagtgctgatttgccagttggcttttcctgtcaggctaccaggcacagcttcctgttcagacaaacgtagcgcgatatcatccagatgaatgtcatcaccagtaaataaaaactgtaaacgcatatctttcaatgggataccttcctgacccagtgggcgtgccatagtattactaacagtaatacgcccttccaggcgctcagcctgggtttgctcaagataactgcgaatactcagatcagctttgggcagatctggagaaaaaacatgaggattcagcccattgaataccagacgggcatcaagtaaaggtaatttatcaaaaggatgaatggtaaaaatgccagccccattcaattcaccatcctttacagccagctttgcccttatctgttgtaagttaccactcagtttaagaaccgcatgacttggtttattatcagcattgacagcattcgcccaactgtaaaacaccagttgtgacatcagatcaaatggtggatcgggggcaatctccaggttacctgcaatctttccctgctccagttcaagtgccagtgtttgcagacgatggcgtttgccatcactgtccagccgaaggacaagatcggatatctccagatcgggctgatcattacccaatgtataggtcttgagtgagcggatacccaatttttcgattaccatgccgattggcagcgacaggctttcgggttgtgtaactggctcttcctcttcttcagatggtgcgttatatacttcaaccgattgaatggtcagcgcttcaatcaaaagattacccgtcagcaaacgttgtggttgccagcgaaaatccagattttctacccgagcatccagctcatcatttttgaaagtgattgtttgtgcatgaaaagcatgctgcaaactgccggatatacccgaaaatgtcagcgcgccattcgtggctcgggaagcagttgcaaacaaccagtgtaggccagaagaagtaaaaaccagccaatacaaaccacttgtcatggccagcatcaacgctgccagcattcccgaaaaccattttctgaaacgccgtggagatttcacagaagattgcgataccggatttttgttatttatctgatgatccatatcagaacgccactgcaatggagaaatgcacccgtaatgtgccggtatcatgccgcctggccagatccagtgcaaacgggccggccgggctgcgccagcgtgcacccaccccgtaacctagcgctagtttaaaatcttcccacctgtctgccgcatcacccgcatcaacaaatgccgccccgccccagtcgttcgagaaccagtgaacatattcagctgttccagttgccacaacacgtccaccaacaatagcatttccttcacgcacgcccagactcagaaaatcgtaaccccggatagattgaatgcccccggcgcggaacaggtattcctgcgggatcccctgacgcgatgaagccagggtatagccagcttctgcacggaaatacaatgtatcccgccggccgacaggaaaccactgctgatgccggaggtagctgcggacaaagttccgatcagacagcacgtagctggaaccgccacccagtcgcacctctgaaacaaaaccactgtgaacatttaccggatcgtcaatatcgtggtagcgataccatgaatccagcgccagggtttcattcacggtattgggtgcgccagaaggttcccgttcctcgcgttgccaattgatgcccactttcaaaatggaatgagccgtggttcgtatcctggaaaaatccacacgctgattaaaggttttcaggtttttgatatcggtcttctcgacgcgtacaccggatgaataccgataacgattggcatccggcaaagtatctactcttgcagaaaatgtctggcgtttttgttccaggcgcaacaggctgcccagattccaggcacgccccaaaaaattgtaatcttgataattgatttcaccacgtgcgccattgttggagctgtagccaatgcctgcaccaacgtgtttggattttgcctcagtcaatatgactattaccggcacagcctcgtgcaaagcgggatctggtttgatcgtaacagccgccgaattaaatagctgactattctgcagcgccacctgaaaagccaacaattgatcccggcgatagggatcacccgggcggaaaggcatactgttttgaattacatccggttgatagcgttccagaccagtaatctgcagctctccataacgaaatgccgggccggaatcaatgatgatcgacaaggttgcctgggcggtatcgggatccactcttgcataactctcaacgatacgagcagtggcataatctctgtccgctacgttggagagtaaagcagatttggcatcttcccagcgtgcactgcgaaaaaccttacctggcttcagcgtccacccggcacgcaactgctctacccgtatatgctgttcgggctcatctgccgccagatttccctgaaattcgatggacacagcagcgacacgtgtgcggggaccaggtgtaacgcgcaattcatacgccttattattttcccgttcattaaattcgatttcaggggtaaagtacccttctgttgccagcagctcagtggattcctgttttattttacgtgcataagctgcctgactgatttcatccttgaatggcttggccggaggagtaatatatttttccagcagctttttggcagttgatggtgcaataatcgtcacttcaacaggatccgatttcttttccttttccgtatccttgctaatggcggaagctgccaaagcggtgccgcagcaggacaaatacaacaaacagagtaacaacaacccagcacgccaattacattctgcctgataaaaaaacttgtccagcctattcatacaggcgaaacaatatttgagcatataccacgaatacatatcctgtttgcttgagacactggtataaatttttgtggcgaaagggaaattcatggatagcatggctgcgataagtggcacccattttacaataagaggacaacatgtctgtatcaagactattccagcaggattgtcgtgactgcccacgtctggcacagcatctggatcaggttaaaacggatcacccagattatcatgctcggccagttgctcccttcggagatacttcagcaaagttgctgatcatcgggctcgcacccggattgcatggcgccaaccggaccggccgtccgtttaccggtgattacgctggtatcctactgtatcaaacattacataaatttggtttcgccaaccgcagcaaatctgttgcggttgacgatgcacttcgcctgattaactgccggataaccaatgcagtcaaatgtttaccacctgccaataaaccactaccggcagaaatacgacagtgcaatattttcctggcatctgaattgcatgattttgtaagcaatggcgggcaggcattactggcgctgggaacggttgcccatcaggctacattaacagcattgcaactccgaaaaacagattatccctttagtcatggcgctgttcaccctgttgcaggaagattgaggctttatgacagctatcattgcagtcgctacaatacccagaccaaacgcctgacagaacccatgtttgaacagattttcgacagaatttgtcaggatatggctgcaacttgataaataacaggagagtaaagatgccttatgtaaatatccggctggccggtacgctgaccaacgaacaaaaacagcagatcaccactgaaattaccgacacgctggaacgtatcgcacacaagcctaaatcttacgtttatattgcctttgatgaaatgccgcatgaaagctgggcaatcggcggccggctgctgggcagcgataagtaacaaggtacctgtcttgccggattcctctttcgacggtaaagcgtttgttctgacgctcccttctcaaccgggcgtatatcgcatgctgaatgcggccggcgatgtgatttatgtaggcaaagccattgatctgcggaaaagggtgtcatcctattttcaaaaatcgaatctgtcaccgcgtattcagctcatggtatcgcagattacagggattgagacgacagtcacccgctccgaagcggaagcgctgctgcttgaaaacaacctgatcaaaagccttgcgccccgctacaacatcctgttccgggatgacaaatcctacccttacctgctactgacgaatcatgcttttcccaggctggcgttttatcgcggtgcactggataaccgtcatcagtattttggcccatttcccaatgcaggcgtggtcaaatccagcattcagctgctgcagaaagtttttcgcctgcgcacctgtgaaaattcggtgtttaataatcgtacacggccatgcctacttcaccagatcaagcgctgcagcgcaccatgcgttaatctgatcaccccggaagcgtaccgggaagatgtcaacagtgcagccctgtttctacaaggcaaacaggacgaagtattaaaaaccatagaacagaaaatgtttgaggcatcggatcgacaagcgtatgaacaggcagtactgttccgtgaccaaatgcaggctttacgcatgattcaggaaaaacagtttgtcgacagcggcagagcactggatgccgatgttattgcctgcacaaccgggacagacaaacatactgttgcggtcaacctggtcatgattcgcagcggacgacatctgggtgacaaaacctttttcccgcagaacacacatgaagacagtatcagcacggtgctggaagcttttgtcagccaacattacctgaatcgcagcgttccaccactgatcatcctgggtaaaaaaatccgggtaacactcctgcaaaaactgctatctgaacaggctggtcacaaagtcaccctgacgatcaatccaattggagaacgacgcaagtggctggacatggcaaccgaaaatgcgcaactggcgctacggcaaaaacagatccagcaagccagccaggaagatcggttgcaggcactgcaggaggttttgaatctgccaggtctggcacgtatcgaatgttttgacatcagccataccatgggagaagcaacgatggcctcctgcgtggtgtatgaccattatgccatgcgtaacggcgaatatcggcgttataacattaccggcatcacgccgggagatgactatgcagcgatgcgtgatgtactacaacgacgctacgcaaagatagccatggaagaaggcaagctacccgatctgatcctgattgatggtggcaaagggcaaataggcgttgccagcgaagtaatgatagaactggggctcaatgatattccattggtaggtgtggcaaaaggcgaagcacgcaagccaggactggaacagctgatcctcccctggcaggaagaaaccttgcatctgccgaatgaccatccggctctacaccttatccaacagattcgtgatgaagcgcaccgttttgccatccagggacatcgggcaaaacgtgccaagacccgtaaaacctcctctcttgaacagattgccggcatcggcagcaaacgccgccagaatctgctcacccgctttggcggacttaaaggcgtaaaaaatgccagtatcgaagaattacagcagacagaaggtgtcagtcgggcgctggctgaaaaaatttaccgggaattacgctgacaaggcgacttaaacccagaaactgcatcaccaacagaaagttattctcgatgaagtcgcacacgccattgccaataacctaagagtgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgatcggggttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacacctaagctctgataaggcccttcaggcgttcctggacatgactcaatatccctcctgattttcaacgcgatgtactggctgggcgtcaacccaccattcagctcaatatcgatgcaacacgtatgtcacaagcctttatcggcagcggttatattcaaaatatcgttactaatgaggtcacgacattctctcagagccatcaaattcttcctgcctggccggccgaactcgaaatacgtgcacgctttaacccgaatctgaactcggtatggtttggctcagtgatggaagttatcaacagtattaccatgctgtctattattctcactggtgcggcgctaatccgcgaacgtgagcatggcactatcgaacatctgctggtaatgccactgacatccttcgagatcatgatggccaaaatctggtcgatgggtctagtagtcgccatcgtggctacggcttcgattgtctttgtcgtacaggatttgctcagcgtacccatgagcgctcaatcgggctattcgtcattggtatgacattacatctgtttgccacaacctcaatgggtatttttctcggcacggtagcgcgttcgatgccgcaaatggggttgttgatgatcattattctactgccactgcaaatgctatctggtggcatgacaccacgtgaaagtatgcctgaggcagtgcagtacctcatgctcacagcaccaactacccactttgtctcccttgcccaggctattctctaccgtggtgcaggtttcagtattatctggccagaatttcttgctctacttgcaattggtattatttttttcatgctggcacttacccgcttccgcaagacgattagttctatggcatgatcagaaacgaaagagacgagagattatacctacgggaccagaatcactaagcatgatacatcctaccttgcgggaaggaattatccattcgcccagccgattgtcactggggtcatcgaacggcaccctggtttcatgaacccgcctgccgggtgcctggctggcaatcagaatacgggctgatgcatgcaattgaaatactggttttggtctcagcggtaaaggttcagtacataaagacaccagcgcacctgatgaatcaatgatatgaaatcatccatattggcttgatctgccgcaaaatgatttgctactcactattaaaatcagaaataacacaaaagtttatgcctgattatggctttgagaaagacagaaattccaatttttttctatctgtcatgaacatttctcttgacaggcataaaaatatccacattttttacctgagttgttgacaactcctcaaacccgcgtcaatactggctgtaaacataacatattgtttctaatgaaaaaaataagtgtgcaaaatttcagcatatttcaaaatcctgtttgaaaagacacccttaaggcaatcatcctcaagttatacacaaacttatccacaggaattgtggacaagtttgtacgtaatcgaagcataaatatttaatagatcgcctggataaactttctaaaaacacgcatcgcgattgttacaatctcattgatctcaattttgttgggtttattgttgatatgctgcgtaaattcctgctttttctgctcgttctcacaatgattatcttggctactgcgtggttatttcttagaagcagtctgcccgtttatgaaggagatctgctgcttcccgggttagctgatactgtaacggttgaacgggatgcgctcggcacggtgacactaagtgctgaaaacagattagatctggcgcgtggcctgggtttcattcatgcacaggaacgcttctttgaaatggacttgatgcgccgcaaggccgccggagagctggcagagttatttggtggggttgcattaccggctgatcgcaaggcgcgtggctatcggatgcgtgcccgcgcacagtcaatgctgcaaaggctgccgcaagaccagcttcgtctgcttgaagcctatcgcgacggagtcaatacagggctaaacagtctcaaaaccaaacaatttggttatctgcttacacaaacgctaccccgaccctggcgtagcgaagacagcctgttgatcgtgcttgccatgcacataacactgcaggaaaacagcattgatcgtgaactggggctatcaatgatgcatgcctccttgccggaatctgcctaccgttttctgactgccagcggtggagagtgggatgccgccctggatgacagccaacttgaatggccaccctaccctcctgctaccgatattgatttgcgctcaatcaatcgacaaactttgtcaggcaacagctttcaggaattacccatcattggcagtaatgcttttgcagttgggggcgctctaaccaatggcagtgcactggtagccaatgacatgcatctgtctttgcaggttcccggcttgtggttccgtactcgtctagtttatccggatcctttgcacgcccagcggaagattgatgtaatcggcgtcagcctccctggtaacccggttatcgttgccggttccaatcgatatattgcctgggggtttactaattcttatggagattttgccgactgggtcagagtcaagctcgatctggataaccctgcccgttatgctgatcatggtgagtggaaagcaatcaaagtatggcaggaaacgctacatgtgcgtgatgcacccgatgaacagctcaaaatccatgaaactgagtggggccctattcttgctagagattatgatggcacccctctggcgctggtctggacagctttccagccagatgctgtcaaccttgatattattgaattggagcaggcagatagcttggaagaagcagttaggattgcgcaaaacatgggcattccagcacaaaatttcattgcaggcagtagaaatggcgatatcgtctggacaattgccggccgtattcctttacgcacgggcggctacgatgcaaatctgcccgcagattggggccaacagacaattggctggaggggctggcttgcgcctgctgattatccgctggtgatcaatccgccagggatgcgactctggaatggcaattccagaatggtcgatggcgccttgctgaaaaaactgggggatggcgggtatgatctcggcgcgcgcagtcagcaaatccgcgatcaattacgtgcgctcaatcatgttgcaccaaaagatctgctagccatacagctggatgatcgtgcactgctgcttgctcgctggaaacaattgctggaagaaacattacaaaaaatcccgccagctgcgtggagccgggaaatgcagcaagccttgcgtgactgggatggccacgcttcgcctcagtcggtagcttatcgcgtcgtacacagttttcgttacgctgttatggaacatattctcaatgcctttgcggcaatagtgaagctcaatcaccctgattttgtgcggccccgcctaagccaggttgaacatgccgtctggaagctgatcaagcatcgtccaccacatttattgccccccggtgatgatagttgggaggatatgctcgccgcttgcgcacaacgtgtgacagcatggctgcaagcgcaaccaggcggcattgccgcgcgcaattggggtgaagaaaatactgccgctatccggcatccgctcagccgcgccctgccgacatggattgctgcatggctggatatgcctgcagatcagttgcctggggatcaccatatgcctcgtgttcagacaccaaattttggtgcatccctgcgctttgtggtggcacctggagaggaagagaatggctattttcagatgccaggcggacaaagcggccatccgctctctccttactacggcagcggccattctgattgggtgacggggaatgccagcccgtttctaccgggaccaccacaacaaactttatatctgcacgccaccgaagttaagctatatcaataaaataacctggctgaaacagcagcaaaagtatcctccatcaccctggctggagacattgcgttactctagtggcatttgagtaatcagcaagttactgtttttttcctgatcaattcgatttagcttaatatttttacagggatgtcgataaaacttacacaatttaatgacagcttaatagccgcattctttaaagatagcagcatgctgaaatcggttaaatttgactgaggttctattttcagcagaaaggctgctagttttaatgtcagtaaattacgcataaaacagcaaaatcattccatatattcatattaaattcacaatgacagtcacgctatgaaagcaaatgaaatacaaaaaaaattgcttgttgtggaagatgatcccgggctccaaaaacaattgcgctggagttttgatgattgcaacgtggctgttgcttctgatcgtgaaagtgcgctggcacagatccgccgacatgaacccgcagtcgtaaccatggatcttggtttgcctcctgatccggatggggcaacggaaggcctggcaaccttgcagcagattcttgcattggctcccgacaccaaggttattgtgctgaccggcaatcagaatcatgagaatgcgctaaaagcaattgacatgggtgcttatgattttcatcaaaaaccccttgatgcgggtgtacttaatttgatcgtaaatcgggccttttatctgcaccggttacaaagggaaaattataagctgcagcaagctggcctgatttcatccgttcctggatttattaccggagatccggaaatagccagaatttgtcaacagattgaacgtattgcatcttccgatgttgccgttgcattactgggcgagagcggcactggaaaggaagtactggctaaagcacttcacctgctcagtggcagaaacagtaaacgcatggttgcagtaaattgcgcagcgattccggaatcattactggaagccgaattgtttggttacgaaaaaggggcttttaccaatgctgcaaaacagactctcggtaaaatagaaaccgcgcaagggggcacattttttctggatgaagttggtgatctgcctctctcactgcaggccaagctgctaaggtttttacaggaacgcgtcattgaacgcattggtggcagagaagagattccggtggatgtgcgtattatctgtgcaacccatcaggatctgaagaaaatgatcgatgccggtactttccgcgaagatttattctatcggctgtgcgagatcagcattcatataccgccagtgcgtgaacgcattggcgacgctgtattgcttgcgcatcacttcaagaatcaataccgtatcaaggaaaagcgccagacactcaacttcagtcaggatgcactgaatgcaatcagcagccaccgctggccgggtaatgtccgagaaattgaaaactgcatcaaacgtgctgtcatcatggcggagggctcccaaattacggcccaggatctgggactgcaatcagcagacaatcctgagcaacccgccaccctgcgcgaagtccgggaacaggcagaacgcgaagtagtcgccaaggctttggcccggatggatggtaatatcgttaaagctgcagaactgctcggcgtcacccggccaacactttacgacctgatgaatcgccacggacttaaatagcctataaaacctaccaacctcgttattacccagcccactcatgacttctctttttcacgaactggtttatcagtctgccgaccggaatatagattctgtagctctgattgatcagaagcgtcttttatcttacccggcactggccgaagcagtgcaatcattcgctggcaccttgcatacattagggctaagtcggggagagcgtgtcgccgtttaccttgagaagcggcttgaaacggttattgccctgtttggcacatctgccgcgggaggggcatttgtaccggtcaacccgttgctcaaagctgaacaggttgcctatattcttaacgattgcaacgttagagtactggtcacttccgttgatcgattcagcctgctcaacacggcattatcacaatgccatgatttgcatactgtaatcacagttgatgaagcacaagaatcatcgtcaatacccggactcaatgtcacttcatggggacaagcacaaatatcctcttctgaagctgtacacttgccacgttgcatcgacagcgatatggcggcaattttgtatacttccggcagcaccggcaaacccaaaggagtggtactctcccaccgtaacctggtaatcggcgcaaaaagtgtttcacaatatctgaataatcaatcgaatgatcgaatccttgcggtactgccacttagctttgattatggattgagccagctgaacactgcgttttatgtaggcgctactgccattttgatgaattatctactaccacgcgacattctctccatcatcaaacgtgagcagatcactgggctggcggctgttccaccactgtgggcacaattggcacaactggactggcaagatgtacagacactgcgttatatcaccaattccgggggtgctatgccgcgaaccactctggcacgtttgcgcgaagcactgcccagtacagagatatttttaatgtacggcttgacggaagctttccgttcaacttacctgccccctgaagaagtggataaacacccggattccatgggcaaagcaattcccaatgctgaagttatggtgctacgggaagatggctctcactgcgcaccaggtgaaccaggcgaactggtgcaccgtggcccactggtctcgctgggttactggaatgatccggacaaaacgtcagctcgctttcgtccccttgctccacgccaacccggattgaccatccccgagctggctgtctggtcaggtgataccgtgcgaatggatgaagaaggctatctgtattttattggccggcgtgacgacatgatcaaaacctctgggtatcgtgtcagtccgacagaaatcgaggaagttatctatgcaacagaaacagtcgcagagactgctgcatttggagcgccacacccgacgcttggccaggcaattgttgttattgccgtccccaaaacaggaatccaactgaaacaggataccctgatggcagcctgcaaaaatcatttacccgcttttatgcaacctggtttgatcgagttacgacagaccagtctaccgcgtaatccaaatggaaagatcgatcgaaagagtctagccagtgaatttcagcaagttttccaaacagaagaaatatgacgacgaatcaacctaaacatgcgccgatgatacagtttccggtacaggatcattgtcttgtcatcggcggcattccactcacacgactggctcaacggattggaagcacccctttctatgcctacgatcgccagttgatttccacacgtgtacagtctctgagacaacatctgccaccagacatacttctgcactatgcgatgaaggccaatccaatgccggcggtggtacagcacctggcaggcctggtagatggaattgatgttgcctcagttggtgaaatgaaagtggcactggatgcaggcgtgactccagagaatatcagtttcgcgggccccggcaaaaaccgtcaggaactggcctgtgccattgccgccggcattattattaatatggaatccgaacaggagctggaaacaattgctcaactggcagacgaaaccggtttccatcctaaagtcgcagtacgggtcaaccctgattttgagctgaaatcttccggaatgaggatgggaggaggctccaaacaattcggtatcgatgccgagcgcatcccggccgtgttgcaacgtattgcgcaattaaaactagattttgagggattgcatatcttcagcggctcacaaaatctcagagtggaagctattcaggaagcacacaaaaagacgctgcagctcggtttacagcttgcgtcaacctcacccgttccgatgcgcacaatcaacattggtggcggatttggcatcccttattttcccggtgaaaagccgcttgacttgagtgccgttggcactaatctgaaacgattgctggcagaaatccctgcttcttccccaaatatccggttcgtgattgagctggggcgttatattgtggcagaagcaggtgtttatgtatgccgtgtactggaaaagaaactatcaagagggcagatttttcttattaccaatggtggcttgcatcatcatcttgccgcttcaggaaattttggccaggttatccgcaaaaattaccctgttgcggtcggaaataaaatgtacattagtgaaaccgaaattacctcagtggtcggaccactttgcacgccactagacttacttgccaaccagatggaactatctaaagctgagcctgaggatctgatcgttgttttccagtctggcgcctatggattaacagccagccccacctcttttcttagtcaccctgccccgctggaaatactggtctgagaatctgctgtcgagctggtgcctttctctgtaatgatatgacatgcaaatcaaataaccattggtaaccagtacaaggaagtaaacaaattaaaaccatgcccgaatgctattatgacaatcgcatccaaggggtaatccggaaagatgaggagatgatatgagtggtatatgtggctggctgagtgttaatcattcggcaatagagaatcaacaggttattgatcgtatggcccgtttgctgactcgttttgacagcaatcctgttcaaatagcaacacagggcaacgctgtcctgtccgttgttgccaaagtaagccatgctcatctctatgaaaaagatagtttattggttggtatctgggggaggataaaatcccggaatgaacagctgcaggcggatattaatgccaaaggaatggctgcagcgcttgcagatctatggttgcagaaaggtgaaaaactattctctgatcttggcggtgaattcgtgtgctgcatcgtggatagccatgcccgcaaagtcgcactggccattgatccactggggacacatacgctctactaccaacagctggataatggaatcctgtttggctcctcggctgatgtcctgctcacacatccgcaggctagccaggaaatcaatccacaagggctgctcaactacctttattttcacatgatcccgggacctggcaccatttaccaggctcaacagcgcctgcttcctggtgaatacctatattttcatgatggccgtgcagaaatcaatcactacacgcaggctcagtttaatgaggatataaagcgtccgtttccagagcttcaacaggaatttctctcgctgcttagaaaaagtgtcagtgaagtaatacaagatcagaaagccggggcatttctaagtggaggcacagatagctccaccctggcagggatactgacggaagttaccggggaaccagctaaaacctattcaattggttttgaggcaaccggttatgacgagatgtactatgcacgaattgctgcccgacatttctcgacagatcatcacgaatactatgtcacaccggatgatgtagtcgaaaccatcccgttgattgcgtcggtctttgatcaaccttttggtaatgcatcggcactgccagcctattactgtgcacgcatggccaggaaagatggcctggatttgttacttgggggcgacggtggtgatgaactgttcggcggcaatgtacgttatgcaaaacagtatattttttcactgtatgacaaaattccggcgcccttgagaaatcacctgctctcaccgcttatcctctctattccgcccgataccggtcccaaattactccgcaaagcacgtagctatgtcgcacaggcaactgtccccatgcctcatcggatggaaacttataatctattaacgcattatggctttgaggctgtattttctccagaattactggcacaggttaataccgggcaacctgcgcagttgatcgaacaaacttaccacgatgcttctcacgcgcgtagcctgatcaaccgtatgctcgccttcgactggaaatttacgctggcagataacgattttcccaaagtagttcaggcttgtcgtctggggggtatggaagtatcttttccgtttgccaatgatgaaatgctcgctttctctctcgctttggatccggatctgaagctgaaggggacgcagctgcgctatttcttcaaacaggcattacggggatttttgccgaatgagatcattgccaagcaaaaacaggggtttggcttaccgtttggtgtctggctgcaatcgcacaaaccgctacgggaaatttccgcagatagcctgagcgacctcaaagctcgtaacatcatacggaacgatttcatcgataagctacttgatcagcaccttcacgaacacgccagctaccatggtaccatggtgtggctgttaatgatgttagagtactggttcaaacagcatacccggtaaaaattcaagattcatccaatcatcacaaaaaacaacacaaaaaatatcatcagcttgtcatattttagcgacgtaagtatagtttaatgtgtcttgtccagacgacactattatccagtttatattttgttgattaatattctcggaaatacgattgattgtcatgatgcaagcagcaaaatgcaaataaaatataaagtcatatcgtttatatattccccgaattgaaaattggcctgaacagtaaaattcatcctgattagccagcatttttggctctgttttttgttttagacaaaacttatagtcaaggggaaatatgaatgatcttgaaaaagcttttcaccaatattttgaaattgtgcatgctaatacgccggagctgcttaaagaggctttcggcttacgttttcgtattttgtgcgtatataacgatatctctggtttcaattcagtaaattatccagataaactggaaaatgacgaatacgatagtcgctctgcgcatctcttgctgcgccatcggccgaccgatacattcatcggaaccactcgcctgattctgcctgatttgcaacatccagaaaacaaactgccaactgaactgcatacccaattttatcctgaatttcaggtagatccatcatctcgtaaacataccgctgaaatatcccgcttcgccatactgagcgatttttttaaacgtaagaatgaacactatacgctggctggacctgttgatataccaacccgacctgctggcaaacctcacgaacgacgtcgctttcctcatccgatgctagggcttgtcgttggaattatacaaacatgtgctcagtatgaaatttattacttactttcatccatggaaccagccttgaacaaattgttgggattttacggcttgcaattgaattccattggcccatcaactgattaccacggacttcgcagcccttatcatgtctgcctgttagatgttctggacagaatttaccgcgatcagcggacaatttgggagcttgttactgaccacggaaatatctggccggccgatctgactcttctgcgccaacaaaacaggcgacaactcgctgactacggtagcgctcgcatatcgggaaaccaataacattcaccattgtgacgggaatttttacttactgccttcggggcactcttctccccgcactgctaattatgctttttttcacggataatgttttatcctccgataacgcggttgaagtagtagtccatcccggcaccaatgtcaattatctttccaagaatttattacgtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacaattacgctctgtctttagtatgcgccttagaacctggcaaagcggtgtaccgatccgggttttcgtgctgcctgacgatgcgccgttacacggtatatttgccaaaaagaaactcaatgtcttcccctatcaattacgcctcgcatgggatcgcctggtctattcaggaaccggacaagcaccactcgtcgtgtactccgaagaagagatgcgtacaaaaattgcgacgacaccgggatcaatcggttatttaagtgaaatcaagattgatggaagtgtccaggtcgttcatatcaatgaatagcaaaaaatttttcaccaatccctttttgagcatcgcagggttacttctgactcttttcgcaccatccggatttgctgatgggcatcagggagtacaaattctgaagcagctgcaggtacatggtttcctcagccagggatatatcaagacaaccggaaacaatgttttcggtcacagcaacaactcgggcagctttgatttcagggaaatgggcctgacagcctctctgcgcccgctacccagattgcaattctccggacagttacttcaccgcagggcgggagaaggcagtgacggtggcatccgtattgattttggcttccttgattacaattttattaatacgcccggggtagaacttggcttgcgcctgggcagaatgaagaatccgtttgggttctataacgatacccgtgatgtgccctttacccggccaagtatactgttacctcaatcaatctattttgatcggacccgcaacctggcactggcttcggatggcgctcagctgtacggagaatcacgcacagattggggaaatattaccattcagcttggtgctgcttttccgcaggtagatgacaaagataccgaaacatctatttttggtcatacaaccccgatccgaggatatctgaaaagcaggctttcatatatcggccgtatcctctacgaactgcctgacgggcggctacgcctggctgtcagcagcgctcagctcaatgttggctatgatcccagccaaaatgatatttttgaatcgggttcattcagattctctcccctgattctgtcagcgcaatacaatgcagaacgctggagcataacttcagaatatgcgttacgttattctcgccgtcatggttttggcaaccccagacttgatcagagttctaccggagatagcttctatctgcaaggtatctaccggttccttccaggctgggaagctgtattgcgctacgatctgcttttcgccaacagaaaagatcgcaacggcaagaaatttgcagccgtaagcggccatccggcatacagtcagtacgccagagatttgacggtaggattacgctggaatattactccatccatcatgctgagcactgaatatcatcggatcaatggaactgcctggctttctccactggataatccggatatcaccagtactaagaaaaactggaatctgtttaccgcacaaatttcctatcggttctgatgcaagatcaagtgaaacctgccatctccgagaggccagttgatttaaaaaatactggccataaattttttcggatatttatcgggctaagctggaaaatttccctgctgagtagcctgattttactgcttgtggtaaccacgttcagcatgatcaactacaacagcctgatcgatagcattgatcaacaaagagaaacacaataccagcgttacgctagagaaatagaaagcctaatcgggcgcaattctgaaagtttacacggactcgtcagagttattccctacttaaaagggatgaaggccagcctgcaagcagctaactcacagaaaatactcacaacctttgaacggtactggacattgttccagattcagagcgatatcgaagatattcgtttctacagttcttccggatcattgcttgcacggtggggcaactttgatgccaatgcataccgggacaaccttattcttgagcatgttcgtgaagtcaatacgcgtgaacatcctgctacgttgatgatctgtgttgaaagctgtacccaatatattattgaaccattgctgattgatggggtacgaacgggtgccattgttattggctcttctctggttgatgtttttttgaatttcaaacgtgcttccgattctgatattggcctgtttgtcggacgtactgtgaataacacacacaacaacatactgtcagataacaatgctttcatggggatacctgaatggaatgtctccattacggctctgacaaacagcggtaaaaatctcaccatcctgagcaaagtagccaaaagtcacccaaatcttgcagaaattgaacaaggtatccaatatgaatggaataacagacattatcagatcaagctgctcccgctgcatggtatccgtatacctgaccaagggcagctggttatcattaccgaagtaactgataccgtccaggcaatccagaattccatttggcgtattgtcgtcatcgggctgatcgggatggtattttcagagatcatcttgtttagcatgatttcaagaccgctatcccgcctcaaatatatcgtatcgctcctgccattgctggccgggagaggattcggcagtttccgcagtgctctttcctcgcactggcgaaggcgtcggttgaatgatgaaattgatcttctgcacgatgcatcactcacgctttcacataagcttgaaaaattggaagaaaaagttgcctaccgcacccgcatgctggttcaacaacgtgacgaactcagcaaggaaaaagattttattgagaacctgctggatactgcacaagtcgtcgtcctgacacaggatgccagcggaaaaataatcatgactaatacatacggtgaaatactgacccggtacagcgaagaggagctgcagggtaagcactttatggagctgttggcgccggatggagagcaatataatctggatgtatatttactggaaatccgtaagggaaatcgtgatcagttgcggcatgaagcaatcgtactatgtaaagatgattcaaaacggaatgttgcctggctccattctcgcctgacgtggcaatccaaggatgatccttccgtgattctttccgttggactcgacattaccgagtacaagcgggtggagggccatctggcgtggcttgctgatcatgatccactgacaaatctgtacaaccgccgccgtttcagtgaagaactggaacagattctcagttgggcggaaagatatcagcatcccggggcattgctgtttttcgaccttgatcgattcaagtttgtaaatgataccagtggccaccaagcgggtgacgcgatgttgaaaatggtcgctgacatgttatcccgtaccgttcgtacggctgatattgctgcccggttgggtggggatgaattcgctgttatcctgcctgaaatcatgcccggagctgccattgaagttgccaaaaaaattctggcccggctgggtgaaacacaactttcacttaatggcagaacacacaatatttcagccagtatcggcattgcgatctttcccgaacatggaaataatgttcccgacttgctggccgctgctgatcttgcgatgtatcaggccaaggaaacggggcgtggaacctggcatctgttttccagcgatgatcaatcacgtgaacgcgtgcgtacactggtttactggaaagaaaaaattgaatacgccaatgcgcatgatcggtatctgctctatctgcagcccattcaaaccttgcgcgacggaatgacccatcattacgaagtcttgctgcgtatgcaggatgaagacggaaccattcattctcctggagcattcatccgtgcagcagaacataccggtcttatccacaaaatcgatcatctggtgctgcacaaggcaattgcattggccgcaagaatcaatcaagcagaaaataggcgcattggcttctccattaacctgtcagcacacgcctttaacgatccggaactattaccgaccatcagccaggcgctttcagttaaccagattgatcctggcctgttaatgtttgaaataacagaaacagctgccttggataatttgcccgggacacgcggccttttgtatgatctcaaacaactcggctgtggctttgtattggatgattttggggtggggttctcttctttctattatcttcgtgaattgccggttgatgcggtcaagatcgatggctcgtttatccgtaacctggcgagcaatcccgatgatcagatacttgtcagtgcactgtgcagcgtagcaaagggattcggtaaaaagatcacggcagaatttgttgaaaacaaggaaatagtaagcattcttgacaaactggaggttgattttgcacagggctattacattggaatgccaaccttggcagaaaaactcttccctgatactaacggctaatgattagagaattatgcggataaaaaaaccgccccgaggggcggttagaaaatttgaaccatatctcttctcaatttttgttttgttctgtcttaggttcagacttatctacattgtcaggcatggaatcacgttccattgacatgctaggtggatagttggcgggtttatccgtatcaagacatccagtcaaagtaacagctgtaatcattgcggcaatcagtatatgtaagagtttcatttttcctatctccctatagctatttaaaaataatatagtgtctttctctacactttttctgcctggccttcgttcccgaaaaaccagcgcttgctattattatcagaataaaaatttattgtccagaaatttataagcggcgtgtagactgactttgagattgttttggaactcattgaaagtttggaaaaatcaatatcccccatcttgtttcaatctgtatttttaaggtgcctatttaaccagtaatgacttcataatcgtgcgtgatgttaactgtcgccttcagcatcatggaagcagagcagtatttttcggcagataaactgattgaccgttccacttgccgcaaatccaggtttctcccggtaatgatgaaatgcaaatgaatatgggtgaacactttcggatcttcagttgcacgttgcgcatccacttcaacctggcatccggtaatttcctgacgacctttacgcaaaatatgtacgacatcaaaggaggtacaccctcccaggccaagcaatatcatttccattggacgtgggccttgatttttcccgcctgcttccggtgcgccatccatgagtacagaatgcccgctcccaacctgtccgagaaaactgactccttcctgccatgcaatttttgctttcatttattttagagataagttgatcgtagatagaaaactattcttttcgattgccttacaacgattgtcatcaacagcaaaatacatcccgagcttcaaaagcgcttcccagatatctcctttcgtgactcccttgatcattcgatcaatggcagccgcctgcagcaaagcccgcaccagcaattgatagtgagtacggtgaaagatacctgcaatcagtttttgccttgaaggccatacgcgcaatgctgccatggcttgttccagcgtcataccctgactggagttcttggtcaggtggatttttatcagcaaacgaatctgctctgacaaaatagccagtatcagcggcggagctaccccctccccctgcaacccctccagaatacggttataacgtaccatatcggctgtcagcatagcttccggcagctgcagcacatcaaagcgtgtaacatccagaatggcattcctgatctgctcaaaagttaatttaccgacaggatagagtaatcccagcttttttatttcctgatgagctgccagcagattaccttcaaccttatccgcgaagaattgcaatgtatcccgatccgttgtttgcttctgctgtccaagacgctgtttgatccagtggggcaactgatcacgcctgaccggttttatttcggtgatccgaccggtacgttcgaatgccttgaaccacttgctggcacgtccctgtttatcaatttccggtaacgtcacaatggtcacggtatcgcgcggcagatgttgacaaaatttttcgataatcatactgccttccctgcccggtttaccggatggaatacgtaaatcaagtatgcgacgttcgctgaacagggaggattgacgtccccaatgaaacaggtttatccattcaaatcgctgatcaaccgtaaagatttcacgcgcaatgtaaccctgatctttggcatgggcacgaatccggtcggttgcttccgtgaccaacagtaactcatcacccagcacaacatacagagaggcaacaccttcaccaggttgactggtcacaggcttcggatctagtctatacacagctcacccgagggtaacagccgtaatctggcgaagaatctgttgtacggcatctttctgcatatccttgtacagcatttcttcctctgctgccttggccagctcctgtgcatccaggtacggaagaatgcgtgtcaacctgatttcctgcaagggtgccagctcggtattatgtgaatccagcagccgagcagctacccggtaaattagctcaaattcacgtacccttcctccctccgagagagaaagaattcttttttcccggatcgcatgcacaatctgaacaactgcgtcggatttttcgatcttctttactacccgtgcttgcgtatgggtagtaattactcgctcaagatcagagccaatagtcatccctgcaggcgctctaatatagatccgctcaaaaggaagttcggaaacctgcccgcgcaacttgaagccacaggcagccagattcaataccagcaagatggacagtaaagctcgcaacgttatcatccgcaaaatacctgttttgttaaacaacaatattgaccagtcttcccggcacgataactaccttcctgattggctgcccggcaatattcctctgaacatgctcatgctccagagctatccgctcaatagtggcctgatctgcttccctggcaatacgtatttgcccgcgcaacttgccattgatttgaaccacgatttcgatttcatcctggatcagcgcctgctcatctgcctgtggccaaggctgatcaagcagctcagtaccaggcctgagttcactccacaagatatgacagatatgcggaacaatgggtgaaagcagcaatacgctgttttccagcgcttcctgcatgagctggcgtgcagccgggctgatatcttgtacgccggccagcttgttcatcagctccatcaccgcagcaattgcggtattaaacgtgtggcgccgttcaagatcatcagttaccttgactattgtctgatgcaattgacaacgtaaattccgcagatcggctggatattccaaatgcggtattgcatcagttgcagacatgtcacttccctgctgcctgtgcagataaacctgtcgccatagccgtttgagaaaacggaaagcaccttcgacaccggcatctgaccattccagtgtctgcgtgggcgggctggcaaacatcataaacaaacgggcagtatcggcaccatattgttcgataatttcctgcgggtcgatgccattattttttgatttcgacatggtgccaataccaccggattcaaccggctgaccatctgtctgcagcacggcaccgatttttttcccttctgcatcatactgcacatcgacttctaccggattgaagtactgaatccggccgctgccggttttacggaaaaatatttcattcagtaccataccttgcgtcagcagattggcaaaaggctcatcgaatgacaccagcccgagatcacgcatgactttactccagaaacgtgaatacagcagatgcaggatggcgtgctcaatgccaccgatatattgatcaaccggcaaccaataattggctcgctgatcagtcatagcggactgctgatcctgacaagcgtaacggatgaaataccaggaagaatcaacaaatgtatccatagtgtcggtttcacgacgcgcctgccgcccgcagcgcgggcaggtacattcatagaacaaaggtgtttttgtcagtggattaccggagccatccggcaccaggtcttccggcaaagtaacgggtagctgatcatccggtaccggtaccacaccacattggtcacaatgaaccagcggaatcgggcaaccccagtaacgctgccgtgaaatgccccagtcacgcagacgataccgtacacgcttctccccctgttccttcagtttcagcttcgtagcgatagcatcaaccgcatccattgatttcaggccggaaaattcgccggaatcaaatgtcataccataatcagtaaaagcctgcgcaagtggtgcagataattcatcatcttccggcttgataacaggtctgattggcaaagcatactggcgggcaaaatcaaaatcgcgttcatcatgcgccggcaccgccataacagccccttcgccatagctcatcagcacatagttggcgacccacaccggcaagcgttcgcccgtcaatggatgcaggacatacagcccggtagccatgccttttttttcctggagcgccagctcggcttccatagttgcgccttgccggcaggattcaataaaagcggccagcttgggctgattttgtgctgcgtataaagcaaccggatgttctgcagcaactgccacataagtcgctcccatcagcgtatccgcccgggtggtaaagactttcagcgcttgcggcattccggatgcaatatctggtgaaaaaataatatccacgccgtagcttttaccaatccagttagcctgcatagcttttacacgctccggccaacccggcaaattctccagaccagccagtagttcatccgcataacgggtaatagccaagtaataaccggggatttcccgtttctcgaccaccgctccggtacgccaaccacacccatcaatgacctgctcattggccagtaccgtctggtcaaccggatcccagttgactacctgcgttttctgatacgcaatacccttttccagcatgcgtaaaaacaaccattgattccagcgataatattctggatcacacgtggccagctcccgcttccaatcgatagccaaccccagactttgcaactggctacgcatgtaggcgatattgtcatacgtccattttgcaggcggcacacctttctggatggcagcattttcagccggtaatccaaatgcatcccagcccatcggctgcatgacgttatacccctgcatacgacgataacgcgacaatacatccccgatcgtatagttgcgcacatgccccatatgcaacttgccagaaggataaggaaacatggacaggcaataatatttcggcttatcaggtatttcggttgtattgaaaatgcccgtttcctgccagctttgccgggcctgttgttctatttcctgtggatgatatttttcttgcatggatagatggagttttctgccggatgaaaattaaaaaattaattatacagtcaaccattctgactggcagaaagctccttgcaaaaacatctcatcacagcactttctcaaaaaatacgggcattttactggtcgccggtataatccgcagcatgaaaactgatgattttgatttttcccttcccgatgaactgattgcacagtttccgctcgcaaaccgggcagacagccgaatgctgtatgtaaacagcgatcaatctgttttacgtgatgcggctttcaaagatctacctgcttacctcaaaccaggcgatgtgatcgtattcaacaatactcgtgtcgtcaaagctcgtttggcaggcttcaaatccactggcggcaaggttgaagtcatgatcgagcgcattctagatacgcagcaagcgcgggcattgatccgcgccagtcatgcgccggcgattggttccacgttattgctggaaaatgcgattaccgtgcaggtagaagcacgcgagcaggatatttacacactgcgcttcatacactcacggccactcatcgaattgctggatcaatacgggcacactccgctgcctccttatattgaacgtatcgctatagtttctgatgaaagccgttatcagactgtttttgcccaagaaactggagcggttgcagcacccactgcaggcttgcattttgatgaaaccatgctgacaacattacagactctgggagtaaaggtcgcctggatcacgttacatgtcggagctgggactttccagccagtgcgcgtggaaaatatcgatcagcacattatgcataccgagcgataccatatcccggcagaaacgatagaaattatacggagatgcaaggccggtggtggaagtgtgctcgcagttggcaccaccagcttgcgtgcactggaagccagcgcgttgattggtgatggagagctggttgctggatcgaacgaaaccaatctgtttattactcccggatttcagttccgcgttgtagaccgactgctgaccaattttcatctgcctcgcaccaccttattgatgctggtatccgcttttgctggcatagagactattcgtcatgcctatcagcacgccgttaataatcattatcgttttttcagttacggggatgccatgctgattgagggtgatagccgatcatgaaatttcagctgcattgccacgaccatcacgcccgacgaggaacgttgacgcttgcccatggcatgatagaaacaccggccttcatgccggttggcacttatggtgcagtcaaaggattatctccagacgagctgcaaaccctgggggccgaaatcattctgggcaatacttttcatttatggttgcgccccgggctagaagtgattgaagcgcatggcggattgcaccggtttatgcactgggacgggccgatcttgaccgattcaggcggattccaggtattcagcctgggcgcgttacgcaaaatcagcgaagaaggggtacgtttccgctcgccagtcaatggcgatacctgctttctgacaccggaggagtccatgcgcatccagcgtgtgctgaattcggatattgtcatgattttcgatgaatgcaccccctatccggttgatatgcaaattgccgaagattccatgcaattgagtctgcgctgggctgaacgctcgaaagcagcgcatgccggtaatccaaacgcactgttcggtatcgtgcaaggtggcatgtacgaatcgctgcgcgatcgctcaatagccggcttgtataatattggttttgatggatacgctattggcggattatccgtaggcgaacccaagctggaaatgcagcggatcctcagccataccgcgccacagctgccggtagacaagccacgttatctgatgggggtaggcacgcctgaggatattgttcgtgctgttgaacagggcattgatatgttcgattgcgtgttgcctacccgcaatgcgcgcaatggctggctctataccagccaaggtgttctcaagctgcgcaacagccgttatcggctggacacctccccgccggatgaaaattgcgattgctatacctgtcgccattttacccgtgcctatctgcatcatctgcagcgcaccggagaaatgctcggcgcccggctcaactcgctgcataacttgcactactaccaacggctcatgtctgatatccgtaaggcgattgaagctggtcagtttgaacagtttgcatgcagattttccagctagaacttcatgctaaaatatataacgattcagtttccattcatacccaattgaaggagaagaccttatgctcataaaagaagcttttgcccaggccgccaatggcgcagctcagacttccgaccccactctgatgagttttctacccatgattggtatcgtggtcattttttattttttgctgatccgtccgcaaaccaagcgggccaaagagcaaaaacaaatgcagaacgaattacagaaaggtgacgagattatcatcagtggaggagaactgggccgagttgtgagcaccggagacagctacctcaccatggaaattgcagtaggcgttgaaattaccgtactcaaatcttctgttcaaacattattgcccaagggaacgctcagaagcatagaaaccggcaaaagcagccgggcactcaaaaacggcaagcagaaatctaatgaaccccgccaggccgaaccggaaaataaagaaactgaaatcagtgaagttgattcaacaaaacaggataacgaaaagaattaatttaccggtatgctccgctcttttttaattatctgaaattgtggcgtaacttccggcaccctctttcttctgaaatactggccattatgaaccgctaccccctctggaaatatattgtcatcgccgtttcgatcctgcttggactgctgtacaccctgcctaatttttttggtgaatcccccgctgttcagatttcaccactacgagctgacgcacggaccgatacagcacttttgcaacgtttggaacaagtccttaaccagcaaaatcttccgtataacggaacaatactggaagcaaccgggatcaaaatccggtttgccgatacagatactcagatcaaggcgaaagatattctaagttccgaagttggtagcgattatgttgttgcactaaatctgctgcccaactccccgcaatggatgcgtcacattggtgctttgcccatgtatctgggcctggatctacgcggcggagttcattttatgttgcaggtggatatggcaggtgcgctcacaaaatctctcgatcgtttcagcgctgatctgcgcagtacattgcgtgaacaaaggatcccttctgccggtattgagcgggatcggtcaaaaattataatcagattccgcgatgagcaagcacgggaaaaagcaattacggaacttggaaaagcatttgaagatctcgcttttcaatcagaagaggttggcggagaagcacgtctgacaatctccatcaagccggaagcactagtgcgtatgcaaaatactgccgtccagcgcaatatcaccacgctgcgcaaccgagtcaacgagctgggtgtggcagaaccgattattcagcaggcaggagccgatcgggtaatcgtgcagttaccgggtgtacaggatactgccaaggcgaaggatattctgggcagaaccgccacgctggaagtacgcatggtcgatgaagagggtgatattgatgctgccttgcgcggatcagttcctcctggcaccgaattgttcaccgagcgcgggggtggcccactcttggtcaaaaaacagatcctgcttaccggtgaccgtatcacggacgcccaacccggatttgatcaggatcaccaacctgctgtccatttgacactagacaacaatggttcacgaattttcaagcagctaacacgtaataacgtaggtaagcgcatggccattctgctggtggaaaaaaatctgaccgaggtggttactgcgccggttattcgcgaagaaatcggtggcgggcgcgtacagatcagcggaaaaatgagtagtattgaagcacgtgatgttgctctgctgttgcgtgcgggtgcgctggctgcccccatggaaatcgtcgaggagcgtacgatagggccaagcctgggagctgagaatatctccaaaggcttcaattcgactctgtttggtttcctggcggtagccacattcatcatggtttattactcggccattggtgtcatctctgttgtggcactcgccgtcaacctgctatttctcattggattgctctcaatcttgcaagcgacattaacactccccggaatggccggaatggcgctgactgtcgggatggcaattgacgcaaacgtactgatcaatgaacgcatccgcgatgaaatccgccatggtgcttcaccacaggcagccatccatgccgggtatgagcgtgcatgggatgcgattatcgataccaacctaaccacgttactggccggccttggcctgatgatattcggtagcgggccgataaaaggtttcgctgtcgtactatgtctgggaattctgaccacactcttcagtgcagtcaccgtttcgcgcgcaatggttaatctattgtacggaaaccgcaaacttgcgcgtgtcccgatcggaaccatcaaaatatcgaagaaaagtagcaacaaacattaaaatactcactgaaactggataaccatggattttttcagattcgaacgcgatattccttttactcgctggggaaaattatcaatgactttttccctgatcatctccatcctggcgatttattctctcgtcacaaagggattgaatcttgcagtagattttactggcggcaccgtgatggaaatcagctaccaacagcctactgatctcgataaaacccgcaaagtccttgccagcatcggaatgcctgatgcaattgtgcagaatttcgggacatcccgagatgtcatcatcagacttcctgtcaaggcagaacacaccgggggcaatttgtccgagactgttatgacagcgctcaaaaaggatgatccctcagttgaaatgaggcgagtggaattcgtaggtccgcaggttggagatgagttattagaaaatggcttgctggcaatgctgtttgtttccatgggcatagttgcctatctggctttccgatttgaatggaaatttggtgtttcttgtattattgccaacctgcatgacgtattaattattctgggttgtttctccttttttcaatgggaattcgacctgactgttctggctgctgtactggctatcctgggttactctgtcaatgaatccgtggttatctctgatcggattcgagaaaatttccgcaaattacgtaaagcagatgtaacgagagtaattaataacgctattaccgaaactatgtcgcgcaccataattactcacgggagcacacaattggttgtgatctctatgcttttatttggtggagaggcattacataattttgcgttagcactcacaattggcattttgttcggtatttattcctccatcatgattgccagcccgatacttctattactgggagccaagcgagaagatctggtcaaaattgaacgtaaacctcaggaagaagctgtgccatgatgttgtttttggtatcttgaataaaaaatttttgattttatggctggactcaatccacaaacacccattcctacagagttaaagttgtatcgtaaatcaggagtgttaagtgtaaccttcaacgatgggaaatccttcagatttccctgtgaattcctgcgagtttattcaccttctgctgaggtacgtggccacgagcccggccaggaagttttacaaaccggtaaaaaggatgtaactatcacgcatattgaaccagttggccggtatgctgtgaggctggatttttctgatggccacaatactggattgtattcatgggacttactttatgattatggcttgaaccaagaaatcatgtggcaaaattacctgcaacgactgggagcttccggcagtagccgcgaagtaaaatagcaatactttccgctaaacattaattactcattcggaatatatcctcagaataatgaatgccacacactttggttttacaactgtttcagaaacagaaaaagctcgtaaggttgcagaagtcttccattcggtagcagcacgttataacctgatgaatgacctgatgtccatgggattgcatcgtctgtggaaaaaatttgcaatcgatgtcagcggtgcgaaaagaggcgacaaggtattggatattgccggtggaaccgctgatttaactgctttattccgggagaaagtaggtgacacaggggaagtctggctgaccgacatcaacaattccatgctgtcaattggtcgtgatcgtatgctgaatgatggtaaaagcgtaccggttgctcaatgtgatgctgaaaaactacccttcccggataattattttgatcgggtttgtgtcgcttttggtttgaggaacatgacacataaagatattgctctccgggaaatgtggcgtgtgttatccccgggtggttcgctcatcgtgctggaattttccaaggtgtggaaaccactgcagcctttgtatgacacttactcctttaaggctctcccgtttatggggaaaattgttacccgtgacgatgccagttaccgctatctcgcagaatctattcggatgcatccctcccaggaagatctgaaacagctcatgcagcaggttggatttgaacgggttgaatatttcaatctgacagcgggcgttgtagcactgcatcgcggatataaattctgatcttgcttttggtacgaaacacatgaatctgtccacatgttcaaacaggatttacaacagcccgccagctttgcgttttgccagcagacaaatcaggtcgcaagcaatatgtgctgcagccagtgcggttatcggactgtgatcatagggcggagatgctcctacgatatccattccaatcaggttgattgcagtaagcctgcgaagattgataatgcctgtgcagttgatagccccccacaaaccggcgtgcctgtacccggtgcataagctggatcaaggcaatcgatatcaaacgtaaaataggctggctgattaccgacgatacgttcaatttctgcaaccactgcatctgtcccctcccgatgtactcgaccagcatccagaatattaatccccatgaaatcatcatcccaggtacgaataccaatctgtaccgaatgcttgatatcaatcaaaccatcctgcactgctttgtaaaacatggaaccatgattcagtgaagctggagaattatctggccaggtatcacaatgcgcatcaaaatggattaaagacagtgtggggtgccagttttctctacatgtgctttcaacaacggaaagaaaaatagagtgatcaccaccgaacgtcaacatgcgcgcaccagatgccagaatatgtcgggcatgatcgataatcgcctcatgaatcgacattggattatgtacatcaaaaaagcagtctccaaaatcgatcgcagcaagattttcgaatggatcaaatccccatggataaggtttgagcgaagccacttcagcggaagcctggcgaattcccggtggcccgaaccgggcgccagaacggtaagataccgccaaatccagtgggataccgctgatcaccagctcggcacctgtcaagtctttccggaaactgcaacgcataaaagaaagtatgcccgagaaggtcggttcacgcagcatgccataaggtgttttacgtactattgctccatcaattttgacagggtcattcgacatgatccggttttgtttcctttatcgttgaatgtactagtatgacgtggttagaatcttgcgccatgatggtatcctggtaatagacaggatagaccattgatcctaatacgatagggggtaaatcagttcgcgctgatcacagacaaatccccgaagattctgtctcacccttcctgaatagaatcgttctgtctattcagaatcccgtccagaatcaacaagcacgctccgcagactatggctgaatcagcaagattaaatgctggccaatgataaccactcacgtgaaaatccagaaaatcgacaacatgccccagcataatccgatcccagagattgcccaatgccccccctagaataaagctcaacgcaatacaaaacagccggtttgttgtgttcttgtacaacagataaataatcagagctgatacaagaagagcaattgcgctcaaaaaccagcgctgccagccagaagcattactcagaaaactgaaggctgctcctgcattgtaggcaagtacaagattgaagaattcagtgatgacaatctgctgaccatacgataaattaagctcaacccagcgtttgctgagtaaatccagcatcaggatgattgtggccaaactcagactgaaatacagtttcatcacgcacccctatatattttcccagtgattcttcacaggaatcaggcatagcgccggtgttcaccaggccccgaaagattgctcacacaacgactacacagtgatggatgttcagcaatcgaccccacatcctgccgataatgccagcaacgctcacatttctgatgagggctggcagttacaataattgtttctttaatagccttatctacatgctgcaaatggacttcagacgtgatcagtacgaatctgagatcgtcttccagcgaatcgagcaatgtatagttttccccgattgtgcaaatttctactgtagcagcaagtgatgaaccaatttttccctgaatacgcgcatcttccagttgtttcaacacccgagcgcgcaactcacgcaactgctgccagcgctggatcagaatttgcgcatctcccggctgctccgggaagcgatgccaggtatgcaaaaaaatactgtcatccgtcgatccactcagttgctgccagacttcttctgcagtaaagctcagcgctggtgcaagcagacgtgcgagactatgcactatgtgatagagcgcactctgggcagagcgtcgtggaatcccatccatcatcgtggtatagagacgatctttgaggatatccagatagaaccctcccagatcttcggagcaaaaatgatgtaaccgggcaaccacctgatggaattcataacgttcataaagccggataagctcattctgcaatgtttcagtatagacgagcatgtaacggtcaatttctatccattcctgcggtggcaatgcatctgtaaccgggtcgaaatcagccagattggccagtagaaaacgcagggtattgcggatgcgtcgataggtttcaaccgtgcgcttaaggatttcatcagagatggacaattctccggagtaatcggtagaagctacccacagccgcaaaatatcagcaccgagcgtatcagcaattttttgcggagcaatgacgttacctttcgatttactcattttgtaaccttgcccatccactacaaaaccatgcgtaagcagggcagaataaggcgcatagccgtcaatcgcacaccctgtcagcagcgacgactgaaaccagccacgatgctgatcagagccctccaggtaaagatcagccgggtgctttaactgtggattcgtttttagtacagtttcatgcgtggtgccagaatcaaaccagacatccagtgtgtctgtcagcttttgataatgttgtgcttcttctcccagcaactcagccgcatcaaggctaaaccatgcttcaatcccctgttgctcaaccagatcggccactttctccagcaactcctgtgtctggggatgcaatgtatgcgtttccttgtggataaaaaaggtcatcggcactccccagttgcgctggcgagaaatacaccagtcagggcggttcccaatcattgcttccaaccgcgccctgccccatgctggatagaaacgggtgagttccactgaatgaatagcaaggtcacgtaataatttttcgggagagtgcgaatcagcggattgctgcataccaataaaccactgcggtgtcgcacggaaaataattggtgttttatggcgccagcagtgtgggtaactgtgctcaatttcttccacatgcaacagatggtcatccgcttgcagtgcatcaattacaacaacattggctttccagacaaacaacccgccaaccagtggaatttcctcccggaatttaccgtcccccttgaccgggctatcactgggcaacccatactgctggccaacaaaatagtcgtccaggccgtgcgcaggtgcggtatgaacaagacctgtaccggcttccagcgttacatgttgtccgcagattattttaacggtgcgatctgcaaaaggatggtgtaagggcaacccctccagtgcctgccccttgcaagttgccattacctgcccttcaagctggtaacgggcaagacaagtatctaccagctcggaagccagcaacagccacccctgggcggtactgatcagactgtattcgaactcgggatgtatacataccgcctgattggcaggaagcgtccacggcgtcgtcgtccagatcacggcaagaatacgggtatcatctggaatctgtatatgcattgctgcggcaagctggtgataagcatcctgctcgtttgccacttcaaagccaacatcaatcgctggcgaacacttgttttcatactccacctcagcttctgccaaggctgagccacagtcgatacaccagttgaccggtttttgcccctgataaagatgaccattgcgataaattttcccaagcgcacggataatgccagcctcagttgcataattcatcgtaaggtaaggatactcccagtcacccagtacccctagtcgcatgaaatcagctttttgtcgatctacctgttgctgcgcgaaagctcggcacagcttgcgcacctgatccgccggcaaatgtttgccatgcttcttctcaatctggtgttcgatgggcagaccatgacaatcccatcctggaatataaggtgcatcaaagccagacaaggttttactcttgacaacgatgtccttgaggattttattgacagcgtggccgatatgaatatcaccatttgcatagggtggaccatcatgcagaataaatttcggccgcccctgactggcagccctgattttctggtaaagatttttttcctgccaggccttgagcatgacgggttcacgccgagccagatctccacgcataggaaaaggcgtatcaggcaggtttagtgtttttttataatcgttcgtcatatcagcaatccaggcaagctgttgcatgcatggaagaatccatttgggaaaaataggccttggcgtgaacaacgtcctgttccatttgtttcacaagcgtttccatatcagggaatttttcctcatctctgagtttttgcaaaaactcgattcgcaaccgttgcccataaatatcttcatcaaaatcaaacagatgtacttcaagtacgggctgggcatattcgagaacagttggccggactcccagactggccactccccttgcccgttgtgtgaaaccggagccattgcgccaacttgcttccaccacaaaaataccatttaacaacggatgatgatcttttagttgaatattagcggttggaaatcccagtttcttccccagcttcaaaccatccacaactcgtccgcccatggtgaaaggacgtccaaggagttctgctgccaaatcaagatcatcagatgctagcgcatgacgaactgccgtacttgaaactctcaattcattcaatacaaccggggacattacctctagctccctcccgcctgattccaaaaataatttctgcaacaaggcaacatctcctgatcgccgggcaccaaagcaaaaatcctctcctaccagcaaccagcaaacgttcatttcctgcaacaaaatgcgtgtaacaaacaattctgcgctgattttcgcaaacgcatgattgaaacgataaatctgaactcgatccacacccagattcgccagcagctcgagtttttcacgcagatttgtcaatcgagcaggggcacgatcaggcataagaatctcccgaggatgcggctcaaatgtcataacgcaggatgcagcccccaaacgacgcgctgctcgcttcaatcgcgcaatcatcgcctggtggccaagatgaacaccatcgaaattccctatagtcagcgcaactggctcctccttgctggctgcagcccgcctggttatacgcatgccaataattcgatgactgatcgaccggaaatatactctggttgaatagctacctcgtgacagcctgatgactgttccatgacgatctcagtagcgtagatttattatttttcatacttctacagcatcaagaccaaccggctcacgatgcgggaaatgactcatctgatagcccatccagaggcgtccggcgataaattcagcgacggtatctgcgtgctgtttcagatccggattccccaattcatgggtcgtttcccggaaaagctgcagccagcgtctaaataatgctgcgctgagctcgggtaaagcaacatgcttgggcatgggcgcaccacgaaaacggctggtgccacgtaactgtgctgaccagaaattgatcatctgcacaaaatgcgcatcccaatcaatcacatgctcctcaaagatgggacccaatgcagtatcttttctcgccttggcataaaattcgtgcaccagttttgaaacttcttcttcggtatacagatcgggactaggttccgggataggacgaggtatcatgacgttgtgtttaatatattcgttggattaaagttcgcgcatatcagatagtttgaataatgatccgacagcctgaaacgaccattttctcatatttgcaatatagcttcgagtctttgtatatagccccgatgttatttaatctctctcaattgttcatgaaaagaaactggatacgggtaattgacgcgaattacctttctgtactggccggcttctacctgaaaatgaaacttaataaaataatatgccagatcagcttgttaatgccgtgcctgatactatccggttgttcagatgtctggaacaacccatacccggattcggactctggtaaaaacattctttacaatgcttttgctgagcgtcccaaacacctggatcccgtacaatcgtacagctcgaatgaaatcctgttcaccgcccagatttatcaaccccccttgcaatatcattttttgaaacggccgctgactctgattcctcaaacagccagcaaaatgcccgttgtaagctatcaggacggcaatggcgtgcaactgcctcccaattcggctggtgctcatgtcgcctactctgtttatgaaatcaccatcagatccggtattctttatcaacctcacccggcattcgcgcagaataagcatcaacacctgctttatcatgcattgactcggcaggatatacagacagtccaaaaaatcagtgattttgagcatacaggaacacgagaactgattgccgatgactttatctaccagatcaagcgactggcccatcctcggctgcactcccctatctttggcttgatggcagattacatcgtagggctgcgcgaatatgctgaaactttaagagatcaagataaaacccaaccccaaaacagcttcctggatttacgcaagtttcctttgaccggagtcgagcggatagatgattacacttaccgtattcgtatcaagggtaaatatccgcaatttatctactggctaaccatggcattttttgcaccagttccatgggaagccgatcacttcttctcacaacccggtatggccgagaagaattttacactcgactggtatccggttggaaccggtccgtacatgctaactgaaaacaacccgaaccagattatggtgctggagcgcaacccgaactttaagggcgagtactatccggatgatggtatgccggaagatatggaaaatggcttgctgcgtgatgccggcaaagcattgccattcatagataaaatcatattcagccgtgaaaaggaaagtattccctactggaataaatttttgcagggatattacgatgcctccagtattggctcggacagctttgatcaagcggtacaaataaccggacaaggtgaagcggccatcactgaagaaatggaggcgcaaggtattcgtcttggaacagaagtagccccatccacctattacatgggatttaatatgcttgatccggtggtaggtggccgtactcctgaggaaaaagcggcagcgcgcaaactgcgtcaggccatttctatagccgtcaattatgaagaatttttgaccatctttgccaatggccgtggtattgctgcgcaaggtcccattccaccgggcattgaaggctatcatgaaggtgaagcaggcataaatccgatttcctatgaatggcataacggggaagctcggcgcaaatcaatcaaacaagcacaagcattgcttgcagaagccggttatcccggggggatcagtcgtagaaccggtaaaccgcttgtactgtattatgacgtcacagcacgtagtgcagatgacagatcaatcatggactggatgcgaatgcagtttcagaaactcaatatccagctgatagtacgcagcaccgattacaatcgtttccaggacaagattcgcaaggggaacgcacagatttttgaatggggctggaatgcagattatccggatccggaaaactttctgtttttattgtacgggccgcagcgcaaagtggataacagtggtgaaaatgcggccaattacgataatgctgaatacaatcggctgttcgagcagatgaaaaatatggaacatggcccagagcgtatacagattattgatcggatggttgctattttacgagaagacgctccctggctatggggttatcatccaaaaatcttcgctttgtaccatgcctggtatcagaatgtgaaacctaacagaatggcgtacaacacaatcaaatattaccggatcaaccctgaattacgtgatcagaagcgccatgaatggaatacgccggtagtatggccaattggcataggaatagtattattgataattattctattcccggcgcgagcagcttatcgccgtaaagaacagcacagaatattgaaaaacagatagcttgactcaatgctaaattacattattcgtcggctgttttatgcgattccgatacttgtcggcgtcaatctcatcacatttgcacttttctttgtagtgaacactcctgacgatatggctcgcatgcatctgggaacgaaacacgttacagaagaagctatctggaagtggaaacaagagcatggttacaacaaacccctgctctacaacaacgttgcttacggaatcgagaaattcaccgacactattttttttgaaaaatccgtttcgatgtttgctttcgattttggccgtgccgatgacgggcgcgatatcgctcatgagattcaatcacgcatgtggcccagcctggctattgcgttgcctgtatttctgcttgggttactggcctacattactttcgcattgataatggttttctttcgggccacctacattgatttctggggtatcgtcctgtgtgtcatgctcatgtccatctccagcctgttttatatcattgccggccaatttttgatcggcaagctatggcacctggtgcccatatccggatacgccagcgggctggatgccacccgcttccttttgttgcccattattgtgggtatcatcagcagtgccggcgccaatacgcgctggtatcgcaccctttttctggaagaaattaataaggaatatgtacgtactgcccgagccaagggattatcggaaaatatagtattgttcaggcatgtgctcaagaatgcaatgatccccatattaaccggggcagttgtcgtcattccgctgttatttcttggaggactgattactgaatcattttttggtattcctggactgggcagctacaccattgacgctattcaatcacaggattttgcagtagtacgcgcaatggtatttctgggatcattgttgtatatcacaggattggtactgacagatatttcctacacctttgcagatccaagagtacgattagaataattatttttttctgttgcttgacctccttctccgagtaaatgacgatactgctgtaattggcatgaaatgctggctgtaataaatatcaagcaatactatttttatcactttatgatggtttaactcattttgagactggttctgtacagtataaaaagcaagattgtaatttttgctgtgattgccactttgttgcctacaatcagcctcagtctattgtcattcaagcagaatgaagcgctgattagcgacagcgttacccgtgaactgcgcatgcttgctgacaacaccaatcgccagctggatcaatgggcaggagaaaatatgcttgccatccgcgcattatcaacatctagccccgttattgagggattgactactttaaaacagttttcagatagcgagagtgctagtgccgtaaagcagacgcaatctgtcatggccagttatttgcgctcggtacagataaagctagatgaagtacttgaattaactgtttttgatgccacccgaaaaattgtggcaagcagtagtactagtacgcctgaggtacgcgacccccctgaacaatggacgcatacctcccttacttcgggaaccattgccatccctcccgcctggaacgatcgttttgctacagcaactattagtattatttatccagtgctgtcgtatgacagccagttaataggtgctatcgctgccactctggatttgggaaccttcgaaagcagattggctgaaatcaaaaaattttcgtcaggtgaaattgtcatactggatcagcatggcaaggtattgctgggtagcgcccccggcgttgatcaccaggcagtattaagcctgcatcaatgggaattaattcagatgttcaatgaaccaatatcctatgatggattatcttatccaaaagcaatcggcttagcttatacatcagaaaatattcccgtaacgatcctggtagagcaggatcacagtgccatacaagctgcatggataaagttacgtaatcgttttcttgagtttgtcagcatacttatcattatcgtaaccgccgtagccttgtatatggggcattctattgttacaccgctgaaacagctgatcaacgcagtacaagggatcgtagaaggaaatttggatatttatctgccagccaagcgaagagatgaagttgggcagcttactgatatattcaatcaaatgacgagggcattacgcaacaagcatacagaaatcatgaccgccaatcaggctatgcagcaacaaaaccaactactgcaaaaactctcaatcacggatggtctgacgggcctgtataaccgcacaaaactcaataccatcctgtcagaacagctagccagattcaaacgccacgaccgccccttctgcctgctgatgatagacattgattatttcaaaaccataaatgataaacttggccatattgtgggcgacaggattttggtcacggtagcttccgtcctgctgaaatcgatcagaacaatagactatgccgcacgttatgggggggatgaattcgtggttattctgactgaaactaactccagtgcagcaatcaaaacagcagaacggatccgggccgaagtcaactctgcctgccttgcattcaaggagcatccagcccacattactctgagtattggtattacccaaagttactacgatgatataacgccgaatgatctgattgctcgcgcagatgcggcgctgtatgaagccaaagaatccgggcgtgaccgggtacactgtgctgatgcataacactctagtcggcttcaacataacttactccatccggacacaatagaaatggaatataaggattattatcaaattatgggcatttcgcgcgatgcgacacaggacgatatcaagcggacgtatcgtaaactggcgcgcaaataccaccctgatgtcagcaaagaatcggaagctgaaacacgtttcaaagagattggtgaggcatacgaagtacttaaggatcctgaaaaacgggccgcctacgatcgtctggggacacgctggaaaagcggacaggaatttcaacccccacctgaatgggatcagggatttgaatttcatggaggtgaatttacacaatcggcagcttcacaattcagcagttttttcgaagcgctattcgggagaaaccagggtggtcagcggcatagtaatcagggattcaacctgcaaggagaagattcccatgcaaaaatttcgatagacctggaagattcctttaatgggggtgttcgcagcctgactctgcaacacacggaacccggcctggacggaaggccacacattcgggagcgcacattaaatgttcgtatacccaaaggaatacagcaggggcagcatattcggctggccggccaaggaagccccggggcaggccgaggcaaggcgggtgatctatatctcgaaattgtatttaagtctcatccgcactttagcgtggaaggtaaagatattttcatggagttgcctgtcgcgccctgggaagctgcgctgggcaccaccatcccgattccaacccctaccagtaaggttgatctaaaaattccagccaattcccgttcaggccaaaaattgcgcttgaaaggacgcggaatcccgagcacattaccgggtgatctatatgtagttttgcagattgttttgcctcctgctgatagtgaacaagctcgaacactttatcgcgagatggagcagaaactcgcattcaacccgcgagccagattcaatatttgattatgacatatatggaacacggcatattaaatggcattattattgaagaaagtgaagggatttcactgcttgagctctgtcagatttgtaaagtcgatactgaatgggtaacagcactggtgcatgaaggcattctcgaacctgttggagctaaaccggaacactggtttttcagtggaatttgtttgagacgtgtgttaattattaatcgcctgcagcatgatctggatattaacctagcaggtgctgcgctagtggtggagctgttagaagaaagggatgctctgcttgctaaaactaatttgtaatcgctcgtaattgtattaaaagcagtctcatagaactaccaagtccttattgaacagctggttaatttcatacaatacccgatcgttatgtctaatacccagttaaaaattcgtatccggctagatcagccaattgatcactctgcagctgagcaagacttgctgaaactggcgaaagaacctgtattaccagcccctccccttgtgtatgtatataactggcccagaattattggtgcatcgctggtactgttgcttgtattggcagtgcttttctggctagcttcagactggatatctggcgataaagaatccgggataaatccagccaaaatatcctcatcagcagtacttccagccaatcccgatattccccctgttccggcagcacaatccgtttcagccataaccgagctttcgtccagccagtcatccgggagcaatccaggagccgatgaactcgttggtatacataccaaacctgagcatatcgaagatatacccagtccgatatttgattcaatttctgcagccacatcggatccaccaatcaaaccgggaaccaagcctggtgccactgcttttcaatcctcagaaagtggtgcacaaaaaatcaattatcctgttggtctggttaaagcacaactgacttcaaatatccgacaaagagctccggttgatgatatcaaccggatttcactcgcgggaaagtcaagccgaccaatcttcctctttttacattttaataaattcaaaggtggaaaaatatttatcaattggtactatcgtgataaacgtgtcgccaaggttatgcttccggttagcaataatgactggcgcacttattccagcaaggtacttaatcagaacagattgggttcgtggcgtgttacagccacggatcaatcaggcaaatggcttgccgaatttaaattcagagtaacacgttaatcacatctttccagacatgaaattctgtagcgagtgtggcaataaagtagttttacgtattccgaaaggtgacacactgccacgctacatctgttcaaactgtcacgccatccattatcagaaccccaaagtaattgttgggtgtattccagaatgggaaaataagattctgttatgtaaacgagcaattgcacctcatcgaggcaagtggacattgcccgcaggattcatggaaaataatgaaactctggcccagggtgcaacgcgggagactttcgaagaagccaatgcccgagtagaaattcgcgaactctatgcaatttacagtctgccgcatatcagccaggtttatcttttattccaggcaaaattactggatcttgatttttcaccgggaattgaaagtctggaagtcagactttttggagaacaggaaattccttgggacgatatcgcttttcgtgtaattcatgatccactaaaacgttatctaaaggaacgacagcatggacaacctgagcctcacatgggaataatcgacaaacgccaggattaacactgattaattgtttagtctcaagaaattattatttgactaaaatcaatttatgctttaaagttacgggctcagtcgcggggtggagcagtctggcagctcgtcgggctcataacccgaaggtcgtaggttcaaatcctgcccccgcaaccactttattcctctcaaaacctcaaatacgttgatacgacttatagagtcgataacgtttgtgtatcattacaggacgactagtcaatagtttacgatcaaggagccttggctcaccaaacatttaatatcttttctgctgttttttatcaaacttagatttacctcagacttgtaatttcttccgatctagccacttattatttataagtcatgcctgtttgatgatatttgcaagactattctgcttactcccaataattctcatgctgtttctcaaaaattttttcgagtacacaccccgaatctaaatgtttgccaatacactcggaagacgtgatcaactagagactgacagatagccaggaaaaattcaggccacaaacagacaaacacctgtaatttcaccacttctgattattagttgctgtatttaatacacccttgacttgcctgaagaaaagaaaataacgaggtatttgtcgcaggcttgcttgactaacttgcacttactgaagcacacgcctaggagctctgggtaaatataagagctattgtcaaatctggtgtatagagaatcaagcggctacctgttttcgatctccattttgtttaacgccgttaacgaatttgacgccctgcacaacatccgctaacaatttatagccccttagaacctgtttacgatcttttgagtagtagcgccaggaaggccagatgaatgaactgcaagctggtattgagcttacgctcgcagtttttccataaccttcggctcttctccagccaggcaaagctgcgctcgacgatccagcgtttgggtatgactgcaaaagtgtgcagttcactgcgcttggcaatctgcaccgtaacaagttttcctagaatttctcgcgcgccttcggcaaacggctctccagtatagccgctatcgcacagcaggctttgaacctgccccagactctgcttgcagcgttttagagcttgcaatgctcctttgcggtcagtcacttccgccgtcgtcaccgcaatggcatgcggcaagccctgggtatcgacggcgatatggcgcttgatacccgataccttcttgccggcgtcataacccttctggccagccgtgtccgtatttttcacgctctgcgcatccacgatcaagaacgtgctgcaagcgttgcgcccccgtttctcgcgggccgcgccaacctgatttttttaatgcctgctccaacacactcacgccgtgctgatcgggctcactccatttgcgccaatgagcatacacgctctgccatttgggaaactcaccgggcaggaatctccattggcaaccggtgcgcagcaggtacagcacagcgcagaatacctcatacagatccactgtcgtgggcttggtgctgcgtcgcacgctgcgcaatagcggctctatctcggcaaacttctctctgctgatatcactggcatattttgttctcttcatctgcacattatcaaggatagcagaaagatcgtaaacaggttcttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctctaaatataatggcaatcaaaataatctgaactaacaccctaaatgaatgaaaaaatttcgaatcagctagctagcactggcactacgaggcagaatcatcaggtgataaaggcaggccataaagcagctcggccatgcaagcgttatcatgacaaagacatatgattggagacaggaagggcaatgaaaccgccccgacaaaatagcaatttagcagtttgtgaaaatgccacaaaaagaagaacacatgcaaccatttgattaaaatggctccccgacctgggctcgaaccagggacctgcggattaacaggccactgttattcagttgcaaatcagaagtatatctttaaaatctattccgcaattattgaaacatgaccaccctgaaatgccctatccatgcgggtcaaaaatttattgcggaaatgttttcatcgttttgttgaggccaacagaacgatttgattctcgataattgataaaagaaatcccccgccatcgaggagctaatgacaggggattgagggatcctgatctaaagggaggaaagacaggatcaaaaaataaatgacacgactatcttaaccttcaactatttcaggattgttacaaaccaaggaaagttcaattttgcgtggctctccgtaaaggaatcccctgccaccagggggtgatggcaggggcagatgctgtcaaatgacagctatcaagaaggagcgtgagttgcctcacgcacaaccatgttattccttatcaagaactattatcatccgtaatgaagggtgtttactccctttatctgcgttatgaaatccgtacttttatggcaaggcactaatcctgatgcctgaaagttgacattgattgaactgccaagtaatccttgacggttgcctgcaacccccggatctgttcgtttgcgcgatccaggtctccgcctagtcggataatttctgctgcaactctatcaagatcgacttcgatctctcgatcccagtcggctgatccgttggtggctgcatcaactgctgcgggggtggcggcaaccttgggcactgctggacagcgtttgacgcgcagcctgtcgtagtcagcagtagtatcagcaataatggtattgagcttcgtaagccgcttgtcgtagtcattggatacctcgcttattctgttggccatcttgcgctcctgctgagcagcagcaactcttgcagcagcagtttgtgcttccagccttgcatccttgtactgcccgcataaaaaagccccgctcgccaatccgacaagcagggcaatggtggcagcggttaaactactcggcataaagatcatcctgtgcctgctcgtacaactttctctgcctgatcaatttagctggcacagatgcgataaccagtgataggccaaaagcacgaatccattcgactgggaaagatgcttgcacctcaataggcaagctgcgccagatctccatcagctcaggcgcgaatgccacgatcgatgatcccgctgctaccatccaagttgatatttgcttccaccaggtacgccaaccagaaattaattccatgtttatccccttgtgattaaatcgacggccgccttgtgaaaggttggccaagtagactgatgtggcttgccgggacgccagcacctcaaataaagctgccatgcaccggcagtatcagtaacggctggcaacggcctcggatccgtgtatagcagcagccgagccatgacagtagcaagttggtcatgccattcaatcgctgtgtatacatccgccctgtctacgtggatcttgcccagcacccgctcaatctcacgagcagatgctgcatgggtcaacacaccccgcacaccaccgccattttcgaattggtaaaatccgcgcgcgatcctgctcggctgttgtgcccggaatataaatctggattcctgcagaccgattgtcagcaacatcactctggcttccggtgtgtcgtaattcctcggaattgctccacctgccagcagccggaaagacggtgtcaggatttcatcatttacaaatcgcagatccatcaaatctccacctcatgcgtttgcatctgtccatcgaccaggcgctcatacgtgatttttttaacgccctgctttctcagccagccatgcaatgcggcagcattcacaaccgtaaatctgccactgctggtgtccatcagattcaacccacttacacgcgcatgatcgccagtcatttcaagtgctcccgcccacctgactggatcaccgtaagtgcctgtatcggactgtccagtgccgtgaccacgcacgatgtatacctgcacatgttgcccggttggttccagtgataccccaccagatagattgatggcgctcacttttccctctccatatcttttatccgtttctctataacgttttccacaaggaatagaagccgggttgccatatggccaccaacaccactaccagctgcacataccccaagaggcatatcaacagcttcaagcgccatgaataccagcatccctacaaaggctgacgtgatcatctcgccaataagctcaagtgcactgaaaggtctcgttcgctcgcaaggcagcttctgtatgatgctggctaatccccctacgattgccataacgatagcaagggtccatacctcaatgctccacgttgtaggatccttatcgtggtgcatactcaaccaaatcgtttccagacataaaaacctcgcacaaatttgctaaactcaaacaagtttttctccttggtatagacaaggggcagaaacaagaaagccccatagcgttgcgagcgcctggggctttcgtctaattcagtgattacgttttatttggcagcagcagcaaagagcgcatccatatcttcttctgatagcactggactgcgccgctccggacctttgtatgggagtttgttcaaaatggtagatttcctaaaccggagagataagatctttaatcggcgcgttccagctgttgcccaattgatcaataccaagacagtaaactttctctagcgaagatatcggaaggctgaacgtaaaagccccgatggcatctgtcaaaatttcacctaaaagcgccccgctttcacggtgataacatcgtgctatataaccgtctgctactgagccgtccggttttagaagtgttccagatactgttttatttcctcccggaaatgaggatgttggaggatcgccgccagtaccgacggatagaaaagaactgataaattcttgattattgtttggatatgagatcccaacttgaccagatgaaaaagttgaatctgttgcgcttatgttccatgtggccggctccgggtccggatgtttccatgttttgcactttaaagatgtgccgatgcattgaaagcgcataaataggggcacctcgtgcgccagcgctgctgtcggcaaactcgacaaagacggtatgttaaacattatcgaactaaacacacccgagacaaccttgtacaatgaaacggtagcaccgtttgaagataaatctgtattggcattgattgccgctagataacaattattaggccgtttgtcacttgtaaaactgccatcaccccttgcgtaaatattaatgactccgctgctattggtgtttgaaggcggagctattgaactaaaagtggctttatataaaatatcgacatctgcgaacgaccccaagcctgcgccgattgttctaaaatcagagcccaagccttttatcagcattccatttccccaagatttttttataggggatgtgttcatttcagcgtcgttatatgtgctcgcagcgcctcgcaaaagggctggccattttccagaatgacctattgataaatctaaaaaatactgtgccatagaaaatctttattgcgtaaattgaagttgaacactatttccggcgtctggtgtataattattttcgaaagtcatcatgttttcaccagatgaccactgcataacatgcgtctgtggttgtagagattggtaaccatccctaacagcgtataactcaactcgtagattaataacccctgccaaaaaaccaactccgataacatcggaaattccagttatcccagtattgctatattttagatcgttgtttgaatcgtcataagcatagacgctgtacgttgtgcctgtttcaggcgtgacggtaccgtcagaaaaaccaatcaaaaccgcaccggtttgctgcagtcgatttcgttccacccaactcaaagaaacaggcccggatactgcatttggaaaataactcccatttatcttgaaatttcccggaggataaggccggagtgctctggaatctagcgtgacggtatcttgaggtgcatttgccagcgccaatcttccggcgccagtgaccgtcaacagtttgacgttgatttgctcgctggcaatatactcagttggatctgcctcgccatattcatcccagaaaatcaggctatcgccatcggagtgagaggcaggaacagtatccaatacgccgcgttttactgtgatgctagacgtagtaatcgactcaacactcattagctctgtgcccagctggaaccaagtgccgagcgttatagcttcgatgtcctgcacttctctgatggcaaacgtggtggccatttgatcaatagcttcatccaaaacagcacaaggggagaaatcgagattcgagacatcttcatagccgttgcccatatctgtatagatgcgggcggataaagcagccccttgcggacgggcggcacccgcacccacaaatcccatatctgggttgccggccaacagcgcatcaatggccggttgaccttgtcgctgtaccagttcaaagtaagggacttcaaatacagcatacctggcgattggtacaggttcctggcctgtatccggccgctctattggcgggggaacgatgatggcggaatcgggcgttgcaaatgcatcctgcacgcactggatccgaacacggtggcttctgccgtctccataagcaataccagtcacgcgcatcaccatgtcagttaaatcatagacaggccaggtgagcttgaatacatcaccaacgttaaggccggctgccgcgcgattcgcataaatcgtgcagctggccagcggcgttgataaggttttcagatcacgctgagcaacacgggatgcgatgtacgcattggtaatgccttcgtaagtgacagatgtccccactgttgattgttgctgttgcgataacgcgatgtcttgcacagtcagtgtggcattttgccccgtctcactgttccaataggtgactgttactgagttgatcagctctccaatcgagggacgcttaaagtcagctattttttctacattgctttcattaagcgtcagcaggtttgcggggttgtagtcatctcggatgagcttcaggacgaaccggccggtcttacggtcaacatagacggaggcgtcaatatgcttgacgataattttaataaattcttctatgctggtctcggtatcccacaacagtgacataccgaatccttcagcgtacagcgtatctgctgcagccatgaatgacagatcatcgatatccgcctcaagatagcccattccccacaatggatctgtcaggcattcccggatgatatgggccgggttcatgtccccagtggttccagcaccaactatcagcacatttttaaatctggttatggatggtgagctatcttggtcccttacaaacataagctgactcactgcaatctcttggggttgaggatattggccagttgagattgttgctgagtctgacaagcgggttattttgtatcctaaattgccgggacttacattagcgtttacttccaacctgtaccagacatttacatctaatttatctgttgctattgcgtgattgccattaatcattggcctctggagcgcgtctacaactgcctcccgaactggattaaaactaaaccaagcggttccattatcgctggctatagcaatcctcatagaatccccggcagaaagccgctcaaccagaaattcaacagaaaagcttttaataataagagttggaatttgtcttttgtaaaaagaacttacagaaccagctgcggatcctgaatttctgatggaattctgttcgacgatataagcggcaggatcatttgactcaaatatagccgtgtttgagaaagtttcgtttacattagcccctacacctagtccagatatttcagccttgctgtcgtgccactgcggcaaaccgttttgacgggtatgaatacgctgcaaccggaatgaccactttttgagatacgggttcatgcccacatagatctgccgcagcaccatgcccgcaacacctcgaaatgacgggacataactcccgagcttcgacaacaggtatgaattttgctcttgcgcagcgtggccggtttcaaagtctaccgctccctgaatgccgccttcgcgcgattcaccaccgaaaacattcggttggtttagtgcaatctggccgccgctcaaccggccatcccacacatcacgttcatctacctggatgcgcagaagcctatcgacagggccgtgacacagaatcatgtgcatcccgacatagtatttgtagccgacggttacttttttagagctgcccatcttcttctctagcgatcttcaccacttgcaatgccatcgcatcgccggttgctgctaacttttctgcttctatcccttgcttgagaaataaaccccagtccagcccgtggtgcagaaaaaaatcgcgggtaccacggctgcacatgcctgccttgcggatatgcaacatggtcacagttttatctatcacttcttgccgcccttcttcttgatggcaactgtcttcagatcaccgtaccacaccacgttcgcctgcttgatgtcccgcgtgccaaacagcaccgggatggctctgccttcttctgccgtgggagcttccacctggcccgctgtcggactctggttttgcgacttgggctgaaacgctacggatatcgccagcgcaacaacgaatactgctatggtccaccacatagatcctctatacgattgatgagccgttgaacggatttttcagcgggatgtaaggaaacccgccaaagttgttccggttgccgaacttgtcattgcaggtggtgattgtccggtcgcagccgggataaatggtgatgttgaaatctcctgcgaaatcaaccggcctgatcagagtgatgctcgatcctgagtggttggttatcatccggaatacgccaccagccgttttgatcatgccataagtaaaatagccggcgggataggaagccgccgcactgattgtcatgctggtgccactgaccgccgtagctatatcggcaactgcaaacccggccttatccagattacagcctttgccgtacaaaacatgcgggcagactcgctgatatttctggcgcaatccaggccggcgcaatgatgtaaagatggattccaacagcagctctatagtggcatccgttggcttgattgatgccagcctgcctttccagacgactgtcacatccgcatcttccttggcaaatacagtcagggtgatcaggctatccagggatgattgcatccatgttctggcactagggttattgagtgatacggttaccgtcaagtcggcccgggataactcgttacgagattctggctcactgcggccaagtgtgacagggacataagtttcgccggcgtacacgacaggcgcatcggaggatgtccaccgcacgacggcattagtacccccgcgcaactcgacaaaacggtatagctcgacagatactgtcacggctgtatctctatgatagtggaggtgatctcagccacccctctgccaatccagcgcacgctcaagttatccgagtcaaaccggcacagcccgagatacgacattatgtcgatagcattaatatgcaaattcagcgctggcgacaaggtaagctgaatacgctgcgcatccacctgttcggcaaaagttatctctctgtaccgcaagatctctccatccctatctctcacggcgatgtgtttccggtgctgtccataggccatataggcatcgctgcgcatgatcagggttgttgtgatcatgcctgcattcagcgggtgcagattaacttcatacagtggcagccagaacaacccggctttgccttgtgctctggcgaaccagcgtttgtaatcgctgactgattcaaagccattaaccgttttgcgggcaggtgaggttatccgggcgtagatccagggcgataatcttgagacgagcccgagatcaaaatccaccctatctacctgctggtgcatcgatcggtttatcccggaaccggcaagctgcgggcaatcgtcaaaaacgtcgtagccgagatactggcccggtgtggccggtactatttccgaataatcatcaatctcgaacgctacctgcagttcagtgactagccggttcagatggcgaccagagctgccattcaaccagccgagcctgactggcatcagcgagcactcgccgaatgaggccgtatctgtggtgatatcgatataccctgatccggcgatagatatctccacgatctgccagtgtgattcggtttgccagagcaatgcgagtgagccattgcggaagtcatagccggatgtatcgcatgaaatcgtcgtctggtgtgccgatacgctagcaagcgattgcgcctggtgccacaaggggacggcccagcgcttgtctatggcgccatacagcgtgttgaagatctccgctccgtgggcagcagatgaagcagcgcacgaataggcaatggtttggcgcggctttgatcgcagcgccacccgctgctcggtaccgttatacgatctgatgatgtcggtaagatactcaagagtttcactaaccgggtccctggccgggactggcaggaacgccagatccccgaacagcgtcgtcgtcaccttagccatggttgacgacttgcctgacctgatctggattgcgtttgatggtgttgatcagtacctgctcaccttccggggtggatagataatcgcccaccaatgacggatcaaggacgttgacagcgttgagattgacgacgggcggtgcagattgttgcgattgttgtgaaccctgtatcgatgacagcacgttatccagcttcgcgctggtttgtgcggtggtgacacgctcgcctttctcaagcaaccatgtgccggtctgcggcaccgaatcaattccatcatgtgccataccacggatggcagcgacatttgccataccggcagcaatcgccgcaccggctgcaagcggcccaagaatgtgaccgattaccggcgttgctgcagcagacgcataagcggcatttgcggcctcataggtcttgataactgcctgagtaatggcagccgctttgcccagcgcggctgcttttgcattctgtgagttctgcagttgagccagggttccgaaaaaatcagaggccatattcaaccccgcgatctgcctggcttcatcaattgcttgcagttttctggcgtgctcttgatgcagctgttgttctttctgatcggcctcgtcggtaaagttcgaatactcatcccgaaactgctttaccatttccagctgtttggcataccactcgttgagctgctgttctgctttatccagcctgccgaattcgccagtgaagccaccggcaatttctcccaccccggcaaactcgggagatgcctccatgatacctttgagtgcccgcccggcctgcttgttctgatcctcagcgcccatctcttggatgatcttcagctgctcacgcaaagtatcgagacgggattcgtcctgagtgcgcagtgatttgaccacaccttgataattttcaagcagctttttctcttcatcccgcagggtgatacttttcaaaatggcatcggcatgtgctagttggtgttcattcgcacccatgatgcgcaggtcatacagcttgacctcatcggctgtcatgccccataccttggctgcccgctcgatcgctgtcagctcgcgcgtgatcgcttctgctgccttgtcaccctcatcacgctttgccttggctgctttgctggcttttgctgctgctgcggctgcctttgccgctgcgatctctgcttcctgatcgatcttgagtgcatccgccttgatgcctttggtctcggctgcaacgcgctttatccgatctcccagcaattctgtttccatcaggcgatcaatctctgcattagccatcctggctatctgctcttgctgcccggcctcctttagcaatgctcgcgctttatccatatcccccatgccaatatgagagagtgcgccctcaacctgggctgccaaccattgaatattgcctgcctgagatgcaaaaaaaccaaccagggtattcgcagcaattctgacaactcgggtaaatccatccaccgcattcagcaaatatggaatggcattgacgctttccatcaatgcgttggtaacgcttttgatcgccgcttggacttctggatccttcaatgcccggttcagatcctcaaccatgtcacgcgcgccgttgagcgatcctgcatcgccagtcatcaatccgcccaaggtagtcttgagcgcttccagcgcgccggcgtaggtgtttctggccgcctctgccgcaccaccataagttgtttcgagtgcttccaggatgaccgtctgtgcttccgccgttcggccggtgtcctcaagatgcttgaccagcagcttctgatcttcggtaaagcggaatccctgcttggataacgcgggagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcataacgcggccaggccttggctgggcacatccagcgcacggcccaccagttccattgcctgcgtgacagacatgcccatacggactgacatatcggtcgcagcctgtaacgcacgcgggaaattattaccgatgatgccggtaaattcagcgaggcgggtctgtgctttggtaaattctccggctgcaatgccggtcaggtccgacatactatcagccatcttgttgagctgatcttgcgtgtatccggcaacttccccggtagatttgagtacggctgcaagctgcacctgttcctgctcggccatcttgctgttctctgccatctgatcgtagatggatttaactgagatgccggccagcccggcagcaattgtcttgccgatgttggaccaggctttcttaacctcatccgccgcacgctgcatctctttggatttcttctgcgcatggcggcctgccttgtccaggccttcggtaaacgagccaatgcgggagacgagatcgagagtaagcgtccctaaagagcttgccatcagaaccactccttcattgcttgatccagtgtgacgaccggttcgtcataatgcggggcgaagtcatgcaatttgaatccaccgtttttgctgtgtgcattggcatacatgacggctagttgtgcgatggataactcaaccatcaacccgatattgaagctgccgcgtttggcacgataagcaacccacgatttaaactcggtgaaactgatggtctgctttgcctctgcgatggtgcggccacccacgccattgagtacaagctcgtgccagatctcatcctcggtcagctctgctgctttcccaggccatttacttcggcaatgacattcagcaatgcaatagtcaggctgccattcagcgccccacgatccggatccgcttcgccggtaatgtcctgcacggtgaagatcggttttccctgttcatcagtgatgctcgatgcgatacgggatgccaccggatcgagatcgtcatttatgctacgcagatccgcgacggcggatgcatacgataacggcctgacatatacgtcaccggtaaattcttcgtcactctgacgccatgtgatcgtccgcttcaccggtttatctgaaaatccgccttgtgtcttgagactttctatcgagatcagcattagtgcgctcactgtttcggcatccaggcagacccgccagtgcgttggatcgtaacctgagaggtgactaccgtattggatgcaaaatcgaatgggaagtcggaaatatacccatcgaatacaaaccaggtacggccagttggcagattgataccatcctcagcaataatggctgctgttgcagttgcgccagtaccagagccaccagtgatggtaacggttggcacactggtgaagccagtgccaggatcggtgataatgatctctgtcacagcatcaccatcagtcacagcggttgcggttgcgccgctaccaccaccgccagtgatagtaactgttggcgtcccggtatagccattgccaccagcagttacagtaatgctgtctactgttccttttactcgtaacgtgggtaactgtgtgccatccgaccagccaacagcaaacgttatcaccggcgctggatcggtctgtgataatccatgtagtgcaatgtggctagcattgtccggatcggcattgatgccaagtgttgcttgtcctggtgttcgcagaccagggagataggagcgtgtggttgcagacaggcaggtcgtttcaatttgatcggccgggttgccgcccggggagaatgtagttgcgcagtcgatctcctgcacctctctgccgcccgaaccattggggttaataaagaatacttgcgtgccctgtgtaaggattgccatggctgttatctcctgatgatgaaatctatatcgaaattgatgcggtgtaattctgtttccggatctcttccttccatgccccagctggagatgtagcagtgtggctccagtgcatcgcggagtacatccactacctctcgggatatctccggggtttttgcaaagacatctacctgcagcgtaaaactatcaacatccggcctatctccaagataggcagccggcactcctgacacttgccgccagacggcatacggggaaactgggattgaaggtgccatgccaaactgatacagccgtgtcggcttcttccccagcaatgcctggacacccagatctgcagcgcagatagagaagatcggaatcatctctgtctaaatttttttctgatggcgcgatccaatgctttctcaaactgcgtaacaaattcggctgtcgctctactcgtattatttttaagtgccggttcaaagaaatgcttgctttgtatatttttagtgccgaagttgacgaagcgccaatagaaggtatcccctccggggttatctttgcccttcccggataattctcccaattcactgagggtatacttgccacgctttttcttagggcgagcacttggcgtttgagcgccgcccaggatcccaacgcgaaatcccatctgatacccattcgatgctttgaacagccgtccattccagcggatggcaacattcttcgagatatcttccggcgtatccggatcatccacggctttggacattcgcacggcatccgtggccacaacctgcgccgccttacgtaaagcaaaccgaccgcctttgtaacgcacatcctcattgatgagcttgattttctgcatcaattcttcgatatccagttccattttgctagccatcagttgcttagcctcttggttgggatcgtctgatattctcgaccgctgcctttatctgccagcacgcctaccggttcataaaccacattgccatgatggatgcgcatacgtaacggatcgaaggttggtagatagcgaatcgtgatttgggtggtaatttgtgattgcgctgcatccgctgcgataaaatcgcggactgacagatcctcgatcgcagcccagacggtacgatagaattcccaggactccgtgatattgccttgcacgtcttgcgtgtccacacgttgtttgatgactacgcgatgacgcaatcggcctgacttgattccactcatgttataagttccatatccggtaggtatccaacaggccgtccacgtagggcaaaaggctggtgatgttgccgatatttacggattcccgattcatgtaccagtggcctatctgcagcagcatccactgcttcagtgcctgcggaactgcatcgacatctgtataaccacaggcaaaaactacccggaggatcccacccgccgggatggcggcgtcttctgaaaactctacccaggcaggcgcactatcgctgggattggtcaatcgatactcggcagggtcaatggctaactcatcgccatgatcatcgatatgtttcacactggtgattgccgttactggcaacttacgcagatagataaaacggcactgctcgctttcggtaacagcccattcttgcggcattagtgcacggccggtttgagcttcgcacatatcacaggcagcagcgatcaatcctgttaaaacaggatcatcatcaaccactgtgagtcgcagatgatctctgacctgagtcaaagaaagaggttggtcaacaggaggggtaacgcgtttgagcatgattaaaaaacccgccagggttgcccgtggcgggtgcagtagctgcgagggttaatttatttgcctttcttgggttgggtagatttttctgcttcagctgtggactgatcagcctctttgcctgcaggcggatcgttttctttgtcttcagataaatcatcttctgccgaggtgaattgaatagtcataatctttccaccgttattaaggcagtacgccaccgcttcgggggatcggtccacctgatcggccaaccctttgatgatggcctcatccgcttcgattacctgattgggatttagacgctgatccagcaccgtaaaggcaaccagtacccgtgctttttccatggccattttgcctccttaggtggcactattttggtaaaatttcagaggtgcgccgccatcagtcagcgtgccaccggaacgcatccaggccaggaaaccgatctggcccagtttgatgtaagctgaatcctcaaaccggaacagagtcattcccatgacatcgcggatggtatagcgagagaaatcaccgaacaggatagattttgcattggcggccatagctgccatgtcctgattgatggtgatctgatagcccagtagcgtatcagccatggctccgcccaggccatcataacccggcaggaagacaggccggccctgagtgtctttcattttcctgatggatttcagcacgctatcattcatcataaatctgacaccactagctgcccggtaagctggatcaaccgaatggatcagatcgaccagatcatcaaaaatgactgtggtggtctgtccggtcgtgccaactttgccggaggctgctgcagtcactacgccttttggctgattagtgccggtgccggtcgtgaaataggtattgaggacccgcgctagacgctctcccagacgacgggagatgaatgcctgaatatccactgccgaatcctgcagcagctcaaacggcgcggcgacgatcttcgagctgaatttataggtgttgagtgtgacgaccccgaaggttggatcttgcgccgtcgctgtggtgttttctgcgatcaattcacccgtttcagaggtgccatcagaggtgggaaagttcatctgattaccggcagccgtactgatgacactggctacttcacgcacgccgccataggccttgagcacctcgatgatggaagcgactacttcggtcgggacggtatgaccgccctcgccgggggtagtggtgctcatggtattgcggatggttgtccagtcctcagcagtcatggcgcgatcacctccacgcacccatttggcaaacagatcgagctgagcattcgatccattccttccatgcgatgaccgttggactgcctcgactgcacgatctgccatagcttcttcggcaatcctgtcatgcaatgcgcagatgcggtcggcctggtttttcagatcatccagttcggccagttgctgatcatatttctcctggtgttcgggctgccagctgccgttgttgttttcgaccagttcgcgggtttgttttgcgagtgcggcatgacgctcccgcagctcttgcagtgtttgtgccatgagttgttcctttggattggtggcaataaaaaacccgccagggttgcccgtggcgggtgtcttgttggcgtgggagcgccgttacatatgtctggccaatgcagcaatacgctgcagataaccagtatcgattttcggtagatcctgttctgctggctctgccgattgttgtgcctgtcgaatgattggcgctgcgttataggctgacaaatcccaaccgatggatgcactagcagatgggccatcttctgcgactgagtcagcaaacccatactccactgcctcggcagcactgaaccaggtttcatttctcatccagtctcggatttgatcttctgcctgcccggttcttttcgcgtaagttgtcaccagtgattcatccactttttccagcaaggcagccatttccagcagatcatccgcattgcccatcgcaaatgaccaggctttgtggatcatgtaaaacgcaccttcggcgatcacgatattgtccgcagccagagcgatgtaggaggcagcactggcagccacaccatcgatatgggcaatcacttcggagttatgctcgcggatggccgtttcgattgcgcgggcggaaaacacatcaccgccgggggaattgatccgcaagtggatgaccggtgctttgatagccatcagttccttgacgaaactgatggcggtaaccccgccccagaaatcatcactgacaatcgtgtcgtacaaatagatcgtggcttcatcgccagataattctgccctgaacaaacctttggatttattctgcgccagtagctgtagcattctgtccatcattggttcctgtatgcagttgatctccgcctgggataggcttcatgttctcaatccggcgcgcctcgttcacggtcatgaacccaggctccccggcgcggccaatggctacccggtaggcctcgtagcgagttttcagatcaccgcgctccaatcccgctgtattgaattccgcgaaatacccggcactacgcggccagatcttgcgattgatttcctgttcgatcgggcgtagatgacgctgcagagtgtatttgacgaaactaatacccagctgctcaataccttgtccccacgatgaggttttctcctggtgcccgaccatgaacggtggcacgccaaagatccgacagatgtcttcaacctgaaattgccgagttgctagtagctgtgcatcttcactgttcatggtcagctgctgggctttcatgccaccctgtagtacagctggtagatgtgatctcgcactgccgccatactttgcctgccactggctgcgcaggtcattgatggtatccgtcgacatcttttcatcagtcgtcaggataaaatcaggacgggcgctgttggcaaagaagctggcgctgtactcgtctgctgccagtgctgtaccagcggaggtgcgcaatgcatgtcgcagcacggatatgctgcgttggccattaaacccgataccagggatatgcagcatatcgccctggtcaatggtcaccagcgttgcatcgtcatcgatgatggtgtaacgcagcaggccgtccacttgctcgactgtcaccgcactcgggtgcagtggttcgatcgaaacgatcttcggtgacagcctgctggcccgatgtatcctggcaaatgcatcgccatggaatagccgcgattgtgcgatgtattcccagaatgctgaagcggtccaggatggatgaggggattcattgaagaaccaccacaagtcatgggttgttctttcccggccgtcttccgttcgcttgtagatgtggaacggcatgctggcgatcgcgccgccgataattccaatgcaggcatacaccgctgatacggatagcgctgtttgctcgttaacgggctttcctgcgctcgaaaggccatcgactagccagctgtatagttcgctgccacgcgtgccgtctgtgagactgtgagtggcattctggatccgtgtggcttcccgctgtgccatccactgtttcagcacgacactgcctggcgtgcgtgctttgttttggacttcctgccagctgatcataggatgatgagtgcgggttccacggattcttcacgcgcgctgttcagtgcgatccccgcacccatgaccgcagccaccatcagatctatccggccggttgctttgtttttactcagcttgcggttttctgcagagtccgcaacagttacggcattggcggcgcaccaggtgaataccgagttgccatcatggacgacttcgccattgagcaatgcactttcaaacttgtccaacgccgggctcatatctttgaatccctgcccgaatggttccatcggcggcagggcgatgccttcgtcttcagccatttgtttcagatcctcgatgcgccatctgtcaaatgcaatacattggatatcgaacatattctgtaattctgccaatctgcgcaggacggccaggcggctgactgcacggccaggggttgtttcaagatagccggcggatttccaggccaggtaaggaacacgatccacttcttcttttcgcagcagatcctgttccggcaaccaggcaaacgtaacgagctgccaaggatcttctgctgtttccggttccagccacaataccaggccggttagatctgtagtggatcccaaatctagcccaccccatgcacgccggctccgcagattgcgccagtcatagtcgcgacgggcatccatccatacatctgccgagatccaaggggcatctgctccagtccattcacaaaaattcaggcgccgcaccacggcttctttgctcggcatacccttcgcttcccgcacctgttcacggatatagcgatagcccggaaggccgaatctcaggctggggttggctttgtcccagcaggattcatcgttgatcgggtcatcaccttcatccagtgcgcagatgtagctgaagaatgaatcgtcggtcaactgtccagaagctacctgtgtgccgtaagtgtgataatcccaacatgggccggtcttgtccgaccctgagttggtgatcatgaagattaacgcctgccgacggcttttggtaccggcccgcatcatctccaccacgaaattatttttgtgttcatggatctcatcgatgagtgcgatatgcggacgaggaccggactgtccatcatcggacgagatcggacggaagaagctgcctgacttatggtaagcaaggttccagaccgtcgatccttttccacttttgatcagtgcatctcgcaggatggcagattgatctaccatcgccactgcatcacgaaacagaatcatggcctgatctttttttgttgccgctgaatagcactcagcacgcgcctccccatctgccaccagaccatacagacccactgcggcggcaagtggcgattttccgctgcctttcccggtgcttacataggccacgcggaaacgtctcaagccttctacatcgacccagccgaacaagctgccgacgatgaatgcctgccagtccaacaggatatagggcctgccctcatattcgccaccgtttagtttgagcacatcccggcaaaagccaatgatgcgcttcactttttccaggtcgaaaaaaaagccccgtgaaggagcttgctctaaatcttccaggtgccggttacaggctgcccggacatgcgggcctgcgactattttcccagccactactttccgggcataggttgtcaccggatcacgtgaggtaggtttcgggtgtttcttcaagtccaggtaacgtctgttgcggttgaatggtaatgcgcgtacgggcggccggtgacataccgaattgctgcagggctgtcatggcctgcttaaatgccatggatttaaccatctcccagtaactgatcgattttctttctttggcgctagggtcagtatattcctgcccacattccagcgctgcccggcggtatgtggcaatggcttcgcacgccatatgcagcatcggaacatccacttcggtcagcaattttgcttcacgcaagcctggcacgatctcactccatacaatttttgcaccagcagaaaaataatctggagcggccaggtcattgaggtaagccggatctggctcctgcttgttgacccctcgcttcccacgattgccttcaacaatcttcagatgggtcggcttaggatatcttcctctcataattctttatataacttacttatcaattacttatacccccataccaatttcgcggtaatgcacaaagagagggaagcgcggtcaggaggcgaaaagctgtagactttgacccgccccccggggctgatcatttaaaaattctttcgattccagtggtggttggaatccagcgggataccagataaatcgcagcccgcatcaattccggacttctctagcctctgcttgtggctgtcatggcaatgcttacataaagactgccagttacccgaatcccagaacagcttgctatcaccccgatgcgggataacatgatcaacaactgttgccgctacgatctggccacgccgcccatgatctgcgcatagaggatgcttacgcaggtaaccttcccgggctttctgccagcgataaccgtaaccacgctgtgcagatgtctggcgatcctgattcattttcaaacggccataaaaaaacccgttcgggttgaacgggtctgtttggcgttttcagggcgatcacgcaccaacgccactttgcctagatcatgccaaaatcgtgcaccatgtgcaagcgatttctttgagatttcatcaaaaattcaccgatatatttataagcagttgatctatatgatataaatgaccttttacaaacaccaatcctgaccgcacgctcaccgtcatttctgcactcgctcagatactcgacccgcaccaccagtttgtaaagttccggcaattgctcgatcgcgtcattggtttcaatacactctctatcgatatcgtaatccggacacaccgcttcctcaccagccaatcgtacaaagttaacctgtgacttaaaccccagatgcctgccactgcccagcttccactttgcccacctgcacaacctgctgacgacgatcgcttcttccatctcacctctcctttaactttcccgcttttgctgccttcaccagtttccggatccgccgggccttcctgcgacgctcccgtaccaattgctctttttctgcttgctccaaccgttcccgcaaagaacgcaaccgatccaccacctctgccggatcaccgtacatccaactgaatagcacgccgctcatggattattcacatcaccggataaagctgttttcataccggcctcgccacgcttacccagcgatcggccattttcttccacgtagaccagctggatatcatcgccaaacacacgccggcactcatctgcaaaggcaatgcactgcggaaacaactggcgtacctcatccttatccatcacaagcacccatttcagaatcgatttcagggatagatctcttaatcaccatcaggtcaatcgtgccatccatatctttatccaggagcgcaatctctatcagcttttccctatatgcaatctctgccaattgcgccaactccttcgcacgtcgattaattacctgtcgctcaaagcgagataactccacaacctgctgtgttgcctgccgaaaatcttttccgtaatccacttatccccttaatagcatgtcaatttatctgatcaaaccttcccaacctcgaactaggttgggaactaggttgggaacctctaaagccgcgtgcctgcttgttcttcctaaccttcctaaccttcctaacctaaaataaaagttatttatatatagaattgacacgtcgcgcgtcgcgcgcataacgcgtacacgtgtatattggaaacaggtagggaaggttaggaaggttaggaagaagccctgtccatgagggtttcaaggttcctaacctcagcgcataggttaggaaggttaggaacatgaaatcaaaaatcgatgccacgatcctctcctttcgcatcatcctgtcccgatttatgacctgagcccatttcttggggggccttgtaccagtatcgggtaacggcgtgcgtgcgtttttcaatcctcctgcagcccaacttccgtaatgcactgccgatccgcgtctgcacatccctgctcagtcgtgccgcgtcgatcttcaggcaatcggttgccacatccgcaatgcagaactccttatactgttctgcaatccaactttcgatcatatccagatagctatccgatacactcctcctgaactgttccgggttaaaaatatcgatctgctcgcggttggttggccagaagcgttcaccagacagataaatctgatacgcctcggcaaacaactgatcccgcaccgctgccaggccatcgatattgatttcacctgtgcattcgattggccagaaccgccggccgcctgtctgatccttgttccattcccactcattggtggttccacagaacaccagctgacgcgggcaacgtacttcacgcgccccataaaccggccggaattcatccacctcgcgcgaaaagaatgacttttgcttggttgcttcggaacgagccaacgatcccagctcggagatctcatacaaccacttgccacgcagcgcagacatgctgtccttgctgtgcagatccagatcggtatcaccgaaccacccaccacccaaaacgcgcaggagcgatgatttaccgcgtccctgatcgccttccagtaccaggcaataatcaaacttgataccgggccgcatcgcgcgcgcaaccatccccaccagaaaccagcgggcaacccgccagacatactctgactttggggcatggatgaaatcagttatccagtcatccacgcgcgaaataccatcccatttcagggagcgcagataatcctgcaccgggttaaacttgtgaaacctcgccagcgattccaccgccagcgcagtcatgttttcccggggagcaaagccatatttacgcgtgatccacatcgaggtctgcacatcgtcatccccgttccattcacccgtttcaccgcccacaaatggcggtggtttcagcttcaccacccggtaagaaaattcgtcataggcgatcacatttcgccattttttatcgtgctccaggatgtcgtacacgttcgacagacaggcggccggtttcttgccatcccataccaaatccctgacagaccagggcggcccatcatcaccctcaccagcactttgccgctcagccctttcaggctccgcctgccattccggcgccgatcgaatcaataccagcaacgcttccttcggcatgccttcctcgactgcatccgcgatatcccagccatccagcttatcaccgggggcaggaatcggtactagccgaaacttcgttgcaggatccagcttgagcaacaaatcccgtatcttgagtattgccaccatccctggttgcttatgctcaggcagcagattgccgacagcatcacgtttcgcatcgcaatccgggaaggcataaatcaccttaccagccagtggctgccaatcggatttatctaccgccttgctgccacctgaccaacttactgatacgaattcatcctcaagcgcaaccctgcccgcatccgcacacttctccccttccaccagcagcaccggccgctcagggtgcagctcaagctgacgcaacccatacagcggcctcggctccgggaaagccatccagcgccactcacgcttatcggataactcatgctgcgcaaatacgcatggcaaaatctctttgccaccatcagaagtctggaaccggtgcacagcacccagcacacggccttcctgatcgaaataatcccagtgcttgacggatcgcccgcgcaccggatgcgcaaccggtgccggcggtgcatcctctggcaccggcactattggcacccaaagagatcgcttcctcgctggcttatccaacgatttttcctcttttgccggaacagatgactccagatcgatccctacctgctcagcgactgccttggccgcatcgagctgcgaaagacaatggatatacgcatacagactgatcagatcagcaccggaatccccagtcgcaaagtcagaccataccccggataccaggttgatcgagaacgaccccttacgatgatcagaacgtgtcggattcaaacacttatattcagccccggccgtatcaccgcccggcaaccactgaggcaccagcgcatgtgcacggccaagtgcagcatcagcaattcgcttgaaatcgatccggttaggggtcatttatacttacccatatttatataaatacattgataaattatcatgatatttatataattcagcctatgaagccgcttagattcattggatccagcctcgacgatctgaaaaactttccggaagaagcccgcaaggcagttggttttgagcttttcgccgtgcaacaaggactgatgccatccgatttcaaaccgatgctctccgttggaccaggtacctacgaaatcaggatccacgtaatgggcgaatggcgtgtaatttacgtggcaaaaatgcaggacgccgtttatatcctgcatgcattccacaagaaaacgcagaaaaccagcaaacacgacatagcgctggcagaacagcgttacaagcaaatcatgaaggagtaacaatcgatggaaaaaattaccaaatccagcggaaacgtattcaaagatcttgggtttaagccagaagaatcggccatttatactctgagggcagaattgatgagcaacctgcgcaaaacaatccgcgaacgtgaatggacgcaggaaacagctgctaaaacacttggcattggccagtctcgtgtatccgatctgatgcgtggaaaatgggaaaaattcagcctggatatgctgatcaccctggccacacgagccggaaaacatatcgacataaccgtcacctgaaaatgcgggcatccggctacgtgggataaggagagaaagggggagcccacgctgcccgctgcggtaaggcaaggaaatgccagggagtaattctgtagacgggatcactctgccctccccgtcagtaattttttgagcaacaagttttcacgttcaagctcttcggatttctcgcgctcaactctcaatcttcgttccatctcggtttccatcggaaccagttcgtatccacgtgatcgggcaagccaaatcaatggcgcttcatttccgcaaacatccatgtatgaacaaagtttgtcttgtggaaagtaatgttgtccgctgcgagtaatgcgcgaccactgggcaatgtctccgacgatgccatgcctgccgacaatctccttatcctccagaccagacatctgctgacaaagccggatagctgcagtcatagacggctgtgcatcaattacacgctcatcaattatctgcatttccggtttcaatctcagtgctgcctgcatcaaatcacctcgcgtcaaatggtttgattcgatttgtttcgttgaccggggggagaatcactgccatcgcggaggtggctgttgcgcacaactccccagtcaacgtcagggcggagatcttcacagcggacaactctgtcagtggccttctcaatgggtgggcaatattcagccggaaaacgacgatgcccatcacgccaaaaacacacggcttgaggagtaacaccaaggataagggcgacctttgttggccctcccaaaatttctacggctcttgctattggttccatgcactaaagcccgggttaattaattaatgaccattaattctacatccgtagaattaatttatcaacaactgtatttgtaggtaaatctacaactgtttaatatctggtatggctataggaaaacgtattaagtactaccgagaaaagcttggatggacgttggaagaaatgtcttccaagtgcggggttgagatcggtactatttcagcaatagaaaaccgtgatagcgatagatcaaaatattttggtgctattgcaaaagcatttggattaactatcgaacagctgtctgacattgagacagactggatgagcacaccctctgactctgacagcggggagagcatcaatcaacaacccgatgtgctcaccccccgccagcaagcactacttggattattcgaaggactgaccgacagccaaaaggatgctttgatccgagaacttcaggaaaagaaacagcagaacgacgaactgctgacggagctgctcaagcgcaaggcgaaataaactaaagaacggccatcaccagccgcttagctccttataaattttttataaggaggcgaaaatgtcagaccatagaattacttgtatcaataaatctaatcgccaaagtgcacatgaaaagatcgagtacattggaggacataaccaaaatggcactccgtggaaaatttcacaatcagaagcaattgacgggatagagtcagggaaatatcgcttctatgtcactcacaacgggaatattgtttgggtaatcgttgctaccagcgcatccggaaacaagtatattaagacccagaatgatggagagcaccctaataatttattaagtcttccagagtgcccgaatctgtaaccatttcatcatttttaataatgatctttataaacccatgaatacggaatttaatgagattggcggagagctctcaaacacaacgagaactgctcggttcaatatctttgagggtgctcggcggattgcacgagttattactggaattgcaataatcattgcaattattagcacaattaataatccacgagacaactggctggaatctttaggctacctggtggccggtcttgctatattttggatgttcgtttgtgctattggctggatcgctcgtggctttgccggcattcccaacggtatggattaccgcccaagggaagattgataaggaaacagcccatatcaaagagccgcagttgcgccgtagtttggtagatgcacgttttgttgttaagttattagcaatagtttaacattgagcatgcgtttattgtcataatacgtatgacttatattaatatttatcaactaaatcagcaacttatacgaggaagaggaaaaccatggccaaacctattaaggagacgcctattttgcttgggagggatgcagaaaggttcaacagaattattaaagagaacgaaaacaagaaagtatcagctatcgattacgaaagagcagctaagacatataaaagtattaagttgagaggtggcgtcaattaattggaatcgggagagctatatttaaggcgcctggaaaataccgacgagcgtccatgttttgactgtggggatgaagatttaaatgagttcttcgcaaaggattccaaggaaggtaccagtaaactcatttcggttacctatgtattcgagacagaaagtggagaagccgcctgttatttctgtttatctaacgatgctataagaaaagaagacacatcaagatctcgattcaagaaattgatgtctcctctaccaagagaaaaaagatactcaagcatgccagcagtaaaaattggaaggctggcaacaaacaagaattttcaatgtagtggcataggaacaaaagcgcttgattacataaaaatgtggtttactgaaggaaataaaactgggtgcagatttataattgttgacgcgatgaataactctaaaacattacgcttttatgagaagaatgggtttgatttcttggactcccataaaggtgaaaaaaacaacggacatacacgtttaatgttctttgatttactgacattccgaccctaaaacaagaaacaatggtcgatatataagccgtgatgctgagagcaaagcggcttttttattctctcttgtttgtccgtcctcgtgataacggcaaaaacaggaatctctgtagctctggaacgagacagtctgctgacagaactgcttaagcggaagtatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactataaaggcaacgtaagaaaaccaagcgaggaattctgactccccaaaaaaaacccgccagtgacggcgggcaaaagacttcaaaagatgaggtacagttaacgacagagcctcaacgaacttaagcaaaattttttcggcgttacctttataaaagctaaattctacatcctacatcccacatccacgactgatctcccccccacctattgtttgcaacttgtagcaattcaaaatataaaattcttctaaagtaaatttaaattcatccgctacgatggatgaggtttgttagtcagcctcatattagagttcttttcataactaaatttaatcgaggttttataatgattagaaacatcatttcggtagtcactttatttcttctgtcatttgcgtttcaagcatctgcttttgcagcgaatcctgaagggtcgtaccagaagacctgcacaaatattgctctgaatggggaaacattgaccgcaagctgtacccgcttcaatggctcaaaaaataatactgaactaccgtttgcaacttcttgcgtaggaaacgtcagcaatgtcgatggcaacttggtatgcacgggtgccaccggctcttttgcaagaacttgcaaggatgcgtctatagctaataacaaactgaccgcaacctgtcaaaaaagtgatggtagctggtcaaaaaccccttctactatcagctatagcggttatcaaaaccaagttacaaactgcaatggtcaattggtcgatagtccaaactgtaaataatgccttgcttgtattaggggtgttctagttttgatgatcatatctacctactacatcccacttcgttttactctgcagtgctactgtagcaacaggttattgtacaaatacacatagcattgtagagtctgctccctatcctcactcttcttggtttggccaaccagcgttctacctttgatcagttgagtgtcaaacatatcttgtattgttaactttttgggacaaacacatgaatttaaaatacttcttaccgatactagtagttgttgccatggaagctggcgctgataactccaccctggatgcggccgttggcggggcaatcggaggagctgctggagctgcgctgggaaatgagcttggtggtcgtagcggcgcaattatagggggtgccttgggagcgtcagcgggtactgcaatcactacaaaaccagaccatcatcaacatgataattaccctcaacatggatacccgatttacccgagcaataatgtttatccaggcaatataaaccctggatatcattgccctcctggtcaagcaaaaaaggggcgttgttgattgcttgatgaagatactgagctcattgcagcatttgttgcaggcagcgttgttaaaagcggagagtagtttgatcaatcattaaccatccccatctttcctgcgcaaccagtaccttaaagcagttatccacagaatcactcaaggttttcggggataagtatgaaatcgtatacaccctgctgatttgcattgcttgtagtaaaaacacttaaagatcagcatagccactaccgatacaagtggatgacaaaattaaatatcgcagaaataatttccccctgggtgcactcatttattaccgcattcataatcaccgcagccattgctattccccttgcaatgatgatcggcagaacaactcaacagcgcaaagcaatattcggaatagttacagcaatttgcatgtgggtatactggatatatttcacacctatctcatgaacctcaaaaagatcctcttcctggcgatattcattgtcgccctgcccttgcaggcagagcagctcactggccgtgtcgtggcaatctctgatggcgatacgctaaccatactcgatagcagcaagaaacagattaagattcgcatggccgggatagacaccccggaatcgaaacaaccctacggcaccaaagccaaacaggaattatcagatcttgctttcggcaagaccgctactatcgaagtggaagctaccgatcgctacaagcgcaaagtcggacgcgtgtatgtgaatagagtgaacatcaatgccgagatggtaaagcgtggtgcagcctgggtatatccgcaatatgcgaacgatctgttgctctacagcctcgagcacgaagcaaggcttaatcgtcgcggactgtggaagttgccagacaatgaacgggtgccaccgtggttatggcggaagaataaattcaagcagaggaaggcgggttaaatttttttacgcatccataaggggtgggtatcccatccatccgggaatcccatatttctcagggacaatccgggaatagatggaaaagaatcaagtaactcacgtaaccgtacaggccaggatgagttcgggctgattgtacgcatcaggtacaacatgatacatagcgccatgaaaacgcgcgattttacagtgtcctgctgttcgattacgggattaaagtcttgcacggtaccaaactgtggcagcttaggttgatcaactaagtttttattccacagtcggctgtgatgtgcagctacattacgtacaaaattcaatgcccttaaccagctgctcattaaatccccattaggcaacccatatttagccgctatattgtccttgtcatttcttttcataaattgaaaaaaagtggacagcataccgaattcccataactcaacaacaacccaaattggaaagggcttgccgtactttttttcgtagtgaataacgaaatcctctttggaacgaaatataagatcattattctttttgacccagttttgataaaccgtgcagccactaccagcttgttttttattaatggatctttgattaaaaaattctggtttcgtatgcgcaaacttgttttttctcccaagtaaataggcaacgtcaacacgaaacgcgacctctatacgctcaatagcgtcaagtgccagcagacgcaaacgtttatcaaatacgtagagggaaagtgcttgatcgaatgtactacctggttggaatgtatccaggcgggaagaaggtgtgaaattgccttgtgacgggaccaactgacgcataggataccaataggcactcagccgatagtatccaatatgctgtaaataaaataatgctctagcatcgtcagcgacatccaatccccgactcttcagcaaatccagttgctgctcaaaagtaagatagggcttgttgtacgttgacatagccaggaaaaagaaaacccacccctggtgctgctgggtgggccgtgttggaatcaattatagtcaacatatgtttagtactcaagctaaatctttctacttaattaataaacctgcatgcctataaagaatagctaacggctcgttccctcccccacttaacaaataacaaggcccgcctagtgcgggctttctgttatcccccaccattctggtaatcccaccgagatagcagggcctttcatttcatcgctaattaaaccatcctcgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcggggaatgacgtatcactctttccaaagccagtagcgaatctgcaacatcctcaatcggaataagcttcttattcgaatagtaaatttgctgatttactactaactccataatcgcattcccttctagtcgttaacttggccaaacccttgaccataaatcgttaacgacccatcccttcttcaactgaagggtcaccccttctgtgtgcattcggctttgtagaattattggaaaataatatctacatttgttgacaattaatatctacgattgtagaatttatcacatcggatatttactcggttaacaaacattcaaggagcccccatgaaacctttaattctctgccatgtgcaggtacgtcagcacaacggttacagacatacctacaccgggttattcagatccactgtagacgctgcatcagatgcctttgtgcgcttctgccctggtacagcggtgaaagtaacagcaaacaaaaataaggagagcagagcatgagcaaactaagaatgttcctgatcgacctggccatcgctgctgtactggcagtaaccatcgtgctggtactggatgtggcaaataacgtgatcagccacgtagcgctatcgctcgcaaaaaagatcaccgcagccggaatggaggtggcatgaccaagttcaaagctgatgatttggaaattgaggagctagccgcgtttcttctgggggaagagctggatgcattcattgatgtagatggaacatatgaatacaaattatggctctcattctgggaaaaattcggcgttgatgtagatgacttcgttaggacagtaaacatgcttatcccgctgatcaatatagggcggtcgcccatcacgaatactctttataagggtttctcaaattcggacggcaacctgtggctggtgaagatgaaggtggaagagtgactactcgcacactcacccaatacgccgaagtggtaaccatcatcaccctgcttgccggcatcgcttatctgatcttcgcagttgcagcagcacctgatcttagtaagaagctagatgctgatggcggaaatatatgcatcctggatgacgagcttgattacgttgcctttggaatggattacagcgaactcttcccggcaggccatgaatatggcaaggacggggaaatcatcatgacggatgatcttctgccagatcctgctaatccatatggaatcaatggataccctgccctgcgttgggcagaacaaagcatgacagggcaatcaccaccagtactgtactggccagcaccagcatacaagcaggtgttaaagaagccgggcaaaccatgtgctgataaatataaacatgtagctgagccaggaatcctcgccatcataggagcagcgctgctggccgctgcgatagtgaaatgaatcaggagaaatggatgaacccatcacatgaattcatagcagcagtcagacagcatcgtgaacttctcgaaaccttgggagaagatcacgcagacactatacgggcgatgatgttggcaatggagctagccccagaggaattgaaagatgaaatgatggataaagcacaggaaatgggcctgataccggaaatatctggctatcttgaggatggaaccccaatggtcagattggaagatattgccaagcgccttggattatcaccagaacaagctgaagaggccatgcataagatgcttgctgatcgtgaagcattaggcctgtcgaatgatggtctcgtggtaaccgatgcggcaatgatccatcgtaagcagtaaggagcagatatggacatacttaaacctagtagcgagctgatacaagtgatgagccaccaaagaaaatggaccgcagaagacagaagatttctcgctcatctgcgcaagaaaaaaaagatgcaggtaaaagatatcgccgtgatgatggggcggacggaatgctctgtgtggaagcagctttcttatctggagatgacagccggggtacccagacacagtactcgtaagccatcggcgaaagataaagaagaagccagcagaaaaaatgccttaaggcacggctggaatatgcggccagaagacaggccaaaattcagagaaaaaatggcggcgctaaatcaggttgagcaagcactaaatgcaatgaggaatagcaatgtcagtatttcttgaaccaccagatatcgcgaagcttactgggtatcgcatgaagtcggcccaaatagagcagctacggtttatggggattcccttctttataaatgcagcgggacggccagtcgtaacacgtgctgccgtagaaggccgtaaggatacacaggatcacgccaaaccgaaatggcagccgagggtgattgaggtaaagcaatgagcaagaaaaagttgaagcagggtcaaatattcacgccaccatgggtcacgaacgaaatgctggatctgatcggtggtgataaagtactgtcagacgatgaaagtttcttctttgagcctacgtgcggcgatgggcagatgctaattgtaattgtcgaacggatctataaagctcttctggctaagtacgatggggacatcgagaaggctctaagtgaaactctattcaaattttatgcaagtgagctagatgaaactctgataccaccggcgcggatgcgagtgtggcagtttgcagccaaggagatcaaacgggaattgagcctatttgaacaatatcttattgcccatcaactacaacagtcaattgagtgtcgagatgccttaaaagaatctattgacgccattgattcttgcccaggaatgagggctttaaaaaggaaggaattaaaaagacaaaagagtaagaaattggcaacagaagaggctataaaataaaaatgggcaggccaccatacatccacaaaaaccttcctgctcgcatgcgggcaaggcagcgtgggaaaaagatctattactactacgacacaggtagcaagccacgtaaagagatctcccttgggactgactacgccatagccgtcaagaaatgggcggagctggagattgatgcaaagccaaggtgcacacagatcatcacattccggtatgtggcggaaagatatatgcgcgaaatcatggccactaaagcgccacgcacccagaaggataatctgtcggaaatagagtggttatatagattctttgatgacccgcctgccccattggaagaaattgagccaatccatattagacagtatcttgatcaaagacaggcaaaaaccagagcaaaccgtgagaaggcacttttcagccacatctggaacaaagccagagaatggggttacaccagcctgccaaatccgtgcgccgggataaaaggcaaccgggaaaaaggacggaaagatgtctacatcgaagatgaaatttatatggctgtctataaggtagcaagccacccgctgcgcgatgctatggacatggcctacctcacaggacaacgcccggcagatatactcgcactgcgcgaatctgacctgacagatggcaggataaacgtcaaacagcaaaaaactggaaagaagctgcgcatcaagctggaaggcgagctggccgctcttatcgatcgaatcaagagcaggaaggtaaaacacacgatcaggtcactgtatctcatcgttgatgagactgggcaaaaactctcttacaccacgctgcgctcacactttgacaaggcaagagaactggcgggaatcaaaaaagaggaattccaattccgggatctgcgggcaaaagccgggaccgacaaggcggaatcttcaggagatataaggcaggctcagaagcaactcggacacgcaaatattaccatgacagagacatatatcagagacaggaaaggtgacgaaataactcccacaaaatagaaaattgcggaaattatcaggaattgcggaaattgacggacgagcaaaacaaatgcaaattattgattcttttggctccccgacctgggctcgaaccagggacctgcggattaacagtccgtcgctctaccgactgagctatcggggaatatgaagcaatcactacaagcgcggtatgttagacttttatgtcgttctggtcaacttttctcgtagtcagttacggaattaataataccatttgccggattaaaaaaatttgttaaaaaacggtgctaaatccggttatttcattgaattgacctttttatatgtcgagagtcaatgtttgcatataccccagaaaaaccttctatccgaatgaaaaaaaaatcactaagcaaagaggaatcagcattactttcccctccggaaaatttcgaaacagccactactgaactggaacagattgtggcaaatatggaagccggacaaatgtctttggaagatgcgctttctgcgtacaaacgcggagtggaattgttacaatactgccagaatatgctgaaagactcgcagcaacagataaaaatacttgaagcagacatattgaaaaatttttctactaccgagcacgatgcaccctgatttccagctgtgggcaactgagcgccttgctttaattgaatctttcttggagcagaatcttcctgccacgaattgtgcccctgcacgcttgcatgaagcaatgcgttatgcggtactaaatgggggtaagcgagtacggccactactatcctttgccgccggggaacttagtggagctgataaaacacaagtcgttgctgccagcgcggcagtggaattgattcatgcctactccctggtgcatgatgatcttccctgtatggataatgacatactccggcgcggcaaaccaacctgccatatcagatatggcgaacctaccgccttgctggtgggagatagcctgcaaagtctggcttttcagttattggctgaatctgctttaactgaagatccacgtacacagctggaaatgattcggcatcttgcattcgctgccggatcccgaggtatggctggaggacaggcaattgacttggatagtgttggcaaaacactcagccttccggaactcgaattcatgcacattcacaaaactggtgcactgatccgggctgcagtaatacttggggcccgttgcggtagcagactgaatgaagaccaatttaaacagttggaccattttgccaagtgtatcggtctggcatttcaggtagtagatgatattctcgatgcagaagcctccactgctgcgctaggcaaaaccgcagggaaggatgcagaaaacaacaaacctacctatgttagtatactgggtatcaaacaagcccgagaactggcgcacgagcttcagcgggaagccagcggggtgctggacaaatttggtcctgaagccctgcgtttgcagcaaatcactgatttcattgtacagcgtgagttttagttttacgctactaatccaatctttaccaatctttacgttacccactcttagctacaattcgcatgtatccattactcgatcgcattgagatacccgcacaattacgtaacctgaaacgcagccaattgccacaattagcagatgaactgcgaagctttctgatcgaatcggtagcgaagaccggtggacatttgtcttccaatctcgggacgatcgaactgaccattgcgctgcactatatatttgatacaccctttgatcgactggtatgggatgtcggacatcaaacctatgcacataaaatacttacaggtcgacgaacgggaatggctcatctgcgcatgcagggaggtattgcaggattccccagaagagatgagagtgaatatgacgctttcggcacagcacattccagtacatctattagtgccgcactaggtatggctgtcgcagcacgaattaataaaataaaacagcacgcaattgcaattattggtgatggcgcaatgagtgcgggaatggcttttgaggcgctgaacaatgccggtgtaatggatgcggacttgctggttatcctgaatgacaatgacatgtctatttccccccctgtgggagcactcaatcactatctggccaaactgatgtcaggccgtttttatgccactgcaagacgtgcaggagaaaaaatgctgggcgtagttcctccggtattggagctggcgaaacgtgccgaggaacatgttaaaggtatggtaactccgggcacgttatttgaggaattcggtttcaactatattggcccaattgatggccacgatctggatatcctgctcactacgctaaataacatcaagcagcttgatgggccgcaattcctgcacattgtgacgcgcaagggcaaaggctacaaaccggcagaagaagatcctgttttgtatcacggggttggaaaattcgaaccggggaagggagttataccgaaaccatctaccaggccagcttatacccaaatatttggtgactggttatgtgatatggcggccaaagattcgcggctaatcggcataacgcccgctatgagagaaggctctggacttatccgtttttcaaaagaatacccggatcgctattttgatgtgggaattgctgaacaacatgccgtgacattcgctgccggtgcagcctgtgaaggattgaaaccagttgtggcgatttactcaacttttctgcagcgtgcctatgatcagctgattcatgatgtggctattcagaatttacccgttgttttcgctattgaccgagccgggcttgtcggtgcagacggtccgacacatgccggaagttttgatttgagttatctgcgttgtattcccaatatcacagtgatgatgcctgctgatgagaatgagtgtcgtcaaatgctctatactgctttccagctcgatacccctactgccgtccggtatccgcgtggtacaggacccggcgtgcaaataaagcaggaaatgcagattgttccactgggcaagggtgagattcgccgccagggcacacgcattgcattacttgcgtttggtagtatgctgtccccctgtcttgaagctggagatgaattggatgccacggtcgtcaatatgcgttttgtaaagccactggaccaggaactggttatgacacttgcggccgaacacgaattactggtgactgttgaagaaaatacaattatgggaggggcaggcagtgctgtactggaatgcctagccagtcagggcgtgaatatcagattactgcaattaggtttgtcagacaacttccttgatcagggtgatcctgctcaaatgttatctgactgcggattggataaaaccgggatcattaaatcagtaaaagaaagactctctctatagcgttcgcatacgtaacaaatcagcagcaaagctggcgagatctattccttaccggttgctccaatatttttatacagcttcacagccagataatctggacaggaaggaattttttatgaaaaaatatactgatcagcctatcgctgacgtgcagggctcaccggataccagacatatcgcaattgacagagtcggaatcaaagcgattcgtcacccggttctggtcgccgataaggatggtggttcccagcatactgtggcgcaatttaatatgtatgtcaatctgccacataatttcaaagggacgcatatgtcccgttttgtggagatactaaatagccacgaacgtgaaatttcggttgaatcatttgaagaaattttgcgctccatggtcagcaggctggaatcagattccggtcatattgaaatgacttttccctacttcgtcaataaatcagcccctatctcaggcgtaaaaagcttactggattatgaggtaacctttatcggcgaaattaaacatcgcgatcaatatgggtttaccatgaaggtgatcgttcctgttaccagcctgtgcccctgctccaagaaaatatccgattacggtgcgcataaccagcgttcacacgtcaccatttctgtacacactaacagcttcgtctggattgaggatgttatcagaattgcggaagaacaggcctcatgcgaactgttcggtctgctgaaacggccggatgaaaaatatgtcacagaaaaggcctataacaatccaaaatttgtcgaagatatcgtccgtgatgttgccgaaatacttaatcatgatgaccggatagatgcctatgttgttgaatcagaaaactttgaatccatacataatcactctgcatacgcactgatagagcgcgacaagcgaaagtaataagcccgagctactgtgccctctagtaggcaacagcaattccagaactacgatgatgaatatacttaacttcgcagtctttttactttgataactttaaaataacaatcttcgcatttgcctgttgtcatggtaatcttttgcgcttttcaggaaatagatcaccatgcaacaggatcatgataccccccctccttcaaaacgaatatcctctatcgcttacttcctgtttctgtcccgctggttacagctacctttatatttggggctggtactagcacagtgtgtctatgtatatcacttttggattgagctatcagatctgattggcgctgtattttctaaccagaatgctttacagcatgtccttgatatggtggcagtcaaaggagtagaaagaaccgagaaggatctgaccgaaacagccattatgctggtagtactcggcttgattgatgtggtaatgatttcgaatttactcatcatggtgattatcggcggatatgaaacctttgtttcacgcatgaatcttgaaggtcatccggatcagccggaatggttgtcacacgtcaacgcttcagtattaaaggtcaaactggcaactgctattatcggcatttcatcgattcacctgctaaagacatttatcaacgctactgcttatgatgaaaaaacattgattgcgcagactgctatccaccttgcatttctgctctcagcgcttgcaatagcatattgcgaccggatcatttcacaaactatccagcattccggcgagcacgaatgagaggctaatatataaggttagcacgatatcaaaggttaatgctgcgtccgccatcgacggcaataatttgcccggtaataaaaggagcattttcaatcagaaaactgacagtccgtgcgatatcatccggctcccccatgcgtttaagtagcgttctatcaataatatgtgcgcgtgttacctcatcctgccattcacccgcttccggccatagaattggcccgggtgaaataccgttgacacggatttgcggtgcaagctccatggccagtgaacgagttaatgctgccagcccacctttagcagtattgtaaataacataacgtttgaggggttggtcagcatgaatatcaataatattgacgatattcccctgatttttttttaaatggggggctgctgcctgggataaaaaaagtggagctttcagattactgccaattaaatcatcccagtcctgttcagtacattccccaacaggagttggaaagaagctggaggcattgttaaccagagtatccaacccgccaaattgtgaaacagtccgatcaatcaatgttggaattccgtcgatatccagtaaatcaccctgcagtaatgcaaccgaatccgggcgctcctgttcaagctcctgtttcaaccgttgtgcgtcagctgatgaattgcgataatgaactacaagcttggcaccctcgcgatgtaatcgtctacagatagcagcccccatccgccgcgcccctcccgtcaccagaattattttatctttcacgaacactccttctgtttacgctacacttcagcactacaatctactataaacttttttactgccgaaaacaccgtgactctacccctgccgaattcttccgaacaaaaatacagcgacattctgaaaaccatacttcgtgatcggatctccctttccggtggctggatttcatttgcggattacatggatgttgttttgtatacgcctgaagcgggatattacagtggcggtgcagctaaatttggagcagcaggtgattttgtcacatcgcctgaaatttctccattatttggacaaacactagcgcgacaagtcgcacaagtactaagatcagtaaatcatggttcaatcctggaatttggtgcaggctcagggagattggctgtagatcttctgcttgcgcttgaggcactggaaagtctaccggaatgctacaacatccttgatctcagtgcagacttgcagcaacgacagcaagcaatcatcaagcagagaattccacatttggctgcgcgggtacagtggcttaccactctgcccgatcagttcaaggggttgatattcgctaacgaagtgcttgatgccatgcctatccacctagttgtctggaaaaatggcaacattgcagaacggggcgtgatctggaaggattacgagttggcatggcaagatcaacctctgacagaaggcgaactactcaatgttgcccgacaacttcctccatctgatcaaccttccttcccccatccttatatcagtgaaatcagccttgccaaccggcattttatccactcccttgcaagcatattgcagcaaggggctattttgttggttgattatggatttggtcaaagcgagtactaccacccgcaacgtcatcagggcacgctaatgtgccattatcggcatcatgctcatgatgacccgctttttctgccggggttacaggatattaccagccatgtcgatttcagcgccatttcccgaatcgcactggattccggattgcagttagctggctataccacgcaggcacatttcctgattaactgtggaattactgatttactggcgcgcacaccagcagaccaaccagggatttacctgccgctagtcagccaggtacagtgcctgatcagcccggctgaaatgggagaaatgttcaaagtcatgattctaaataaggctatcaacattgatacgacctcttgcggcttcatgcggggagacttacggcatctgctttaattgaagcgctgattattgctggtagcttgcccttgccgacccagttcatgccgggcagactgggcaacctgtttcaaggtcctgcaggctgcctgcattccgggtacaagatgcaacaattcattcaagttgagtgagcgctttagtaataaggtcagcaaaggaattggcttgacgcttccatccggctgcagcgcatccatcagtgcagcaggcggagagaactgtaccggatctgaaatagcccgtatcaccaaaaatgaaatccctttttccgctgcaaccgcagcgatagcaccgctttccatatcaactgcacatccgccgctttgcaatgcaaacatacgtttggcagcttccgtggtcagcacttcatcgctggttgccaatggatcacaggtcacattaatgtgatccggcaggcaatgctggacgctagtacgccacataccatctgttggataattcttgtccgccagcaccgattccggtaaaaccagatggccaggttgcaggccatcatccagtgcacctgccacaccaaaactgatcagtccggtaactcccgcctgattacataaatcggctgctgcgcggcgagcagcagccccacccataccacatattctgatcgtcagattttcatccagtgctactgctcgatcaaaagtcaaacggcgctgtgtgatacatctggcttctgctcgcaaggcaacaatgatgccaacacgactattcatacggcagatttgctacttagtgtgcgatatcgattcagtgcccacaatggaaaatatttggagtaaccgtgatatttcaggtagaaaacccttgggaaaccgggtgcagtgaaccatggctcttcccataacccggtagcaatctgggtacgcagcaaataatcaattccttttctcactgctgtattttccacctctccagcagccatcagtccaagcacagcccacgcagtctggaaggaagtgctggcttccagttgtccagccaattgtggatcaagatatgaatcattggtttctccccatccgccatcggcgtgctgcaccgattccagccattgaatagcacgctgcactgcctgatggcctttatccacacgcgccagcctaaatgcttccagtacggaccaggtaccataaatgtagttactgccccagcgtccaaaccatgccccggatgattcctgttcattgaacaaaaaatccagaccgcgcttcacggcttcctgatgtctcacctcgccattcaaggcaagcaggcctacacaacgtgctgatacatcgcttgtgggcgggtccagcaatgcgccatgatctgcgaatggaatttcattcaggtagtaatacgcattgtctatatcaaatgcagcaaagcctccattactcgattgcatacccgctagccagtctgctgcccgggtaatgctgacacggtaatcttccgctccagtctgaattaatgcccacgctacagcagctgtatcatccagatccggataatgcggattagcgtactggaacgcccagcctcctcctaacagattaggccggctatcgcgccagtcaccgggttcatcgagtatctgtagaggcacaatccagtcaagtgcacgacgaatcggctcgctatcagcctgtttatcctcctgcagcgccaaggtggccagcacagtatcccacacgggagatacacaaggctgacaccaggtaatctcttctccttcatccaccagcagctcacgtaaagattggcgacattgctgaagtagcgggtgatcacggtcgtgacccagcaatgttaatgcctcataggcattaaccatcgccggaaaaattgcccccagaccatcgttaccattaagacgttcgattacccattgttcagcctttttcacagcccggcgacggatgaatgacggaataaatggttccagctttgaagccaaccgctccacatacagcaacaagcgattaagagaagtacgtaccgggaagtagtttttttccttctccggatcaacaacaaacagttcttgtacatgcacattgcgaggattgattgccttggctttcagcgtacatagaatagaaagcggcaccatcaccgtacgcgaccagtacgccactttgctcaggtgaaaaggaaaccagcgcggcaacagcatgatctcagctggaacaaatggtactccacgccatggaatctgccgatacatagcaagcaacaaacgggtaaatacattcgagcgcgccgcccccccccgttccagtatggcgttacgggcatgaaccatatgcgctgcttccagcgagtctccagccagcttcaaagcgtaataggtcttgacactgcaactcatatcaaaatcaccaccatagtatagtggccagccaccatgcccatcggttacctgccgggtacgcaagaaatttgcaattttgcgctccagtacagtgtccacttcatccatgaaatgcatcatcaggatatattcagccggaattgtgcaatctgcttccagtggaaagcaccagtggccatcttctcgctgctgtgccagtaaagctgtgtatgcgcgggtgatagcttcatccagtgtaaccgcagaaatctcgtttgcctcattcccagccacatcatccgccggaaagttttctgaaaccagcgagctatccgacagagaagatttttgtatcaaggttctgaaaaacgcctgtgaaatagacataaaatgcaaagccctcatttggtaaatctgcatgaaatgattgtacagcgatcttccaggagatagtccaatcacttattatagaattgtatttcttgagaaaatgatatgacagaattatgacacccctaatcaaggcgggggatttgtttttgtggattcaatcatcagatcagggtcgtcaattaacagatcatcataatgactggcggggggattcccatcgtatatctgatattcacgttgctgcatataaccttcacgaacaaacaaataaggatccagagccgattcgtcgcgtattttcataggtcctgagagactggctctcttgtcaacgatacgcaaaatggccaaaggtatagccaccggaccgcccagcgcataagctagataaaacagcccgtccgtaaacacactaaccggcagatcgaccatatcccgggaattacttgggccataagcgggaatgaagagatagggtccactacccattccccacactgccaatgtctgcccaaaatcttcattatgctcctcaaatcccatgtgtccggccatatcggaaagtcctccaacaccgatagtggaattgatgacaaaacgcatcgtatctgaaaccccctgacgtattttcccttgtaaaaaactgttcaaaactacacttgggtaggaaagattccggtaaaaattactgacagggtgctgtattgcttccggtacatattcgatatatacattggcagctggctcaatcaatctgcgatcaagctcatcggtaaagcggtaggatttacggttcagtgactcatacggatcatacacacccgcctggttttcttctcttggcaccgagccgcaacttacgcagaaaaacacaacgcacagaaaaatatatcgcaagtaactcggcttaatttcagctataaagctctttctgtccctaattatagtgctgttatttttctcgtaagaattcaaggtgttttcctgaaaataggataactggttttatctatataattattcgggatgcgatagtaaccaggagctcgtcaggtttgagtaaccgagtgaaccaggtgaaaaaaccagggacagttatttataattccgtggcgcacagcctgcagacttctagacgcgtctttcgccaagcactatctcaaccagttttaaggcctgcaattccatttccaggaccagttcatccactttggctcgaaaatgacgataaaaaataatgctcggaatcgcaactaaaatgccaaacgcggaattatacagagcgactgaaattccatgggccagttgtactggattactaccagatggtgtgcctgatccaaaaatctcgatcataccgatcaatgtaccgaacagccccattaacggacttagggaagcaattgttcctagtgtcgtaaggtagcgctccagctcatgggccgctactcgcccggcctcttcgatcgaatccttcatgatttctcgcggactatcgatgtttttcaatcctgctaccagcacctgtccgagtggagaatgtgactgtaaacgagtgagcgtatcagcatgcacaccagagtgacgatattcctgcaacactctcggcaataaatctctcggggaaacttttgacagacgcagactccacaaacgttcaccgataatacccaccgctatgacagaagccagtattatcggccatatcggccatcctgctgcctgaataattgaaaacacgaattaatccccttagtttatagtgaaatcaccgcattatattttgcaacaccaatatgctttgctcaaccagcaatttttactgaaaggttatacacaattcctgtggataactgtgtgaataaatcatggacaagttggataagtaccattgcagacatggaattttttgaactgcctaatttttaggccaaataaaatttttaaaaacaaatgtttattttaaaccattgttatcgtacaaacttttctattcataatgtaataaccaaatgtcattgtggatgattataaaccggcatgattgataacaacctttttcctgagccaaagaaaatagtgtggcgggtcagtgaattaaaccggcatgtgcgtgtaatactcgaacagacttttccattgttatgggtaagtggagaaatttccaatctgaaacgttatccgtcgggacactggtacttttcgctcaaggatgacaatgctcaggtacgatgtgtcatgttccgccataaaaatatgtacctggattggatgccgcaggatggtgctcaagtggaagcccaggcactgattacgctctatgaagcacgtggagagtttcaactgacaattgagcagcttcgccgcgctggattaggtgttttgtttgaaacgtttgagcggctcaaaaccagacttcagcaagaggggctgttcaatcccgaatacaagcaactgattcctccttaccctcaacaaatcggaatcatcacttcaaccaatactgctgcgctgagagatgtactcacgacactgcaacggcgtttaccctcgctacctgtcgttatttatcccgcaccggtacaaggtaaagaagctgcctcagcaattgtgactgcgctacaaatcgccacacagcgaagtgaatgcgatgtgctgatcctgtgtcgtggaggaggttcaatagaagatttatgggcgttcaatgaagaaatcgttgcgcgagcgattgctgcctgcccaattccaattgtaaccggtatcggccatgaaaccgatttcaccattgctgattttgtagcagatatgcgcgcaccgacacctaccggtgccgctcagttagcagccccggacagacaagatattctgcatcgcctgcagtactggcagcatcgattgcagcaggcaatagaacgaaatattgaacgtcgcatgcaaacgaccgatttgcttactcaccgtctgattcaccctggagagagaatccactaccagttaatccatttgtcgcaattacacaaccgtttactacatgcatggagcagacaactggaagtttgcaaatggcgaatcgaagcattcaggcgacgtatacaattcaccaaacccgatatcaatacggggaaaagatatcagcaagaactggctgcgcggctgcaacgagcgatggtgtaccgactggaaagcttgcaggttcaacttatccgacatcaacagcatctcgctcatctcgacccgaaagcagtgctggaacgtggttacagtatcacctatactgccgggggggaaattctgcaagacagtcagcagattcacactggcgataacgtacagatagtctttgccaagggatcggccaaggcaaatatcactgaaacaaacaaatgactcagatcaactttcttatcctcattcttatcacgcttcactttaaccaggagtttaaccaataatgtccagaatctttcttgcgttgggggcattgaatgcatttctgtgtgtggcactgggggccatgggagcacatggcctcaaatctatactgacacccgacatgcttaccaattttcagatcggcgtacaatatcacttctaccatgcaatcgggctgatactggttggactggcgctagatcgattcccgcaagcgcgcgcattaaaattttccggcattttaatgatggtggggattctgttgttctccggcacattgtatgttatcagcctcaccgggtggaaaggattgagcatggccgctccactgggtggaatgtcttacatgagtgcctggcttctgtttgcctatgctgtctggagaaacaaacgggggtgaaatcacattccggatttctactaccaaccactacaagattgcaaaatagcagaaaataaaatgacagaacatttcttcgcgccctgtccacgcgggctggaagcggttctagcggcagaacttgaatgtcttgaagcgacctctattgagatttcacccggaggagtagcttttcgtggaagttggctaacctgttaccgtgccaatcttgaaagtcgcatcgccagccgcattttgtggcaagtggccagaaatcagtaccgcagtgaagccgacatttacgacatcacacatcgcttgtcctggcccgactggtttgagccgcgattgacaataaaggtcaatctggccgcaattaaatgcccgctgcgcagtcttgatttccttacactccgaatcaaggatgcaatctgcgacaaattccgcactatccgtggcaagcgtccagacatcgacaccaccacacccgatatacgtattcatggattccttgatgcacggcaatttaccctttacctggatacttcaggcgaagcactattcaaacgcggtctgcgccaaacccagggggatgctcctttgcgtgaaaacctggctgccggcatcctggcattggctggctggcatcctggcattccactgcttgacccaatgtgcggtagcgggactctgttactggaagcagcacaaattgcctgccagattgcacccggcgccaggcgacaatttgcattcgagaatctcaaactgtttgatgccaactcctggaaaaaacttaaacaaacagctgcaaaccgccaacgtgaacgtatattccaatccatttatggcagtgatctgtatggcaatgcactggttaatgcacgtaacaatctggcaacagcaggattagccgagtgcgtcgcgctgaagcaggcgaacgttttggaaatttctcctccagctgaaaccggcatgttgatcagtaatccaccgtacggcgtacgcgttggagatcaccagacattggccgaattttatccccaattgggaaatgtactgaaacaacgattcagcggctggcaggcttttctgctaactgctgatcccctgctggcaaaatctattcgacttacaccttcacgccgaactccactttttaatggcgcactggaatgtcgtttgctcgaatacagactggttgccggcagcatgcgcagagagaaaccatcaaatgaatcaagcaaaaaacagtcataaactttaagataaagttatgagaataatctttctactgattttcttggcctgtgccggattaattggttatgcgctttatctgcaactgatggatggattgctaccctgcccgttatgcatcttccagcgcattgcttactggctgatcgggatcactgctttatttacattcatacataatccacaatcactgggacgacatatctactgtggattaatcattttattttcactggcaggtgctattgttgccggccgacaagcctggttaatacgttttcctgaagcattcgaatgcggtatcagcccagaagaagcttttttgaatggattgcctcttgcacaatggtggccgaatatgtttgaagccaatggtgactgcaatgatggtacctggcagtttctatcattgacgctgccggattggtcattactcatatttacggcattcggaattattgcagggttactctggcacaagaaatataattctattaatcaataatacggtcacctaattcatatcaatccggaatccagaaggctaacagcctcaagattggcggaaaaatacatggagcaaattacgtacttgaaccatcacttacaaataattggtgatgcgttaaaaatcgggtaatcatccggtttatgcgggccgagtaaacgccaactctctcagtcaactttttccaaccaggaataacatctgctgcgattaataatcagtaataacagtatagtactgtgtataagctcttcaactaataaaaggatagcatgtcatgatacgtaaacttattagctcaggctcgacatttgaaaaggaaattggttattcgcgtgcggttgtcgtagataattgggtactggtatccggtacaacaggtttcgattacagcaaaatgattatttccgatgatttactggaacaggcagagcagtgtttcaaaaatattgaaatcgcactcaatcaagcagaatcgagcatgaaagacgtggtacgggttacttatgtatttcctaaaacagaagattttgagaaatgctggccagtgatgcgtaaatatttgggagatgtcaggccatccgccatgatgctaaccgcagctttatcagatccacgcatgaaaatagagattcaggtgacagcttatcgcagtactgaaacttaacctttccattcaggcattcaggatgaagagtgttactaaaaagtgactcaacatcccggcaaattgcttatacagcaagccagccatgaacagcggataacgagttttatctatataattatctgggactgaacaaataagcaattgtcactgttgtgtcaacaaataatttcttaataccactgcctggttacactctgtgtcgtgtgccccgtaaagtagtgtcagttttccttcaacagccttatccagcaacgtttttacgccgggattaacagacaattcatcacgatagcgctgctcaaattccgcccattttgcgtggtcatgattgaaccacttgcgtaaatttgtggtaggtgcaatctctttcaaccacaagtcacacgccacctgctctttggttagtccgcgcggccagagtcgatccaccagaatacggtaaccatccgcagggtcagccgattcataagctcttttaatttggatgtccatctcggtaaaatcctcgtatgctttaatcatgctattaactatacaatatccactatgagccatacacccgttctggaattaagtgatatcagcaaatcctacttggatcggcaggtattgtccggtttatcctacagccttgccgctggagaatatgttgccatcatgggtgactctggggtgggaaaatcgactttattgaacctgattgccggattggatagccccgatggcggtgaaataaaaattgatggcaagaacttgccggtggatgatgaagcggcaacaatcctgcgacgtaagtatctgggattcatcttccaggcatttcatgtgttgcctcatctgacactgcagcaaaatgtctcgctgccgctgctactcaatcatctgccgcttgatcatgcactgactatgctggcagcagtaggcttgcagggaagggagcaggattttcctcatcagctatcgggaggggaactgcaacgggtagcaatcgcccgcgcactggtacaccgcccgcgcctgattctggcggatgaacccaccggcaatctcgatcaggatacttctcgggaaatcctgcaattgattcgttccgagatcaagacgaaccaggcttccgccattattgttacgcattcgcgcctggcggctgaaacagcagacagaatcctgatactggacaggcatggcctggctccgatttctctggaaaaccgagaatgagccagccactactcactcgctggctgttgcagggtgaatggcgctcacaccgtctgcaatccatcgtggctgtgctggcgattatgttcggggtggcgctgggattcaccattcatctgatcaatacggcggctgtcagtgaattctccgccgccacccgcagtctttccggaacctccgatctgacggtgcgcgccctccgatctacgttcgatgaaacactttatcccatgctcagtcagcatgagggcgtagcgcgggccagcccggtgctggagatcactgtcggcatccctgccaaggcaaaaactgtgcataacccggctctcaagattctggggctggatatgtttcgtgcgatcggtatcacacctgatctgctgggcgtaccagcagaggataaacctatggatatgttggccgatgatgctgtttttctgtcccccgcagcaatggaatggcttgcagtcacacagggagattcaatcacagtaaacatgggaacaaggcagattacgttgcgcgtggccggtggactggcacgagcacatgctgggcagcgcattgccgtcatggatatcggtgcagcacagtggcgctttgaccaaatcggccagctttcgcgtattgagctgaaactgcagcagggtgttaatcacactgcatttcgggaaacgctgggtaaggagctgggagcttcctatttattgactgaaagtcaggacgacgatgcacgcgcgcacaatatgtcacgcgcttaccgcgtcaacctggacattctggcgctggtggcactttttactggcgcgtttctaattttctccggccaggctctctccaccatccggcggcgatcacagcttgctctattgcgtgtgctgggcatgacccgtcgtcaacttttgcgccaacttctgctggagagcggattacttggtgtactgggatcgctgctggggctggcactgggatatttgctggcggcgatggcgctccatcatcttgatgcagatctgggtgccggtttctttccgggactggaaccacagttgcatttcgatcccctggcggcattactctattttttactgggaaccggcgttactgtactgggcagcctgttgcctgcatgggaagcagctcacacacatccggcgcccgcactcaagtctggcagtgaatacactgtactggcagcactacgtgcaccccggctggctgctgtctgcctgctgacgggtattatttttgccggattgccaccagtgtatgatctgcctgtgtttggctacctggccatcgtcctgttgctgattggcagtatggctgcattgccatatttatgcggattacttttctccaccctgttacgcgcactcaatccaagtaaatcaaacattttgtatatgctggcagtcacccggctttcaaatgcttccggtctagcagccattgcactgggtggtgtactggtcagcttcagtttgatggtggctatggcgattatggtaaccagtttccgcgtatcggtagataactggcttgcacaagtattgcccgctgatctttatctgcaccccatcattcaccaggatatgcgcggcctgacaactgatgaacagcagactattacttctctgccagatattgcacgcattgattttatccgttcgataccggttactctggatccgaccaggcctaacatcacgctgctggcacgcccgattgatcgcaacgaccccggattgatagtcccattgacagaaaacgcgctatcacccggggagattccccctgatacggtaccgatctgggtatcggaagcaatggttgatctgtatggatttaaaaccggcaagcaggtcacactgccttttgccgacccttcgcaattattcatcgttgccggggtgtggcgggattacggacgtatcttcggcgcgatccagatggaattatccgattatcgcaagctgaccggagatgatcatgtcagcgatgcagcactatggataaaacctggagcaactattcacacagcggtgtcagcactaaaggcgctgccgtttggagatacgctggaaatcatggaaaccggccgggtgcgtgcagttgccttgaaacagtttgaccgcagctttgcagtaacctacctgctggagctggtcgcaattggtgtaggtttaatgggcgtagcagccagtttttcagcacagacgctgacccggatcagagaattcggtatgttgcgccatatcgggctcagcagacgacagattcagcgtatgttgacgctggaaggcggattattggctggatttggtattatcaccggatttctgctaggcacaggtatcagcctgattcttatttttattgtcaacccgcaatcttttcactggaccatgcaactgtacgtgccttgggcatggctggtactgatggcattggcagtactggtggccgccacattgacagcgctggtggccagccgccgtgcagcgtctggcaatgtcatccgggcagttagggaggattggtaatgcgttacttatggatattattaggcgggctgatttttcagagctctctgctttcggctccacctgtattggctcccgtcgtgcccggtaaaatatttaagttcccggatgatcatggcgctcaccccaattttcggattgaatggtggtatgtgaccggctggctggaaacatcgacaggtgatccattaggcttccagattaccttcttccgtttaacgacccaaactgatagggataaccccagccattttgctccccaccaactgatcatcgcgcatgcagcgctatccgatcctgcaatcggcaaactacagcacgaccaaaaaattgcccgttcaggattcgatctggcatacgctcgaaccggcaataccgatgtaaagctagatgactggacctttctgcgcacaatggatggccactaccaagccgatatcagggcagatgatttcaccatgaaattatcatttacaccttcacaacccttaatgttgcagggtgaaaacggtttctcgcgcaaagggccgaaagcagcacaagccagctattactacagcgagccacatttacaggcaaccggaacaatcagtcgccagggaaaggatatgtctgtcaccggaacagcctggcttgatcgcgaatggtcgagtgagtatctcgatccggatgcagcaggctgggattgggtcagcacgaacctcgataatggttctgcattgatggcttttcagatacgcgggaaagatggcagtaaaatctgggcacatgctgtattgcgtgatgcctctggtcgcgtgcaatctttcacgcctgagcaagtcagttttcacccggttcgtacctggcgctctgcccgtacgcaggctgtctacccggttgctacccgtatcagaacaggcaagatcgaatggcagattacccctttaatggatgatcaggaattggattcgcgcgattctacccgcgctgtctactgggaaggtgctatcacgcttacacgtgatggcaaaccggccgggcgaggttacatggagctgactggttatgtacagccattaacgatgtaacaacaacacatagattgggtattctcaagcattacaaaccggtaaaatttacttatttaccgatcaagataattaacaatatgaatctggataatgaatcctttgacaaggagttggatgtgcgtgggctcgtttgtccactacccattctccgcacaaaaaaatttctatctgaaatggcacatgggcaagtgctcaaaatcatggccaccgacccgggcgcaatgattgattttcaggtgtttgccgatcagacaggaaacgaattactgtcttcatccgaaattactggtgaatatctgttctacctgaaaaaaagatagcattgaaaaccagcatatatattcgctcagagtaacaacctctatcatgcctgcctgctccatccgccacaaaaaactttagagccgcaatactgctactgcggccaagcaaagcaaggcaaggcttcaatttctcctcccttccctctcctcccgtaaccggctatacttacagtgacgtatgtaaacatattgaaaataaacaaaaaatttatatgatctatgtcatgcgttttgttattgaactttatcttatatataggttcttataagtacctgataacaggtagcttttatactaaaacagaggaggtgcttgccatgaaagctttgaaatccgggtgttgtatgaggttgattaaattgaccgaagtttttttgacaacccggaattgtcctaaatcagatttcattctgaaaccagactggtaactgacttttatcaggagcttccacggaaactccaattttcgcgaaaaggagtagtaattatggctacaaatatattaaaagacaaagctgcacagcaggttgctgataaaccaacttatgataaatccgagtggtttgatgctaaatactataaattcgggctgctacctatcttagctgtagctgtgatgtgggtttatttccagcgcacatacgcctattctcacggcatggattcaatggaaccggaatttgaccggatctggatgggcttgtggcgtgttcaaatggccgctctgcctcttatagcactttttacgtggggatggttatataaaacccgcaatactgcagaacagcttgccaatctgactccaaagcaggaaataaagcggtatttctatttcctcatgtggcttggggtctatatatttgcagtttactggggatcaagcttctttaccgagcaggacgcttcatggcaccaggtgattatcagggatacaagttttactcctagccatattcctctgttttatggttcattcccggtatacatcatcatgggagtatcgatgattatttacgccaacacccggttgccgctgtacaacaaagggtggtcattccctctgatcatgaccgtagcaggaccgttgatgagtctgcctaacgttggcctgaacgagtggggacacgccttctggttcatggaagaacttttcagcgcaccgctgcactggggcttcgtgattctggcttgggctgccctgttccagggtgggcttgcagtacagatcatagctcgcttttccaacttgcttgacgtggagtggaataaacaagacagagccatattggacgatgtcgtaactgctccttaatcaggtaaactcgaggccccctggacttatcggggggtcagatctgaatgtactatccttccctgattactgaaaacatgatgccgccttcaatttcttgattcaggttgaaagaaggctttatcacaccaaagtcggaaaaatctggaaataacaactggcatcaatctccgcacggcacacgcctggtaatcagaaatttctacggaactggcggcagacagcattgtaacaattgttgtctgccgccgctgttacaagacagacaacttttttctgcaaagtctgactcattcacacccaatatccatcaggtacagaccagattattgtttgctggtaagtgaacccagaaaagcttttacatctttgataaaacttgggtcaacatcacgccccagttgatatctggccatttttttaatagcttcatccagtgtggcaacagaaccatcatggaaataaggagcggttttagcaacatttctcaggccaggtaccttgaatactcctttgtccgcttccagaccagtaacttcgtacctgccaagatcactggtttcatatgattcaaacaagccaatttttttatacgagttgccgcctatggcaataccgtgatgacaattggaacacctcatataaacaaattttttcaaccctcgtttctcagcagcatttaaagcattctcgtcacccctaagaaaatcgtcaaaacgcgaaggcgtgataagcgtgcgttcaaaagcgccaattgccttgccgatatttttatactgaatcggatctttttcatccttgaaagcctcagcaaacatggtttgatattcatcaattttttttagtttgctgattacagcttcctcattaggcatccccatttcaattggattcaaaatctggctaagagcttgctcttcaacatttctggcacgtccatcccagaactgagcaatttgcaacgcagcattgagtgtggtcggagcatttctaccaccacgtctaccatcatgccccggtgaggttggctggttatcaacaccaaaattatctagttggtggcaggagttgcaggaaatagtgtcattaattgaaagtcgcgggtcaagatacagcttcttgcccaacgcaatcaaagcgacattttttgtttcatcaataatcgaaacgggtaacggctcaaaactctgtgtatagttttgcgcgtagccataagaacttgccattaataacagcaataaaaatattatttgcataagacctccggaaattcacataaacaccttgaccaacttcgcgcaataacttttctcatgagactgatcgcaagaaattccaagggttgtttacagagtagttgactaaaacaggaagtcaatattttataagaacctgtttatgatctcgtaaagctggtgttcatgttggggcatgaggaaaagttatctgagcgctctatcgcgaaaacaacttgctgttattcaaccaattccggaaagagttcgcaaagtcaccaagccacgcattattgacctattcgccgtattttgcacagtggtgtacatactaaaacgggctgtcaatggcgggcgcttcccggtgactacccgaaatgggagacgatttacacgtatttctccaaatgaaaaaaacctgccgtcgatggcatgagtgcgttggggcgcgcattaaaaaatcagatatcggaggctcgtattcaggctggccgcaaacgcatacccaagcgtgtgattgttgatgcccagagtgtaaaaaaacacggatactgccaaggaaaagggctacgatacagacaagaaaatgtccgaaatcaaacgacatatcgttgttgacaccttgggattgcctcacgccattgctgcgacaaccgcagaggttaccgaccgcaagggcgctattgctacattgacgccaggcacacaccgactgtccagcgtattgagcatctttgcggattctggctacacagctcaaccatttaccgaagcagtcaggttgtgtttgggtgaggtgatcacggtgcagattaccaggaaaagtgaaatgcacacttttgcggtcatttccaggcgctggattgtgggataaactttttcatggctggaaaaataccggcgattatgaaagaaccgcgagcgaaaactcaataccagcctgcaatttgtccacctgacacttttaatactattacccagaagagcataaacaggttctaagaagaggggtaatcagacctgttgacacaccgttttaccagtatgtcaaacgcagatcagaatcggttttaggttatggcacgttctcgcaggatcagctcagccagtttcaaatcctgcgggtaagtcactttgaagttataggcatttcctactactagcttaggagagagtcccaatgcctctactgcactggcatcatccgtaatacccgctggggccttttccagcgcttcaagcagcagcttcatgcgaaacatttgtggagtctgcgcctgccacagccgctctctcggttccgtacggattacccgaccagcatcatctgcacgttttaaagtatccgccagcggcaccgccagcaaaccaccgacttcgtcatccgcaagctggtcaagcaaccgctcaaccagggctgtacttaatcccgggcgcgctgcatcgtgtactagtatccagtcctgatcctgtacataatttgcagcacgcaatgcctttagtccattggtgacgctttccgcacgagttgccccaccacagttaaatatctggatcttgccggcaaattcacgccagttatgctgaatccattcagtatcttcaggtgccagcacaatgcagactgtggaaatacgggcaatgctacacaaggtacgcagtgcgtggtaaatcataggtttacctgctagtggccggtactgtttggggatgtcttctcccatacgcgaaccggaaccggcagctgtaatcagcgcaataaatttaaccatgcaagaatcctgtaaaatgggcctgtttgttatcaaatacggttattttatcaacgggagggttattatgaaaactgtcagatctttgttacaggaaaaaggatacgatgttgtcgttattggaccgagtgattccgtatccgacgcaatgcaaaagatgacaaccaacaacatcggtgcgttgctggttgttaaagacaaaaaactagtcggtattctaactgagcgagatttttccagaaaatactgcttactgaatagatcggtaaaagatatgcgagtagaggaaattatgacccgtcaggtagcttatgttggactggattacacgaatgaagattgtatggcactgatgactgaaatacgcgttcgccatcttcccgtcttggatgatggaaatattgtcggaattctttcgataggtgacttggtaaaagatatcatctcacaacatgaatttgttattcaacagcttatacaatacatttatgacgcgcgggaaatttaacacttttaggtttaaccctcatctcagagaaataaaaaattgaatcctgagatatcaggagatggagttttcatgatcgatttgtgacagatgccgggcaactgaccagcgcgccccaatccaccctagtgcaccggagaatagcagcagaatcagactatcccgccaggaaagatgattgagcgtaaatgtggtggcatatagccgggccagttcggacagagcttcattcagtttgaggattgcaaaataaagcagcaaccaggccagtacagcgcccgccaccccctgtagcgcaccaaaatagagaaatggtcggcggatatagctatctgtggcaccaatcagtttggatagctcaatctcgtcacgccgcgtcaatatctgtagacggatggtattgaatataacgatcacaagcgccgcgccgaacagtgatgccagcataatgacgaccagtcttcctacatcaagcatggcatccagttttctggcccagtcagtatctaccaatacatgcgccaccctgggccagatctgtaccatggcttgtatttcttctatttcattggcagacatatggccaaggttgattacaaacgcatcaggcaatggattttgcccgagattatgcatcacctccgccatcccactttcctgtttcagttcctgtaacacaatttcctttgaaataaactgaaaaccttcaattgtgggcatcttttccagccgagcattgatcagctcaacgtcggcctggctagctgccgtatccagcataatggtcatttgttgcatgtctgttgcctgccctgatacctcgcgcaagttttccagcagtatgaaaatacccgtgggcaagctcagaacaatactgaaaacgatgatactcagcagactggtaacaggagcagccgcaagttgtctgagtgcacgtaacagcgcatacccatgttgagacagccagctgctcatgtgaccagctttccgtggcgcagctcaagtacacgatgttgtgtcatatcaagcaatattctgtcgtgtgtcgagataagaacggtaacgcccacctgattgaatgattcgaaaacagccatgatgtctcgtgcgtaaccgctatcaagattggcagtaggttcatccgcgatcagaatggtcgggcgatgaacaacagcgcgcgcaatacacagccgttgtttttctcctcccgacaaagtaactggatttgccttctccttattcagcagaccaactttatctagcgccgcacgcacacgcgaagcactagctctcgtatcaaaggccgtcacctgcaacggcaacatgacgttagcaaaaacattacggtcatacaggattttttgttcctgaaaaatcattcctatattccggcgcaagtaaggaatggcacttcgtctgagtgaatcaatattttgctgccctaccacaatactcccggaagttggacgttctatcgcggccatcaacttcagaagtgtacttttaccagcaccagagtgcccggaaaagaaaatcagctctccctggctaatcgacagggtaatacttttgagtgcctcataccctcctggataaaacttgctgacattgttgaagttgatcattgcagccataccagacactcaaacaaaacagaggattaatcaaacagtgcttctgcaaattctcgggcattgaaaggccttaaatcatccagcccttcccccatccctataaaacgtaaagcgagcggattatcgacaaattgtgcagcaatggcagcaattactccgcccttggcagttccatccagcttagtcatgaccaatccagtaacacccagagcatcattgaaggcctttaactgactgacagcgttttgaccagtattcgcatccagcactagcagtacctcgtgcggtgcatcaggtatggctttggcaacgacgcgcttgattttcttgatttcttccatcaaatggagctgggtagttaggcgcccagcggtatcggctagaacgatatctatttttcttgcaatagctgcattgactgcatcgaaaatcacagcggccggatcaccttttttgcccggatcactttcctgggaaataactgtgatctggttgcgctcgccccatattttaagttgctcctgtgctgccgcgcgaaaagtatcgccagccgccagcaacaccgaatgtccctgtgactggaaataatgagcaagcttaccgatggtggtagttttaccaacaccgtttacgccagcaatcatgatcacgaagggtttatgcccagttgtaaccagtggtcgctccaacggctgcagcagttcagtcagtgcatcctgtaaggctgttttaagttgttttgaatcgtccagtgcatcacgcttaacgcgggtacgcagtgattccagcaaccggtttgtcgcctggattccagtatctgctgtcaataaagcggtctcaagttcctcatacagatcttcatcgattttcctgcccccaaacaacccggacaactgcttgccaaactgctgtcgtgtgcgtgtcaggccctgcctgatcttatcggcgaaactgactgactcgacttcaatctgagcaggatttttttcgtcagagttctttttggatttaaaaatgctaaacattctggtaggctgtttctgtttcggggaaacaaacatcataccatcaaccaattgccggggtaatgtcagtcatccgccccaggccagttcaactttcagcacaatatgaaaattagtttttgccccagtcgtctcattatttttctttgcattacattattggtatcgccactaccagcttcagccaatccacacgaatatctgcttgataatggccttaaactggttatcaaggaagatcatcgttcgccagtggtcattcagcaggtctggtacaaggccggcagtatggatgaagtcaacgggacaaccggcgtggcacatgcactggaacacatgatgttcaagggaactgacagtgtgcctaccggagaattttccagaagaattgcagccgttggcggtaaggagaatgcttttaccagtagtgactacactgcttattatcagcagctgcaccagcgccacttgccaatggcaatggaacttgaatccgaccgcatgcacaatctgcggctgacacaagaagaatttgccaaggaaatacaggttgtaatggaagaaagaaggctgcgcacggatgatcaggcacacgcgttactgtacgaaaaactaatggcgacagcctttcaggcacatccctatcgtcgcccgattattggctggatgaatgatctggagcatatgcaggtaagtgatgcccaggattggtataagcgctggtatgcgcccaataatgcggtactggtagtggtaggcgacgttgatccggaaagcgtacttgcattggcaaagaaatattacggaagattcagcgccggtaaaattccatctttgtccgaacgcaagccacaaattgaaccgcctcaaataggaatcaagcgactggtagtaaaggcacctgcaaaactcccgcatctgatcatgggatacaaagttcctgtactcaaagatcccaaaaatgattgggagccctacgcactgactattctggctgaagtactggatggcaacgccgcagcaagacttaacaaagctctggtacgtgaaacacgcgttgccatctcggctgatgccggctatagcgctattgagcgtggccctggtactttttatattgatgggactcccagcgaaggcagaacagcagatgaactggaacagtcgattcgtactgaaatcgacaaaattatacagtccggaatcacccaggaagaacttgctcgcgtcaaggcacaagtagtggcaagccgtacttatcaacttgactccacttttgcgcagacgatgcagattggcagactggaaagcatcggactgtcccaccgagatgcagacatcattctggaacgactacaggcagttacggcagagcaggtcaggaatgtcgctgagaaatatctgatagatgattcgctgactgtggccgtactggatccgcaacctttatcagaaacctcttcctcccggaacagcaacattgaactaaaacactaaccttgcctatcttctcgaaagacaaaggaaaggtagctgtgttagcagttgctcattactatttccagggtggcaccatctgtaaactgttgattctttttcgattccctaacctcaattgtacaaatgcatcgcccgattcgtgctctcattgactgtactgctttacaacacaacctttctgttgtccgcagccacgctcgccaggcccgcatcatggctgttgtcaaagccgatgcctacggccatggcttgctccgtaccacacaagcattaaatacagcggatggatttgctgtacttgagctggaagcagcgatccagctaagggaagccggatttaatcaacctgttttacttctggaaggatttttctcggcagaggagcttgaggcaatcgatcattatcagctcagtacggttattcacagtcatgagcagctatcactactgctggcacacagaaagacaggaaaatcggatatctacctcaagatcaatactggcatgaatcgccttggtttcaggcctgaagaagaaagttacgtattcaacagaatcaggcaatggcgttcagataccagtattacactgatgacacatttttcctgtgcggatgacgctctggaagcagatcaagttaatcagcaactggatcagtttgcagcacttcacgatgtaaaagaaaataatctaccccaaacgctagctaattctgcagcaattttacgttaccccggaacacatgcggactgggtacgtcctggtatagtcctctacggagcatcgcccctgccggacaaaacaggtattgaactggggttacggcctgtcatgacactgaccagccagatcatcgctgtgcaacagcttgatccatcagacagagtaggctacggcgggcagtttatcgcaaaccagccaatgcgtatcggagttgttgcagccggttacgcagatgggtatccacgtcatgcccctaccggaaccccggtactggttaatggccagcgcacgcggctggtcgggcgtatttcaatggatatgctaactgtcgatctgaacgggattagcgaagccggggtgggaagcccggtaaccctctggggagaaggactaccggtagaagaagttgcaaaatcggcacaaactatcagttacgagctactgacagcactctctcccagagtaccgagcatcagcataagctaatgattacagattttttgttaatacctgattattcaactttggcatttttacgcagcgactcaactaccgctgcaaacttgcgctgtaatactcgctgctgcatattttgttttacttcgtcaaaagaaggtggaacagcagtacgcacatcatccagacgaattacatgccaaccaaagggcgtttgtactggctgactggttgtttcgccttttttcagtttggtcaatgcatcggaaaagggcttaacataaactgccgccgagctccaacccagctccccaccattactcttgctgccggtatcaatggagcgctcactagccagtttctcaaatacgccgccctttttcagagaggcaaccaaatccttggcttcttgttcggtttccacaagaatatggcgtgctttgtattccttatcacccatctgtgattttactgattcatattccttgcgtaattcatcatcgctaaccggattatttcgcataaaatcagcctgatacgccctgatcaatattccctggcgcgccagatcaatctgtgtgacaacatccggattacggtcaagccccttttttattgcttcttgtgtcagtacttcttccgtgatgagattttcgcgcaaagcatttctcatttcagctgaatcgggttgaccctgcactgttgctgccttgatcaccaggtcaaggcgtgattgtggtatcgctataccgttaactttggcgactgtaccaccgccctgggcacttaagggcgtagtacatacaaatcccagcacagcaagtggcacacagagaaacttggttaagcgcataaaatttcctttaaatagtaaagtagttgacaaattttatctgaataatctaaaaagcatacattttaacaaaacacggataagttctttttgaaaacaaacaagcttttacagattccttttgaaaatattcaggcctgaataaactggaaaaatctctggccaccaccaatttattcaggcagaaccttcctgaacggctttacggccacttttgcataaataccggctgccaggtatggatcagcatctgcccattcctgagccgcattcagtgacgcaaactctgccactatcaagcttccggtaaaacccgccggcccggggtccacgctatcaattgccggacaagggcctgccaataacagtctcccctgctcctgtaattcctggattcgcgccaaatgtgcaggccggttaactacccgttgcgccaggctatccggaacatcttcaccgtatattaaatagagcatgttattttctcttagtcagtacaaatctcatacggttctggttctttgtggcaggcctgaatatcatttggatacacaagctttattaccacagattagtaccaataatttcctaagccaatacgggcggcagaagggcaaccaaagcattacgttcatttgttgccattcccagcaaggcaaaaccatgtaaattaccagcttcatcctgatacaaagctttcatgccattctcaacagtttgaattttccactcaccttctaccccaggatcgggaggcgagataaccgccgggcaggcaggtgttttgaccattaccggcatcgccgggtagcgcagtaatgtctggttaccggcaattgttgcagccagagctcgaccagcatgcgaaattggcagaataaaaggtaatactttcccggccacttctgcacaatcacccaaggcatagatattctgaatactggactgtaaataacgatcaaccgtaattccacgattgatctgaattcctgctgcctcagctaaatcagtacgtggcttcaaaccaatggcagacagcaccatatcggcctgaacaactccacctcctttgcaatataaatgataatatccattctccttgcttatcttctcaacagttgtaccgagcagaaatttaacacctgccgttgacaatttctcacggaaaaagtgtccggcttcggaaggaagcaaccgacctaatggttgcggactcaagtcaaagacgcttacctgatagccttttgctacaagatcgttggcaaactcgcaaccaatcaagccggcgcccagtatagcgacatgacgcttattttccaggttctcacgaaatctccggtaatcatccagatcattaatggatagcatatcatccgcaccgcttccaggtatcggcaggcgcatcggatcagctcccagcgccaatacgagccgaccataagtcagctgcgtaccattttcgaaataaacattattcgcagccacatcaagtgtatcgacacgcgtataaggctgcactgtgatacccagttgtccggacatctgttctgagctcgcactcagaatggaatcaggtgttttacctgttgccaaagcattggataacataggctttgaataaaaaccgccatgatcggcagataagagagtgattggcacggcagaatccagtctccgcagctcgcgtacaaccgtataacccgccaacccgcttcctataactacgacaggcaattgactcatattgatataccctgtttgatcacaatcaatttatctcctttcttttcgcccaaaccagcgaacaaccgaattcacacaagcattcccacccttcaggattttgcaaccacgcgacaaccagcacgtaccttggctttttattgtaccttaaccccaaaaattccagcgacatataggattacattacatagaaataccttatcccgacacttgatgttgtgaaatatgtcaccatatatcggtttgctttgaacgattgttttttattacattcaaaatcagacacgtgtactaataaacctgaaggaagaagataatgaaacggatttttctttttattgtaacgaacttggccatactggtaatgctgagtataaccctgcgtttgctcggtgttgaccgcatactggatgctgaaggtagtggattaaattttaatgctctactggttttatcggctgtaataggatttggcggttctctcatttcgcttgccatgtccaaatggagtgccaagcacatgactggtgccatggtcattgaaattccttcaaattccaccgaaggttggctggtagaaactgtccgccggcaagccaaagcagctggcgtgggtatgcctgaagtggccatttacgattcacctgatattaatgcattcgcaacaggaatgaatagaaacaatgcgttggtagcagtcagctcaggattgctgcaaaaaatgagtcgtgatgaggctgaagcggtactggctcatgaagtcagtcatattgccaatggcgacatggtaacgctggcattgattcagggcgtggtgaatacatttgtgattttcctctcccgtatcatcggccatgtaattgatcgcgctgtcttcagaacggaagaaggacatggccccgcctatttcattaccagccttgtcgcacaactggtactgggcatactcgccacgataattgtgatgtggttcagtcgtcagcgtgaattccgcgcagatgccgggagtgcacagctttccggaagaaataaaatggttgctgcactgcggcgattacaacaggaatatgagccatctcatttgccagataagatcgctgcttttggaatctctggacaaaagagccagattgggcgtctgtttatgtcgcatccccctctggaagagcgcatccaggcattacaatctgcctgatgatagagcagctggggctggtgaatccttacaccagccccagcaaaaatgtaaataaccatctgattgaatcaatcatcaatgattatttcctcgtcatcaaaatccactgactcttccgcggatgaagtgccgttgttttgaatcaggctatcacgcctctgtaaataagcatcgcgtacaaactcgtacttatccagcgaagcttcctccagcgtcttatccagatccagcaactgctcacgcctatcgataaattccattgtagcaacaggcatacgcacagtcagtagatcaaagccggtataaatagctcgcgcaggatgaatgaacgtgctatccacaccaagcccaactgcatcccttacagtactgggccctagtatcggcaatacaagatagggtccgctaccaacaccataaaaacccaatgtttggccgaaatcttcattgcgcttattgatgtcaatatcgctcacctgagtgatatcactggccagatcaatagctcccaacatcccaaaggttgtgttaatcaccacacgtgttgtactcgccattgcgtccataaatttcagctgcagcagggagttcgcaacaatgacaacatcatcaagattggaaaagaagtttccaacaatcattctgagtggagatggtagaaattgctgataccccctggcaacaggctccaccacaatttcatcaagcttttcattaaatgaaaatattgcgcggttcatggattccaaaggatcgtgccggttatctgtggtagcacaacctgacagtgcgctgcctaatgacagaatcacgaaaaattttcggaaataaagagagcaaacaaccataattcgttaattattctttattatgaatttgacattttgtcacgaatacaagaatcgcaacaagccggttggaaaaatataaacggcacccaacctcacgaattgaatcttttatttatatgtcgtgaattgcactctttggtatctcttacgctttttgactgaaaacccgatcagctgcttccagtgttttgtcgatttccacatcaccgtgcgcagcagaaacgaagcctgcttcgaaagctgagggtgcaaaataaataccctctttcagcatggcatgaaaaaaacggttaaacgcatcacggtcactctccattatttcagtaaaacttactggcggtgttttcctgaaataaattccaaacattccgcccactgcctgtgcactaaacaccacgccattttttatggcgacagaagtcaagccgtctgttaacttacgtgtcatcattgacaacttgtcaaaaaaaccaggcgtctgtatttgacgcaaagtttccaatccggcagcaactgcaaccggattgccggaaagtgtacctgcttgatacacgggtcccaatggtgcaaggcattccatcacatcacgccgtccaccaaacgctgccatgggtaaccccccaccgattactttccctagaatggttagatctggcctgatgccatatagcccttgggcacattccagaccaacgcggaaacctgtcatcacctcatccagaatcagcaaactgctatgctttgtacataatgtgcgtaatgtttccagaaactggggggttgccttaatcaaattcatattgcccgccactggttcgacgatcacagcggcaatttcagaacccagtttgctgaaggttgcttccaccccggcaacatcgttatagttcaataccagagtatttcctgctgtttcagcgggaacccctgctgaactgggatggccgaaagtcaatgcgcctgaacctgctttaaccagcaaagcatcatcgtgcccgtggtaacaaccttcaaacttgataatccggtttctgccggtataaccacgcgcgagccgaatggcactcattccagcctctgtaccggaacttaccagccgtaccagttccagggaaggcaacaaccgacataacaattcagctatttccagctctgctgccgttggagcaccaaaagaggtaccacggcttgccgcatcctgaacggccctgacaacatcggggtgcgcatgcccgagaataagcggcccccatgatccaacgtaatcaatataggattttccttccacatcccagaaacaagcaccctgcccgcgctgaaaaaaaataggcgtacctcctacggatttaaaagcacgtactggtgaattaacgcctcccggaatgtattgcctggagcgctcgaacaattgttgattagtgatcgtcattggaatatttgcttaaaagttatcgaaattgatggttcaacagaatagctttgaaaaatgccgggcagcagattggatatcttgtgcgctgaacagcgcctgactgacagcaacggcatcacatccacgggcaatcagcgcctcggcattgtccagattgatgccgccaattgccacaatgggaatattcaacgttttttttgcagcatcaagcagatgaatcggtgcctgatatgcatcaattttagtcattgacggataaaaagcaccaaatgcaacataatctgctcccgccttttcagcttcaattgcatgactgagctgattgtagcaggagacgccaatgattttattctgaccgagatagtgtctagctgccgccacagaagtatcttctccacccacgtgcaaaccttcggcatcgatctccatgactaaatccatatgatcattaataatcagaggaacttgaaactgcttgcagagaagatgaatttctagggcctgcatcaatcgcagccgactgttggcctttttattcctgtactgaagccagcttacgccgccagctaatacgtgataagccatctcacacagccgatcgatattttcaatatcaggcgtgattgcataaaggccgctcaccttaatccgatccataggaggatcaatcatcggagctgccggcttcctcttccaaattatcactttccatccaaaaaaatctgtctggtatatattgtcccattccggggcggaagcctgccttgagcgtatgccaagtaaattcctgcgcctcgtagacgctgtccgtaattgacataccatgagcaagtgaagccgctattgcggatgacaaggtgcaccctgagccatgaaacgatccaggcaaacgctgccatgcatcggaccggacgataccattgacatcgtaaagtacgttaaccacttgcggtgtattttcatgagctcccttgataagcacgtaactgcaaccccattgcaacaattgatctgcactttgcttcaaacccagtatttccggatcatcttcgtgatcaagcgcaatacgcctggcctcaaaactgttaggggtaataattgtcgcctgggaaaataacatctcacgcatggcagaaattacttcttcattggcaaacatgtcgccacgactggaagccagtactggatcaagtaccagtggaatatccggataatccgatataacttcagcaatagctgcgacaatttcaacactgcccagcatcccaatcttgaatgcttgtaccggcatatcttgcaacacggttcttgcctgatcaatgacccattcagcatccatcacaaatatgtcctcgacaccggttgtatcctggacagttacggctgtgagtacagtgagtggatgacagcccattccggcaagagtcagtatatccgcctgaataccggcgcccccgcttgggtcactggcagcgaaggatagtacaattggaggtggtagtgacatgcattaataccgtaaaatgttattttaacttaagcaaatctacttatctattatgactacagaaagtaaccaggattattaccgttatatgtgcatgatttgtggctttatatacgatgaagcagaaggatggccacaagatggtattcctgccggaacccgctgggaagatattcccatgaactggacttgcccggaatgtggtgcacgaaaagaagattttgaaatggtgaaaatataatgcgcattcttcataccatgttgagagtaggtaatctggagcgttcgatccagttttacaccgatgtcctcggaatgcaaattctgcgccgtaaggattacccagaaggaaagttcacattggcattcgtcggttatcaaagtgaagcggaaggtaccgttctggagctgacgcataattgggaaatcgaccattatgatctcggaacaggttttggacacattgcaatcgaagtagacaatgcctacgaagcctgtgaaaaggtcagaaacctgggaggtcgcgtcacgcgagaggctggaccgatgaaacatggaactaccgtgattgctttcatagaagatccggatggttacaagattgaatttattcaaaagaaaacagtgtaactgatgttgccatgaggagcttggctgtagcatagtgctcagccattcaaaacgatacttacagtctatgctgaacataatcctcagtttgctgtctggcaaagagggtacagataaatttcagaaccaccaaagcagcagtaatcgcttaatattagaataatcagttacataaataagtgaataaaatgaacacgataacccatgaagaagcaaatacagttcaacccccgttattttttaccgatagcgctgccagcaaggtaaaagaactgattgaagaagaagcaaaccaggcactcaaactgagagttttcgtcagcggagggggatgctccggatttcaatacggttttacatttgatgaaattatcaatgaagatgactttgtaatagaaaagcaaggagttaggctcctggtggattcaatgagcgttcaatatctgctgggagcggaaatcgattatcaggaaaatgcccagggtgcacaatttgtcatcaagaatccagctgcagccagtacctgtggatgcggctcctcattctcggtctgaaagaattttcaggcaggataaatcgcgcccagtacccgcctaccggttgcgccggtcacggcgggaagatttccaggagtgcgttcaattgattgtcgcgccagccatgcaaatgcacacgcctccacccaatcagcatcgatacctaacacatcggttttcctgatctcgcgatcttgtaattcctgctgtagccgagcaacaagggtctcattatgcgcccctcccccacacaaatagagttcacgggctgttggatagtaagctcgtatcgagtcggcaattgtctgtacagtcagttgcagtaacgtggattgaacatcctgtgcagcttccttacctgtcaaataagacagcaaccaattaagatcgaatgtctccctgcctgtacttttagggggcggcattgagaaatacggaaaactcaacagatctttcagcaggtagtcaatcactttgcctgactttgcccataatccgttttgatcatagcgctcgcctgtatgctgcaagcaccaagcatccatcaacatatttccggggccgcagtcaaaaccacttacgctatttttaacaggcaggctggtaatattggcaattccgccaatattaatgattaggcggtgaacatccgagtgagaaaacatctgctgatgaaatgcaggaaccagtggcgccccctgcccgttggcagcaatatcacgattcctgaaatccgttacaacagtaatatctgtcaactccgccagcagagcgccgttcaccagctggatactatacatatactccgattgtggacaatgtctgatggtttgtccatgacagccgatcgccacaatccctccggaatcaaccttggctttttcaagcaagcacaccaccgcttctgcatataaccttgataatcgattacctgataaagccgcgcgatgtaattcattttcaccgctctgattcaggcctaataattccgcctgaagaaacggatcgtaaggaacataacaggtatcaatgagtgaaaatgacgatccggagaaatttaccagtactgcatcgacaccatccaaactggtacctgacataatgccgatgtaatacatttcacctgactttatagatgactatccaggctgaatcagttcaatgcagcaaagctggtattgcgcagcaaatcaagccgggaagttagttccctggtttgtctgtgaaaagccgaataatattttttactgacgggctgtgctgctggcattacgattttagaagggtcgcgctgaaccccgtttacccgcaactcataatgaaggtgggggccggtcgccatcccggtcgatccaacaaagccaataatatcgccttgtttgacgcgcattcctttctgcaattttctattaaagcccgataaatggccatatgcagagctgtattgagcatcatgcttgagtataatcagattaccatagccactctgcttgcctttaaactcaacagtaccatttgctgtcgccatcacgggtgttccggtcggagcagcatagtcaatccctctgtgggctcgccagcgtttcaagatgggatggtagcgcgcatgagtaaacccagaactgatccgggaaaactttaaaggtgccatcagaaatggtttgctcagactttctccctctggcgtataataaccgccctcctcacccggtggccgaaaatagacagcgcgcctggatttctccttgttgaaaaactctaccgcaagcacacgcccgacttgtgttttcccgctttcatcctgtgcggattcataaacaaccgtaaaacgatcaccctttcggacatcacggtgaaaatcaatactactggaaaatatatcaatcatctgggaggcgattgtgctcggtaagtcagccttgtcaacggctgcaaacaatgatgaactgatcactcccgaacccaccaggacacgcgtatcaccttcagctgactgctcgttcagctcaaatgtcccatcgattttttcgacctgaaactgctcaccatttccgtaaaagtagcgcagtgttaacaattctccgttcggccgggtttccgcatgaatgatttcccccggtttaagctggctcatcgcccgactcccccggacagtatctagaaagcgattcttgtctttttgactgatttcaagacgagcaagaatcgccgaaatggtatctccccgacgtatactttcctgatgccagaaagtcatttcaggatcagaagatgcaaactcttccggcaatggcaaggcacgaactatttttttattgggtatttcctgaaaggaggaatcggggacaattccaaaagcggtaaccatcccgaataacggtaaactggacaagatggtgatccaacgtacctttttttgtgcgaaaacagtgagtttttgcgctagaatgctttttcttttacgaggtgactggtagtaaatcaaatgccatcactcctattcgtctgttggaaatttttcaagtctaacacggaaaagcataaatataatgacgactgattttttactggctggccgtgtctgagtcaattattcatcaacttcaagtaatcaaacggggctgtcaggagctgctgattgaggaagaactcacacaaaaactcaccaaaaatcaacccctaaggatcaaagccggctttgatcctaccgcaccggatctgcacttggggcataccgttctgctgaacaaactgcgccagcttcaggagcttggccaccatatcctgttcctgattggtgactttactggaatgatcggcgaccccagcggcaaaaacgccacgcgcccaccgctgacatgtgagcagattgcacaaaatgcagaaacctacacatctcaggtattcaagatacttaaacctgagcaaacagaggtggttttcaattcaacctggatggataaattcagtgcagctgacctggtcagactggcctccacttataccgtcgcacgcatgcttgaacgggatgatttcagcaagcgctatcacgagaatcggccgatcgccatccatgaatttctttatccgcttgtgcagggttacgattcagtagcgctgaaaaccgatctcgaactaggcggcactgatcaaaaattcaatttgctggtagggcgtgaattacagaagcactacggccaatctccgcagtgcatactgaccatgccacttttggaagggctggatggtatccagaaaatgtcgaaatcgctcaacaactatgtcggtattaatgaatcgcctactgaaatgttcggcaagctgatgtcaatcagcgacaccctgatgtggcgttacatcgaattactgtcttttgaatcactggacaccatacaccagtggcagcttgaagtggaagcaggccgaaatccgcgtgacatcaaggtgcagtttgcacaggaaattgtggcgcgctttcatagccgaacagctgctattcaagctacagaagattttgatgctcgtttcagaaaaggtgccattcctgatgatattccagaaaagaaactgtatgttcaaggcacagagctggctgcacctcaactgctcaagctgactggattaaccgccagtaccagtgaagccctgcgtatgattgaacagggtggcgtaaagctcaatggcaacaaggtcagtgacaaaacccaaactgttcccgtcaatacgacagttattgcccaggtcgggaagaggaaattcgcaaaaataatacttttgcccgatcaagatggcatataaaatctgcttctctgtaaaatcaattccagctatatagcttatatgacaacattgtttatccaccccgaaaaatattaatatgtagacttggttgtaacggtgctactaatttctctactgccatctcaaataattcattaataagtacaaaatgccaactatcgcagatttaaaaaccgataattgaataatgatgaatatcaaggtaaaaataattggtgcaggatcaatcggtaaccatcttacctacggatgtcgtcggcaaggctgggaggtcgtcctgtgtgatacagatccagcagcgttacaacgtacgcgtaatgagatctatccggcccgctatggacaatgggataattcgattcgcctcgcacaccctgatgacacagctggagaacgttttgatgttgtcattatcggcacaccacccgatacacatatcaatatcgcacttgatatcttgcgacaaaacccgcccaggctattgctgattgaaaagccgctatgtcctccttccctgacaggttgtgagcaattgcgcacactggccgagcagactggtgtacagattttggtgggttacaaccatacattgacgcccaataccttgcttgccgaacaatggctgcaagcaggctcgctggggaaaatattaaccattcacgctcagattcgcgaacattggcaaggtattttcaaggcccacccctggatttccggtccggaggatacctatcttggccataccgaacgtggcggaggcgcgctgggcgagcactcccatggactagccatctggcagcactttgcatacctcagcggccatggacgcatcatcgaagtttcagccatgctcgacatggtgaaagagcgcggtgcacactatgatcgactggcgcagctcaatctgcgtactgaaagcggactgaccgggctgctggttcaggatgtgataacagagcccgctgataaacaactgcggctgcagggagaaaatggttatctggactggtacatcaacgtcaaaccaggtgcggatgctgtcagattacgcttacaagacgaaccggagcaatatcaggtttttgaaaaaaccaggccggatgattttcagccggaaatcactcacatcaataccctgctgaccaatccaagccaagtttcaccaatctcactggcacatggtatggaaaccatgttggttattgctgcagcaattcgctcacacgaaacaggtcatgtagtaagaatcgattacgatcaaccatacggctacgatgccctgcaataattttcgcaactgatgtacgcacaaaagaaagtgctggtagttgtaccagcccggggaggcagcaaaggaatacctctgaaaaatttacgggaaattgccggcacctcgcttatcaaacatgtcggacaattggtacgtgagttgagctggattgatcgtgcagttgtctcaaccgatcatgagaacattgcccgggcggctgaaaatgccggactggctgctcctttccagcggcctgatgaactttccggagatcgcatcggagatatcccagtattacagcatgctttatgcgccaccgaaaaaatagatggctgtaagtatgacgttatcgttatgctgcaacctacttcaccattacgccgggcggagcatgtcgcagccactgtcaaaaaacttgttgaagaaaattttgatgcagtctggaccgtcagcccaacggatttgaaataccaccctcttaaacaattggtgctgaatgatcaaggggagctggggttatgggatccgcgcggtaatgacattgttgcccgccagcagcttggcgctgtttatcatcgcaatggtgcggcctatgcactgacgcgctcctgcctgcttgagcaatcttcattactgggcgctcgcagcagtgcagttgtcattgacgagccgatgctgagtattgatactgaatccgatctcgccctggcagaatcattactgcttgcgaaaacaagacaaaactccacacacccggtttcttcacaagaaggtagcagggataaactcaggacatttgtcgtggatatcgatggcgtactggcaacactggtgtccgataatgattattcccggtgccagccaatgcttgaaaatattagcatcatcaataatttacatgcagctggtcataaaatcatcctgtttaccgcacgcggatcagctacgggcatagactggcaggatatcacccgcgatcagatgagaaaatggggcgtgcaacaccacattctgcagtttggtaagcccgcagcagatttttatattgatgaccgtttcatcacactggaagaagcattacgtcattactgacagctgcatacatacacagttattcaatacccggggcagcaggccggagtaaaaaaccggtgcgataacagatattgaatgaagtgaacaggcgaaatagaacaccagctttgttggcctatacacaaaaaataagccaattcacatatttaagctaaataaaaatcaaagataattatggaaacattactggaccgattatatatttttgaaatggccaacaaccaccagggcagcgtggaacatggcttgaaaataattgaaacagtcgctcgaatcgctcgcaaacaccagatcaaagccgcagtcaaactgcaactgcgtgatctggatacctttattcatccggactacaaagggcgcaccgatgtcaaacacatcggtcgctttgaaagcactcgtcttaatatggatgaattccgtcagctggtggatgccattcgtgatcatggactcgtcacggtagccactccatttgatgaacagtccgtacaggcttgccaggcactgaatgttcaagtactgaaacttgccagctgctcagcaaccgactggcccctgatatcagccatgattaacgctaacagaccggtcattgcctcaaccggtggactaggtatttacgatattgataatctggttagccacttgcataagcgcgttccggcgtttgcgctgatgcactgtgtatccctctacccggccccggatgagcgcattcacatgaatttcctcagcaaaatcatgcgtcgctacccttatgttctgacaggatattccgggcatgaagcgcctgataataatgaagtgacaatggcagccattgccaaaggagccagcctgcttgaacgtcatgtgggggtatcaactccggaaatccagctcaacgcctattcgcttgattcgaaacaggccgataactggattgcagcagccgaacggatgcgtgttatttgtggggagagtgaagaaaaacacgtcatacaacatgaaaaggacgcattacgcgagctgcagcgtggtgttttcgtcaaacgcgctgttcgtcaaggcgaaaagatcatgccagaagatgtgtacttcgcaatgccctgctcggaagggcagcttaccagtggtgaatttggccagctacgtgcacaattcatcgcctcacgcgactatgcagctgatactgctgtgtttgaacttcccagacaggatacgatgcatctgatcaggggaattctgcacgatgccaaagggcagctgtatgaatctggaatagcgctgggtgatgactacaccgttgaaatctcacatcattacgggctggaacgattccgcgaaacgggctgtatcctgatcaatctgattaaccgggaatattgctacaaggtactgatcatgctacccgggcagaaacacccgccacatatgcacaaacaaaaagaagaaaccttttgcatgctgtggggagatctgactgtcaatctaccagggcaagaagcagtaaacctgaaaccaggtgataagctactggttccgaggaacaccatgcacgacttcctcacgctctcgggtgccatatttgctgaagtctccacccatagcatcgtgggtgattcctactatgccagtccagaaatcgcggaacttgatccaatgcagcgtaaaactattctggataactggtagggaatattctgtcagcctggcggctcatcatccgggcttgatggagaggcttgaacctcccggattacctcctgaaaatctcctacatcttcaaaacttctatacacagaagcaaagcggatgtaggctaccttatccagcttgtatagctcttgcatgacccattcaccaattgtgcgcgatgaaatttcttgcgccccgcctcccaatagtttctgcagaatacgttctattgcggcatctacctgcccaaccggaaccgggcgcttgtgtaacgcccgggcaaaactagtgtagagcttttcccggttgaactcaacgcgattaccgccctgcttgataatctgcggaaaacgcacctcaactgtttcatacgttgtgaagcgctttccgcaggccgtacattgtcgcctgcgtctgatcctggagccttcttcgctgacacgtgaatcgactacgctggtatcttcagcaccgcagaacgggcatcgcattgctctgtacctccaaaattacaggtaactggagccgaatatccgacacagaaacctggtgcacaagacaaaataatcaatttccatatactggaaattttacacacaaagcttgtgcatctctggcaacctgatccagcaccgcctcattagtcggagcttccaacacatctgccaccagatttgcaagctgctcggattcaagttccttaaatccgcgtgtggtaatcgccggcgtaccaattcggacaccgctggttacaaacggtttttgcggatcatttggaattgcatttttattgacggtgatgtgcgcagtttccaatgcagtctccgcctcccttccagtcagatttttggcgcgtaaatccaccagaaacatatgacaatcagtatggccggatacaatccgcaagccgcgctgttgtaatacccttgccatgacacgcgcgttctcgattacctgcttctgataatccttgaatgccgggctggctgcctccttgaaagccacagccttggccgcgatcacatgcatcagtgggccaccctgtgtctgcgggaaaactgctgagttgagtgctttttcatgctcaggcttagccatgatcacgccaccacgcgggccacgtagtgttttgtgcgtggtactggtaacaaaatcggcgatccccactggattgggataataaccggcagcaatcagccctgcataatgagccatgtccacaaacagataggcacctacgttgtcggcaattttgcggaaagcttgccagtcaattactcgtgcgtaggaagatgcgccagcaacaatcatgcgaggtttatgctcatgcgcaagccgctccagctctgtgtaatcaatctcttcagttttaggatccagaccgtaagcaattgaattgaatattttgccgctcatattgactggtgcgccgtgcgtcaaatggccaccatgcgccagtgacatccccagaagtgtatcgcccggcttcagcgcggacaaataaaccgcagcatttgcctgggaaccggaatgcggctgcacgttaacgtactcggcattaaacagcgcccgcaggcgatcaatggcaagctgttcgacgatatctacatgcttgcatcctccgtaataccgcttgcccggatatccttcggcatacttgttggtcagcacagtgccctgtgcctgcaaaacagccgggctggcataattttccgaggcaatcagctcgatatgatcttcctgccgctgtacctccccctggatcgctcgccataaatccggatcaacctgctcaatcgtcatactctttgaaaacatagtatttactctctgatttttattggaaaatgattattctatcatcgcgtcgcggcgcaaacttcgtaattctattactacgccacgcgtacaaaaacgacacaattctctagcataaaattgacttcatttactgaattggcgatgattagcggtgcatcacatttcattccactctgaacaggagcttttcatggctataaacatattcaaacaacaagttgattccattattcaaagcaagcatctgttgcaacatccgttctacatcgcctggaccgaaggcaaactgacccgcgagcagctgcgccactacgctgagcaatatttttataatgtattggctgaacccacctacctcagcgcagttcacttcaacaccccacattttcacaacgaagaaaactgtggtgatatcagcgtgcgtcaagaggtcctcaaaaacctgatcgatgaagaacacggagaaaaaaatcaccctgccctgtggaaagcatttgcctttgcattaggcgcgaatgatgccagcctggcaaaagccgatgcattgccggaaacagaaaatctggtttcaacctttcgcgacatctgcataaacgaatctttttatgcaggattggccgcattacatgcatttgaatcccaggtacctgatattgctgctgtcaagatcgacggcctggccaaattctatggcatgaaaaatccggaggattatgagttcttctcagtacaccagacagctgatattttccattcacaagcagaatgggcaatcattgaaagatttgctgataccccggaaaaacaggccgaagtactggccgccacacgccgcgcttgtgatgctctatggaaattcctggatggtattcacgaaaattactgtgccaatctcatctgcgaggaaaaaacagcagttacgttgcattaatcccatattggcctgattacaacaatttacgccgggcaatcatcctcagtttagggggggattgcccgatttcttgagtcccttatttttcccgctttgctctcagtttttcctcgttccttttttgcccaatggcttaattccatccagtctggcaaaacaaacctggtcaatcgtttccagaaaatcccgcaaataacgcagcgaagcatcttgctcccgcactgaaagatatagatcgctccacagcccactcgtaccgatacgccgggcaatcacatactcgtaatccagataatttttgattccccatcccggcagtgcagcaatcccccgccggcttgccaccagctgcaaaatagccacggttaattcggttgttcggcgctgccagctgacacccgcaggcatcagcacttgccggatcaaatctatccgctcttccggaaccggataagtaatcagtacgtcctgcgcaaaatcagcagcttcaagtactcgtttgctcccgagtacatgccccggggccagcacagccaggatttcaaaacggaataatggaaaatgaatgatcccctgctgtggcttgttctctgaaccgatcaccacgtcagcaacctgctgtcgaagcaacgacaccggatcactatgaaaaccagaaaccagatcaagctccacttccggccagtgttgacgaaaatcatccatgatcggcatcagccaatcgaaacaggtatgacactccagaacaatccgcaaactccctgccgcctgctgcgatatttttgccagatcccgctctgctgactgaacctcgccaagtatcttccccgccagttgcactagacgcttacctgcatcggtcaactgtactgcatggccactgcgctgaataatcggcaactggtagtgctcttgcagcgccttgatctggtgcgataccgcagattgagtcaaatgcacacgctgcgctgccagtgaaatactgccagtctcatccaaggcattcaatgtgcgaagatgtcgtaattcaagcatatatgaaaattattcatagttatatgtaaaacatttcatttgattcattatagagtattccacacaatgatggtttttcgattatgcagagaaaatataatgaaaatactgacacataatctcggcttcccgagaatcggcgcacaacgtgaattaaaaaaagcactcgaagctcactggaaaggacaaagtgaggctgcgcaattattggctactgcgcgcgaaattcgcgccagcaactggctatcgcagcaaaaatctggcattgatttgatcccggtgggagatttctcactgtatgatcacatactcgacatgaccgcattactgggagcaattccccatcgcttcgagcacaccggcgatcaggttccgcttgatctgtactttgccatggcacgtggcactgttgatcaaccagctatggaaatgaccaagtggttcaataccaattaccactacatcgttcctgaattcgatcacaacacccgatttcatctggcatccgactggctgttccaggaaattaaagaagccaaagtgctggggataaatacaaaagttgttttgatcggcccgctgacctacctgtatcttggtaaagaaattacgccagattttcagcgattggatctgcttcccagcctgctgccggtttatcgcgaaattctgcagcaaattgttgcactgggtgtggaatgggtgcagattgacgaacctatcctcgctcttgatctcgagcagccctggctagatggttttatagaggcctatcgtgcactaaatgatacgggcagccgcttgctgctcacctcttactttggggcggttgatcaccacctcgcattgcttgagaacttgccggtagatggcctgcatattgacctcagcagtgctccggaacaactcgaatcattcctaaccagaaatttctccagcaaaatcctgtcactgggttgtatcgacggacgcaatatctggcgcactgatctatcacaaaaactggaaaacttagcacaaactgcatctcgatttaagggcaatctatggattgccccgagttgttccttgctacattgtccggtagatttatcattagaaactaaactggatccagaaattagaaactggctagccttttctactcagaaactggaagaaatcgccacactcgggctcgggctgaaccagggcaaggaatcaatccaagagatactgactgcttccaatcaagccaaccaatcaagaaagacatcttgtcgcatccataacccggtggttcatcacagaatcaaccatctgactgaacgagacagccagcgcacgcatccttttgcaattcgtaaaaaacagcaacagcagcgcttcaatctgcctctgttgcctaccaccaccatcggctctttcccgcaaacttccgccattcgccaggtacgcgccgcattcaaaaaaaatgaactaagtcatcttgaatacctgtctgccatgcgtcaagaaatttgcgagactatccgcaaacaggaagaaatcggactggatgtgctggttcatggcgaacccgaacgtaatgatatggtggaatatttcggcgaacagctgtggggatatgctttcactgaaaacggctgggtgcaaagctacggctcccgttgcgtcaaaccacccattttatatggtgatgtctatcgccctgaggccatgacagtcgattggatcagctatgcccaaagccagaccaacagaccagtcaaaggcatgttgaccgggccagtcactatgctgttctggtcattcgtgcgagatgatcagccacgggcagataccgctttacaactggcactggcaattcgtgatgaagtcactgatctggaaaaagccggtatcggcatgattcagattgatgagccggcctttcgcgaaggactcccgctcagaagacaggactggcagcattaccttgactgggcggtcaaggcgtttcgcgttgccagctcgggggtaaaggatgaaactcagatccacacccacatgtgttattccgaatttcatgacatcctgcccgccatcgccgaactagatgcagatgtcatcacaattgagacttcacgttcgcgtatggaattgctggatgcattcgtaaaattttcctacccgaatgaaatcggccctggagtatatgacattcactctccccgtgttcctgatacatcggaaatgctggagctgctgaaaaaggcatcacaccatattgatccaaagctactctgggtcaacccggattgcggcctgaaaacgcgcaactggccggaaacccggacagctctgcaaaaaatggtggattgtgcaaaatccctgcgcagcgccctgcagacctgatctattgtctatcctccgcgcagttgccgggcataatccaggctgtcacccccctcttctgacagcttcgtccgtgtaactgccacctcacccacagtagaactgattggataaagttgcgagcaatgtccaatacagaggtcagtttgcatggcaatctttctgtgatgctctaatttatgcgtttgatgtgtgcacccacttgcgccagtttttgttcgatttgttcatagccacgatccagatgatagatccggtcaacgatggtttcgccttgcgcaatcaatccggcgatgatgaggcaggcggaggcgcgcagatcggttgccatcacactggcaccatcaagttggggaatgccatgcacgatcgcagtattaccctcaacctgaatatctgcgttcaggcgtgtgagctcctgtacatgcatgaagcgattttcaaaaattgtttctgtcatgatggaggtgccgccggcaatgctgtttaacgccatgaattgtgcttgcatgtcggtaggaaaggccggatagggcgcagtgcgcagactgaccggttgcggccgctgctgcatgcacaatcggatccaatcctcgcctatatcaatgtctgctccagcttcggccagcttgcccagtacaacgtcaagtgtatctgcgcgtgtcccgatcagggtgacgtcaccaccacaggcagcgactgcggtcaagaatgtcccggtttcaatgcgatcaggcatgacgatgtgtgaaccaccatgcaagcgatctaccccttcgataataataatgtcactgcctgctccttctatttttgctcccataccgatgagacaatttgccagatcaatcacttcaggttcacgggcggcattttccagaatggtcgtgccggaagcaagtgtggcggccatcatcaggttttcggtcccggtaacggtgacaacgtccatggcgatacgtgcacctgaaaggcggcctacctgagcaaggatataaccctgctcaatattgatttccgcccccatggcttgcagtcccttgatatgctgatcgaccggccgcatgccgattgcgcaaccacccggcaaggaaatatgtgcctgtccggttcgcgccagtaatggacccaatacgaggatggcggcacgcatggttttcaccatgtcgtaggaagcggttggattggtaatattggccgcagacagttctgtagtgcctggttcatttgttagaatgcgcacaccaatctgttcaagcaatgccagcatagtagtgacatccctgagatgcgggatattctgtatggcaaatggttcagcagtcagtagcgatgcgcataatacgggcaaagctgcgtttttggcaccggaaatactgatttcaccatggagcttcgaccccccgtgaatgacaagtttctgcatgaatctactcttaacaagaattaaaatattgttgcacccacatgggcgtaatcctttgcattttatcgtactaactgaggagtcagaatgagcaaatttgttgtccagaccaatgatgccccacaagcaatcggcacctattcccaggctgtctgcgtaacaggtggggaaactgtctatctttccggtcagatcgggcttgatccagccagcatggaaatggtacagggtattgatgcacagattgaacaagttattactaatctcaaggcggtcattgttgccagtggcggcagcctgagtgatgtcgtcaaactgaatgtttatctgactgatctgggcaacttttccagagttaatgaagtcatgggcaagcatttcaaccaaccttatcccgcacgcgccgccatcggcgtggcagcattgccgcgcggggcactggtggaaatggatgccgtggcggtactggataagtaaccctacgtactattcacatcattttctccattggctgcccaatctttcagctcactggataaggcattacgcaaaaaacttgaaaagctcggcctattcagtgatttcgatctggttctgcacttgccgctgcgctatgaggatgagacacagttgtcatccatcagtaaagcggctcccggaaatacaatacaaatagaaggggtgattaccgaacaggaagtgctgattagtccgcgacggcagctcgtttgcagggtaagtgacgatagcggtgtgctttatctgcgtttcttaaatttttatgctagccagataaccgcctggtcaccaggtactcggctgcgtgtactgggtgaagtgcgtgccggtttttatggaatggagatggtgcacccaaaatgccgggtggtgcgtgacaacatggcactggcaactgccttgacaccggtttatccggtaacagccggattgccacaacgcacacttatacggctgatcacacaagcttttgagcggttgcgaagaaagcagtttctgcgtgaaattttgccggaaacgatcctgtctgcctgtccactccctgcatttgaggaaagcttatctttgctgcattgtccgccatctgatatttccatggaatcattacagcaacgttcccatccagcctggcagcggatcaagtttgacgaattactggcgcagcaaatttctctacgttgtcattatcaccagcggcgcaatcagcaggcgcctactctgtcgcaacaggttaatttgcagcaggcattgctgggagtactgccattcagcctgactgaggcgcaacataaagtagtggctgaaatcagcacagatcttgcgcagccttaccctatgcagcggttgttacaaggtgatgtaggcagcggcaaaactgtggtggcggcactggctgcattgcaggcgattggaaatggctatcaggttgctgtcatggcaccgacagagattctggctgagcagcatttcaggaagttgtccggctggctggtgccgctcggaatagaagtaggctggttatccggcagtcagaaaaaaagcctgcgcagccaagagctggcaaaaacggcaagtggtgcaaccatgctgattattggaacccatgcactgtttcaggaggcagttcaattcaaacagcttgggttggtcattattgacgaacagcatcgattcggggtggggcaacggcttgccttgcgcatgaaaagggaagatgaaggctcactaccgcaccagttgatgatgagcgccaccccaattccccgtacactttcaatgagctacttcgccgatttggatgtttctgttatcaatcaattacctcccggcagattgccagttgcgaccaggttgattgacaacaatcggcgcgaggaaattattgcacgcatccgtgaagcctgtctggctggccgccaggcttactgggtttgcccattgatcgaggaatccgaggtattacagttaaaaacagcagtggaaacctatgaaacattgagccagattttccctgaactaagcatagccctcattcatggccggctgggtagcgacgaaaaatctgcgattatggcgaaattcagccagggagcagtacagttactggttgccaccaccgtgattgaagtgggtgtggatgtgcccaacgcctcactaatggtgattgaacatgctgaacgcatgggattgtctcaattgcatcagttgcgcgggcggatcggtcgtggatcagctactggtatttgtatcctgatgtatcagcggccattatccgtagtggcgcgtaaacgattgcagattattttcgagcataacgatggatttgaaatcgcgcggcaggatctgctgttgcgcgggccaggtgaatttctcggtacccgtcagagtggcgtacccctgctacgatttgctgatctggaagaagatatcgatttgctggaaatggcgcgcaatgttgcggaggagatactgcgtgattatccgaatgaggcacagcatcacgtgcagcgttggctgggaaatagagaagattatctacgcgcgtagtactagttatattctgccaggccgcgatgacgtaccaggacgcgtgcagcgtcacggaagtgtaacgcgagcttttctgcaaaataaactgaacggtgctgccccccggtacaaccgatagcgactgtgaggtaggcccgattatcctgcatgtaaacaggcagccaggtatctaggaaactactaatatccccgagcatttttgaagcgttgggctgggcttccataaaccggatgacttccagatcatggccagtcaactctttaagatgcggatcgtaaaaggggttgggcaggcagcgtatatcaaacaccagatcggcatctagcggaataccatgtttatagccaaatgactggaacattagcgttagctgggatggatcgcggctatccgagatgaaatccctgataaaagcccgcagcgcattaggtcttaacgagctggtatcaatatggtggccaagatctgatacggtcgccaacacctcacgctcgtgctggatggcttcctctaatgtgatatttttgtcactcaaaggatgtctgcggcgtgtttcagagaagcgctgtatcagcgtatctgtgcgtgtatccagaaaaataaattccgtccgaatgcttttatcgatcattttgaactgccagggtagaacagtaatactatcgccgctgcgcatatcaattgccacggcaacatgtgaatgatgctgcgtttgcaggtgattgatgaggataacgagtagcgatgcaggaaggttatcaacgcagtaatagcctgaatcttccaaggccttaagtgcaattgactttcccgaaccggacaatccactgataatgatgacttgcatggccttgagtataacaggcagattaatttgaaagtgtctgcaaaagcagtatttgtttatacaaaatgatggggaaattgaatagtgaataaggcttttactaaagagagtgaccatgaggaagagctggatgacaccccgcaactaccacagggtgtaaagaattatattaccccagaaggctatcagcgattgaaggatgaatttgatcagttatggaaagtggagcgcccggagctggtcaagattgtatcctgggcagcatcaaacggtgatcgctcagaaaatggtgattatatttatggcaagcggcgcttgcgtgaaattgatcgccgtttgcggtttttatccaggcgcatggaccatgccgaaatcatcgacccggcacaacgcggcgagtgcgatcaggtattttttggtgcgacagtaacggtatacgacgcacaaggcaatgagcagacatacagtattgtcggtatggatgaagcggagcccagctttggccgtatcagctggatttcaccgctggccagagcactactgaaagcacgagagggggatgtggtgtctttgcaaacaccaggtggcctggaagaactggaagtaattaaaatccgttataaaattattacttgattagcaacgagtgtcagcaaggtttgtctgacgagttcgttgctaatcaagtaagtttataatttagtcattgccagctgcctgaagagtcaacaatgctattggcaaatgtctaaatacttctgatatcggtaaataagggacatcatcgagcatacttaacctgatgatcgtttccgaaaatatgtctcggaaagctgcgtctttgaggctatgcggaagctcgatacgcgtatcttgccacatgaaggcatgagtatctggattctgttccaaacgtgcaaaccatcgacctgtgatagctagaatgaagctattaccatctcgccgctgaaaagcacaaatgtgctctgctttctcaccaatggctttgagtggcaagtaatctccccgccaaaataattcaggacatgtttttctgaacgctagagttttccatatcacgaacaacttgacgcgaccgtcatctatgtgtttgaggagattttctagtaaatgtacgcggtcagaggcttcgtcggtgttttgcaggctgtttaaatgctgctggcggatatcaaaatcgacagttcggcgattgtcggggtcgactaaggtgtaacgccataattcggtaccctgataaaggtccggaacccccggcgatgttaaaagcaaaagagtctgggataggctgttgtaaaacccgatgcgggtaacgcggtattccaatgcgaggaaatcgtcgtgaaaggtgctgcttttcttggggtttagtacagcttgtacaaatccgctaacgacttgttcgtagtctaggttagggttgatccatgacgtgtgaatctttgcttctctagccgctttaagcatatatgcttcgatacgtgtcgtaaatgattggatcgatttactatcgcgatgttccaccggccaggcgcctaacaaagtttgataaagcagatattcggcattgtgcgaaggcgctaattggccgtccacgcgccgtttcttgctgcggttaagtcggcgccagcgggaggccgcttgctgccagtcctgcgccagttcgctgagcacattaatgcgagcacgaacgtcgccgctgcgcttactatcgtgagtcgtaagtgtgattaggctggctggccattgcctcaaccgctgttgattggcatgatgaaaagcggcgacagaagtcccgaagtggcgaggatcaccgccgacatcgttaagcgatagcagccggttatagacataaaagctggtgtcctccatgcttttggccatcaccggtgccgtatattgctggaatttcattacaaagagcttgagctggacgtcatactcagcactgcggccttcgagattttgtagcaaaagtacatcgcgaatgaagtcgaagatggtgatatccgcggtagggctacgttttttagcttgattaatggcccattcgacgaagcggcggtcttcatcagcgatatcgtctgccataatgtaggtacggtaaaccggaaagcagacgacgacctcggtcaaggcctcgcgcagaccgttcaaggtatagtctcgggtggtgcgttcggattcggcaattgttccgagcagattgactaacatcgttaaatggctcgacatctggttacgaattacttggcgcttgcaatcgtaaagtacttcgtcgaacgtcagctgttgacctatgaagtgagcataaatatgacttaactctctttccgaggggatatggacaaagaggccgttgactaaattggcaaactcatagcctgtggtgccagcaatcggccagtcatcgcgtagatgttcatattcggctagaattttctcgaccagcaaatacagtacctgcttgggaaaggtatcgccccgatccggtgtttgattggtgatacagctaaattcttcttgcaagcactggcaatagctgcgtggattccacagcccatcaatatggtctatacgtataccatcgatgctgccatcggccaccagtgccaatatcagcctatggctggcctcgaagacctctggattctgctggcgcaggcaaactaaatggttgatgtcgaagaagcgtcgatagttgatttcatctgaggctacccgccaataagtgagcctgaatgcttgcaactcaagcaaacgatgcaggttgtcgaagctctttgcttgcccgggtttaccgttgaaaatagtcagtaatttgctcaagtgcacgcgaatgttgggcgactgctgataaagtgacgcaaactgttgtttgcaggccgcagcagaatgcgatctttcgatcggcaccgttcttagttggcgtagtcgctcaaaatcgcttatcagactatgccactcgatcaaggtatgattttcctgactcaccaacgcagcaaagcgctccatttcatgcaccagtatcgccggataagtttctggatccaatggcagccgctgttccaagaaacgaacgctaaactcgccgcgtttctgatcgaactccaactcgagttttcctgcctccaatactttaccgtaatggtcatccaacaccggtaacagtactttaccgcgcaggctttccctaatcggatgccagtcgatgtcaaaatagcttgcgtaggacgatgcttggccgttttccagtacatccatccaccaagcattctcgccataaccgatgcccatgtgattaggcgcgaagtccaggaggaggcccatgtcgcgagcatgcaaggtatcgaccaaatcggaaaaagcctctccgcccccgagttccggatttagtctgccatgatcgacgatatcgtaaccatgggaactacccgtacggggtgtgaggcagggtgagagatataggtgactgataccaacgtatgcagataaggcacaatgttgcgtgcatcgacaaaagtaaaatccggattaagttgtagacgatagacagcgcgcggtaaggccttattatccacggcagcttgcttcctggaatgaccagatcaccgaccaaccaggtagtgtgtctgattggatgtttgaagtagttggcgtggcgaataacaggcgccctggtggtttatcaagtgcttgtaccggatttggtcctaaattagctaccaaatgcaaataagagccgtcgcccaggagccagtaaacgattagtgcggtcttacctatcacttgaaaagacgagtttccaccctgagtgttcactaggcgaggaacaatttctcggcgacgcaaagttaataagttgcggtgaaaatccaaccattgccgtccgtgttcggtacttaccgtctcccaatccagtaaggactgttgaaaggtagtttctgctacagggtcaggcatttggtttctagccttggtatcagctaattccaggcgacgaccttctgtcacctgttgcgccagttcagcttcgaaatcacaaaaaaaagtgaacggttgccggctaccccactcttggcccatgaagagcaagggtggagagggtgccagtaacaacaaggccgtcgtggcccggatagcttgcgtgggtgcaagcgtggtaatgcgttcaccgcaggcgcgattaccgatttgatcgtgattctgtagaaagcttacgaatgccattggcggcagatgagcgcaggcctctcctctgtgtttgccatgacgataaacagacgattcaccttgataggagaagccttcggacaaacaacgacccagatgataaagcggctgtgcggcgtaatcgccgtagtagctctgagtctcgccagtcaacaaaacatgtatagcatggtgtatgtcgtcgttccattgtgcgacgtagtaattgggattgccggcgccgtctcgctgcaaataacgggcggcgttgtggtcgttttccaggatcagatgcacgtggcgagaaaataaactttgcaccgtttcggccagttcttccagaatatccggatgcgtgctgtcaaaaatgctatggactgcgtccaagcgcagaccatctacatgaaattcctccagccagtacaaggcattatgaatgaaaaactgccggacccagtaactattttggccgtcgaagttgatagccgcaccccaaggggtttggtgctgtgtcgtaaagaaagctgacgcgtaaaggtgtagataattaccttccggcccgaagtggttatagactacatcgacaaacaccatcatgccgatgccgtgcgctgcttggattagctccttgagatcatccggcgagccataactactttccggcgcaaacagcaaaactccgtcgtaaccccagtcgcgctttcccggaaattcggcaatcggcatgatttggatcgcggttatacctagtaagcgtagatagtcaagtttgcgacttgcggccttgaacgtgccttccggtgtaaaggtgccgacatgtaattcataaattacagcctcctcccatggtcgccccgtccagtcatgatccgaccatacccaattttcggcatcgacgattatgctatggccatgtacgtcttcggcttgggagcgcgaagccggatctggaacgcaacgagcaccatcaatgcggtaatgataacgactgccagctggtgccaaaacgctgatcaactcaaaccagccctccgcttgtgcctccatgtctagcgacaattccctgtcgccatctaacaggcagagctctacgcgtttaacacttggtgcccagagccgaaaccgcatgagtccgttgtgttgcgttttgacaccgaacggcattgtgtgccgcctgcgcatgcctgtgttagtactaaccatctgtctgtggtcgccgcaagagatcaaaacaactcaatccgatccagcccttgattttgcagaattagcatcaaggtcagatgctcacgcagctgacgggtaatcaaaaaattttcatgcacaaattgcctggctttgtctcccattttcagcagttgttccggttggtgcaggagatagcgggcacgtaaggcggcgccttccggggtgctaaccagaaaaccagtatggaagttgacgacttgcaggcggatgccaccgacatcaccgcctatcaccgccttgcctttccacagggcttcggtgacggtcaagccaaaaccttctttcaaggatttttgtagtacgatgctggcggcacgctgtagtgcattgatagtgcgatgcgcatcaggagctagtaacaagatatgaatatcgtgatcttcggctgccgcgacacgtacttcgtgcaatactgcttctccttccgggtcatcggtggcaccgccccccgctaaaaccagctggacgctaggtgtttagtcccacggtgtactggaatggatcaaagataaaacgatctggctcatttgtccagactaccggcctaaatcccggattgcggctaactcccgaagcagaagccatgctgcgttccgatgcaatggataaaatttttttcgctatccatggcgccgatcaacaactgctggccggtgacgccgacctaccgatctaccccggatcgttgcacgaacgaccgacatttgtcgatgatatctaccgggatgaagaaattcgtgccaccacgcatcgaattgttatcaatggtgatgaaatcaccatcacggtagctgaaaccatgcgggaacggaaccacgccagccaccgtatactcgccgcaattgctttccccaatctgatgattattgtcgcaacattactggtaatctactttggtgtccggcgtggtctggcaccactgtacacatttaaaaccagattgccagccgctcaccacgcgatttgcgtgcactcgatattgagcatgctccgcgcgaaatccgcccaatgcttacccggctcaatgagctgtttgaatcactgcgcctggctgccgcagcccagcaacgttttttggctgatgcagcacaccagttgcgcacgccgttagctggtttgcaaacccagatcgaactggtggctaccgaaggaaaatatctccgcaacgaagagcgactggcgcgtattgaagaatcagtcgaacgtatcgcgcatctggttacacagctgttgatttatgcgcaaaccgagtcggcagcttctgccaatcaagtctttcaaccagtggcgctgcatgagctggctgaaagctcagcatcaatctttattgatcgcgcccttctcaaggatattgatctcggttttgaaattgagccggcagttaccgagggtatcgcctggatgttgcgcgaggctctgggaaatttaattgataacgcgctgcgctactgtccctccggtagcacgattaccgtccgcagcggcattcgtttcggtcggccctacctggcggtggaggataacggccccggtatttcagttgcagagcgcgacaaagtatttgaacgcttttatcgtattcccggatcggccagtggtggttgtgggctgggcttatctatcgtccaggaaattgcacaactgcataccgcaaccatcaatttctctgaaccggctggtggcggcctgacagttacactgacctttcctgcaagcaatatgaaaaacgagtaatgtaaaaaaagaaagcctgccattttacagaaaacaatgtaaaaggcaggccaaagtagaggaggaagcaacttgtaccagtagaacacacagcttattcagggaagaatctgaaagaaaaaattcgtatttttccttcaaatttatattcatatcgcataaatataaacctggacactaggtgttacggataatgaagttgattatgcccttaaaaataaagattgagaatgtgacatattgccgcaggctgaattgataggagcttcgctatgacaggagacactgcagaaggaaatacaccagaatacttgccagggaaaactgccatatcccggatggacatatggtattttgtgataaacatgagggagcactttttgtgtaatcctctccgagtgtgctcttgcacccgagtgacagccgtctccgcatgacatattgatgccccgccgtggtaagatacttggcctgtaacaatgaaatatacgcgcccatgaccacatccgaggaagttgtccaatatttgcaggatcatccacagttttttgaggagaatcctgatttgatggaatctctccatttcccgcacccatacgaaggtcgcgccatttcaattaatgagcggcaggtggcgatgttacgcgagaaaaacaggcttttgcagaacaggctgcaagaactggtagatgtcggtgaaaaaaatgatgtcatcggtgagaaaatgcatcgcctgacagttgcgttgctgggtttcgattcattacccgaaatgctgcacggactacagtaccatttgtgcgaagatttctctattccgcacgttgcgttacgcttatggcaaatcgatgaactgggcactcaggcagaccttccttctcctgaattcaataaaaccagcagcaacatccatattctcgcacaaggtatgccacacccttattgcgggccagagatagatgatgaaatccggcaatggtttgagatggatgcagaatatctacaatcctttgctcttatcccattaaagaagcaatccggtttcggcttgctggtgatggccagcccggaagtagaacgtttttttcccgacatgggcacactttatctggaacgcctgggagatatggtcagcagttccattacgcgactgatacagcaggctcctggagccaccacgtgtgaatccacttcatgacgagcaggatcttcctgccttaccatcgctgcttggcgaatatctgacttatctgtccagcacgcgtagcctttctgttcaaacacagcatcattaccggcgcgacctgatagcattggtacgctgtactgtcgctcaacacgaaaacggaaacaacaagatttctgatatttcgctgacccggttgcattcgcatgatatccgccatttcatcgcacgcttacatagtagcggcctttccggcagaagcctggcacgtatgctgtccgcttggcgcggattttatcgttatctgatccgtcatcatcaccataccgggaacccctgcctggatgtgcgtgtgccaaaatctccacataaactgccgcatgcgctttcgccagatgaaaccgcacaactgctgacattcaacctttcttctaatgatgtgctggcaacacgcgatctcgccatattcgagctgttctattcatctgggttacgtctgactgagctaacacagctccaaccaactgatattgatttcactgggggcacagtgcgcgttacgggtaaaggcaataaaacccgtatcgtgccagttggcgagctggcgctacgcgcactgcaggcctggctaccgctgcgcagtgcgtggctgataccgggtgagacggcactatttttatcacagcgcgggcgtcgcatccacccgcgcacaattgcctaccgtctgcatcagcgtgcccaattgcaaaaccttgatagccgggtacatccgcacacactgcgccattcatttgcttctcatttgttgcaatccagcggcgatctgcgtgcagttcaggaaatgctcgggcatagcagtatccgcagtacgcaggtctacactcacctggattttcagcatttagcaaaaatctacgaccaggcacatccgcgcgccagaaaaaaaccaaaaacagattagatcttgcaggatacttgaggatatgggagaaccggatacagaagaatcaggagttattcccgagagctgaccagtttcttcgggtgacacgtgcttctgaaaacagtttttctagcgcttcactgtcatgatcggtcagtatttgccgcagtttagatagctccaattgataggcttcaatttgtgcaagtaatgctatacggttatcgaggcagatatcccgccacatttccggggaactggcagcaatgcgagtcataccgttcaggctgctgcctgcgagacgtaaaagctctagtggatttccctcactcaaggtaagactctgggtctggatatgctgcatcaacgaaaatgccagcatgtgcggaagatggctgatagcagcaagtatctggtcatgctgttctggttgcatagatgaaacccgggccccacagtaccgccagagggcggtaacgtaatcaatagcctgttgatcgttctcctgtaatggcgtcagaatcacgggtttattctgaaaaagatcaggggaagcagctaccgcaccactgagttcggttccggcaatcgggtgggcaggaataaaatagctgatatgtttacccaagtacgcgcgagcagcatcaaccacactctgcttggtactgccaacatcggagacgatagtgcgagcttctaaataaggcgctatctgctgcaaaatacgagcagcctgttttacaggaactgcgagtaatacaaaatctgcaccagatagtgcggcagcaaaatcgccgatttgttcgtcaatgatgcccagctcaagggcgcactgcatgttttcagggctgcgcccgattccggtgatatgtttaaccaggccggcccgacgcaacgcttgcgcaaatgaaccaccaattaatcccacaccgataataaccagttttgaaatgctggatgaagccatgatcggtgtgtatgggttggtgggtgattagtcggattctttcaacgcttgttccagcgcatataggaatctcttattttcttcctcaatcccgatagtcacccgcaaatgattgggcatgccgtaattacccaatggacgcacaatgaccccttgctgcaacagacttttgtaaattttcagggtatcggcctgatgaccgtcaatctggatactgacaaaattaccaaaagaagggataaagccgacacccagccgatccaaaccagcgatcatccgctgcataccggtccggtttgtcatgtaggaaagtttgacaaattcaacatcgtcgagggctgcctgagcagccgccaaaccaatgctgttgacattgaaaggctgtcggatacggttcatcagattggcaatatcagcatgcgccagtgcaaaaccaacacgtacgctggccagaccataagccttggagaaagtatgcgtgataaccagattctggaaatttttcaaccatgcgacactgttggtcttgttcgcttctggcagatattcatcataagcttgatccagaataacaagtacatccggcgaaacacgttctataaaacgcaatagatctctggcatcgcacaaggtgccggtcggattattaggattcgcaataaatatgatgcgtgtttctggtgtaatagcatccagcatggcttccaggtcgtgcccataatttctggcaggaacagtaatgcctctggcacctgctgcctgaaccaagagcggatatatggcaaaagcatactgggaataaattgcacttgtaccgggccgcagaaagatgcgggaagcaagctcaagtacatcattggagccgttgcccagcacgatttgctcggcagatacacccagacgatcagataaagccacttttagttcaaaaccactcccatctggataccgtgcagactcactaagcgcctgaatcatcgcttctcttgccaacgggctggttcccaatggattctcgttggaagccagtttaatgacttcatttttatccagaccgaggtctcggaccagttccgatatcggtttacccggctgatagggttggattgcccggatatattccggtgccagttcaaaaaggttcataacattcaggaattaattaatttacgctgcagggtaagagccgaaaaccttcagaaaggttgcattgtcgcgcagcatctgaagtgccctggctacgttttcatcttcctgatgcccttcaatatccgtaaagaaaacatattcccacagactggcgcgtgaaggacgcgattccaggcgcgtcatactgacacaatgttgtgcaaagggcgccagaagctcatggactgaaccaggtcgattatgcgtggccatggccagtgaggttttatcttttccggagggcgccacttcctgcatacctaccaccagaaatcgtgtcgtgttattcgggttatcctcgatattggtggcacagatcttcagtccgaatacttcagcagctttcttcccggcgatcgcagcggcgctgctatctgctgcaacctgacgggcagcatctgcattgctggcagcattgatacgatcagcggcagtcagattttcattgagccatgcctgacattgtgcaaatgattgcggatgtgaataaactcttcgaatagaagccagatcggcgtgctgtgccatcagacactgatggatgggcagctgaagttcgccacatatcttcaagggcgtcagtaacaacaagtccattgttctgccgactgccccctcagtcgaattttcgactggtacaacaccataattagctgcaccggattcaaccttgcgaaaaatatcgtcaattgaactgcagggtattgaggtaaccgcgctaccaaaacgtttggtcactgcttcttccgagaatgtaccctgtggcccaagataagcaacaactaaaggctcttccagtgcacggcagattgatatgacttcggtaaacaaatgcacgatatgctcatctcgtaatggccccgaatttgcttgctgcaaacgagaaaagatttgtgactcacgctcagggcgataagccgtgccggatttctgtcgaccaatctgttgcgcaagccgtgcacgggtattaatcaatcggagcaattcatcatcgattgcatcgatttcattgcgcagttgtgtaagctgttccgtcatcaatagggatttaataagattgcggctggattttctgctttacactcgttcaggctcggaaggtactgaaacaggcagataacgaaccattaacacacccgtaatctgggcaattgcactaatgatttccggcggaacagccctgtcagtatcgaccagtgtataagccatttccccacgggatttattgatcatattatgaatatttaggccgatatccgccatgcgggttgatatttgccccagcagattagggacattggcattagccacggcaacccggaacggagttccacgctccatgacaacatccggaaaattgacggtataactgatattaccgtgagctatataatccatgatctggtcagcaatcatcatggcgcaattttcctccgcttcatgcgtagaggcgcccaggtgaggtaaggtgataactgccggttgctgcttcaatttctgatcaggaaaatcacaaacataatttttgataattccactcttgatgccagccagtacagcatcttcatcaacgatggcattacgcgaaaaattaagcagaattgtatttttctgcatatgagatatcagtgggccgttgatcagatgccgagtagattcattaagcggcacatgtaatgaaataaaattgctgcggcgcaccaaatcttcaatctgattagctctttgtacttctgcagacaagctccatgctgaatcgatcgtgattttcgggtcatagcccaacaccttcatcccgagtttgattgcagcatccgccacaggtcgcccgatcttgccaaggccaataacacccaatgtccgccctggcagctccagtccggaaaactgttttttacctgcttcaacctgcaaatgaaaggattgatcatctccttccagcgcttcaacaaaacgcaaagccggtatcagattacgcgatgccattaacatccctgccagcacgagttccttgactgcattagcattagccccaggtgtattaaaaaccggaataccgcgtgcactcatctggttgacgggaatattgtttgttccagcaccggcacgaccgattgcaatcacacttacgggtatgtccatatcgtgcatgttatgggaacgcaccagtatcacatcaggatcggaaatatcactactgatctgaaaaatattggcaggtaaacgcttgagtccgaccgaagcaatcgagtttagcgtaagaactttgcagattttctgaatatcttcagacatggtttttctcaaattcccgcatgaatgtcgccagtgtctgcaccccttccaatggcatggcattatagattgaagcacgcatgccaccgactgatcggtgccctttcaactgaagcaatccatgtgcctgcgcctgtttcaggaatacctcatcaagaccggaatcacttagtgtgaatggaatattcatcctcgatcgatctgatcggctgaccggacaatggtagaaactactggcatcaatcagatcatagatcagtttagccttggcgatattacgctgttcgatcgcagctaatccaccctgtttttttaaccattccatgaccagccccatgatgtaaatggcataagtgggaggtgtattatacattgaagcctgatccgcatgcgttttgtagcggtacatggtgggagtccggggaagtggcggaatagccagcaaatcttctcggataatcacgatcaccagcccggccgggcccacatttttctgtgctcctgcgtaaatcaacccgaatttactgacatcaaatggccgcgacaggaaattggacgacatatcagcgaccaagggaatattaccattgccaccaggggccgcagataaatcaggcgtccaatggaattcaactccaccgatcgtttcgttgggcgtatagtgcacataagctgtatcagatgaaatatgccattgttccagcgggggaacggagttgaagccatcttgttccgatgatgcagtgatatgaacagagcagtattgacccgcctcagaggcggctttttttgaccattggccggtatgaacataatctgcttgagtatttccttcaagcagattcatcggtaccacggcaaactgactggacgcccctccctgaagaaagagtactttgtagttagcgggaatattcgccaactcacgcaaatcggattcggctttatccactatggacatgaattctttcccgcgatgactcatctccatgaccgacatgccactaccatgccagtccagcatttcctcgcgagcctgttccaatacttcctccggcaaaacagccggtcctgcactgaaattgtatattttcctcattgtgtcaccgggttgaattaattctcatccgtttcaacgattctttccagtccagcaagtttctcgccggcatccagattaatcagtgtaaccccctgagttgcccggcccatttcacgaatttcactgacacgagtacgaatcatgacacctccagtggtaattaacatgatttcatcattgggttcaacgagttgcgcagcgacaactttaccattacgtttattggtattgatcgcgatcataccctgagtacctcggttatgccgggtatattcagtaatggaggtgcgttttccataaccattctcagttgcggtcaatactgtcatattttcactatctgcaaccagcagagagataactttttgttctgccccaagcttcatgcccctgaccccgcgcgcattacgtccggtcgggcgcacatcattttcatcgaaacgcattgccttgcctgcatcagaaaaaagcatgacgtcatgcttgccttcagtaagcgcaacaccaatcagataatccccttcatccagagcgaccgcaatgatcccattggtccgtggccgggaaaactctgataacggtgtttttttgactgtaccaccagcagttgccataaatacgtagcgggtatcatcaaatgacttgaccggcagaacagcattgatcttttcatgctgctccaatgggacaaggttattaatgggcctgccgcgggaagtacggctgccttgcggcacgttgtacacctttatccagtaaacccgcccgaggctggagaaacacaggataaaatcatgggtattggcaataaacagattatcaatgaaatcatcctcgcgagtagtaatcgcttgcttaccacgtcctccacgtttttgtgcctggtaatcgtcaagcaactgagatttaatgtagcctgcgtgtgacagagtcactaccatatcagtgggtgtaatcagatcttccgtacttaaatcttgtgcatcgatcactacctcgctgcgcctgggatcgccgaactgccctttgatagccgtcaattcttcaataataatagcggtgatacgttctgaatttgccaacatattgaggagatcccgaattttatccagtatctctttatactcggagacaattttttcctgctccagtccggtaagacgttgtaacctgagatcaagaatcgcctgggcttgcgcatcggataagcgatattcctggtttgacatcccgaacccggttgccagtgtttcaggacgaaatgcggctgcatcaatcattgcacggcggagcatttcttcaaccagggatgaccgccatgttctggccatcaatcctcttttagcttcagccggagtcggggctgccttgatcaaggcaataatctcatcgacgttagataacgcgactgccaatccttccagtaaatggccacgttcccgcgctttcctgagttcaaatacggtgcgccgtgttataacttcgcgacgatgacgtaggaaataatccagcatctgcttcagattgagcaaacgcggctgtccatcgaccagcgccaccatatttatgccaaatgtatcctgcatctgcgtctctttgtacagattgttcaggacaacctcaggcacctctccacgcttgagttcaatgaccacgcgcataccggatttatccgattcatcgcgcaaatctgaaataccctctatccttttatctcttaccagctctccgatacgtaccaatagattggccttgttcacctgataaggtaattcatcgataatgatgctgtggcgatttcctttatcgagctcttcaaaatgcgttcgggcacgcataatgacgcgccctcttccagtctggtatccatccttgataccagatataccgtaaatgatgccggcagttggaaaatcgggggccggaatacaagccatcaacccagcgatatcgatatctggatcacttagcaacagcaagcaagcatcaatcacttcgctgatattatgaggcgggatgttggttgccatacccaccgcaataccggatgaaccattaatcagcaagttgggtatttttgccggcagaatcaatggctcctgttcggaaccatcatagttggggccaaaatcaacagtacttttatccaggtcggccagcaactcatgggcaatgcgcgacattctgatttcggtgtagcgcatagctgctgcattatcgccatcaatcgagccaaaattaccctgcccgtctatcagcatgtaacgcagagaaaaaggttgtgccatacgcacgatcgtgtcatagacagctgtatcaccatgcgggtgatacttaccaatcacatcaccaacgatacgtgcagattttttatatggccggttccaatcattggatagttcatgcatggcgtaaagcacacgccggtgtaccggtttcaacccatcacgcacatcaggcaaggctcgtcctacgataacgctcatcgcataatcgaggtaagagcgcttcatctcatcctcaagactgacgggcaatgtttcctttgcgaattgttccatgtataaactactttagtggtgaaatattcgggttatacccatacgggcaaagcaactgctgcgcaagaattactgatggctctgctcaatataagcagttttttgttccagcatatcaatcagggcggcgataccatttttttgcaacacggcgttgtattcagcccgtttcaaggccagatcgctaactccatcaactacaatattgataatgcgccagccttcactggtcttgttcatcacataatcaaaattaacaggattaccatcggtacgaatgagttggctgcgaaccagcatccgtcctcgcggaagctgtgtccgttcaacaattttgaactgctcgccatcatactggctaaaccggtctgcgtaggtcgcaatgctgttttcctgaaatgcctggctaatagcctgctgctgatcagagttgagttttgcccagtgcgcgcccagcacagaacggataattgctgcaagatcatgtgtctgttgaatgatgggagtaagaagtttcaggcgaccgctatagccaattttctggccctgttgcatagcctggatcaaaccattctgcagagtaatcaccacctcggcaccatcgcttttagatgactctgcctgcaatccagcagcagtcatcaccagcatggcaaccaccaatagcttaaatactctgttagttgtgttcagaagcttcatagcgtcgatttttccagtgagcccgtattcctcgccagtatctgaacgcagatgtccaggtcatcagcaggtatagcgtaccagttacaggcaatgcgacaccccagagtggcgagcttcgataaaatctgagtacgggcgtataaacaatcagcatggccagccaggtaagcacactgctggccacaaaaatcttcttatccgcataaataatcgcagacaatggcgcgcaccagaacatactggtcatgatcaacgtacacagaaacagcagcaacaatgaataatgcagttgcgtaaatgcagtacgggcaacggtgttccagatggtagcgagactgtcatagcctcgatgactttgaacagcatgactaagtccgatccaggttttaaaaccggcctgtttaaccaaagcggccagcgtacagtcatcaattagcgcattgtgaatactggtaaaagcattaatagatttcagcacactggttttgaccagaatgcacccgcccgcagcagcagccatacgggactctggtttattagataacttaaatggatataacagcttgaagaaaaatataaaagctggcaccagcaggcgttcggagaaacgcttgactggcagctcagccattaacgacactagcgataaattttcctgatgcgccttatttaacaaagcctccaaaataccaggtgacaagctgatatctgcatccagcaacaaagtatactgcgtacgcacctgctgcagcccctgatccaacgcccataactttccactccagtttttaggcggggttgtaccagagataatctctacccctggtctcttcgccagggctgcagtacgatcttccgattgatcatcaattacaataatccgcaaatcctcaccttgagcttgaagcttgctcagagtctgatcgataaactgtgcttcgttacgtgcaggaatcagaactgtgacatcgctgaagaaccgatttacttctacaccaattgaaggttcgagctgttcccgaacactccaggcccgccacggggccagcaggatagcccaccagcaaaatacgcctgccaaagtcatatacattatcaatgtaatcatgacttccgataagcgggagtacgacttttctcaggccaggaaaaaatattaattatccggaccggacgaatgatctggtgccggcgcaacggtcttatgttcaacagttactgacacgggaaagggtttccgtttatttgtattatgctgcgatccattgtttgtttgcagcggatccagcgccatgggtccctctacacgcgggccgcgcatgctgactcgtaatgccttaaaaggatgagcaaaagtatcgttaatggcagtaggctcaaacccgcaatgcgccatgcaatttgcacatttagggttattcccaacaccataccgatcccaatcggtctcttccatcaattcccggaagtttgctgcatagccttcatccaccagcaggtaacaaggcctttgccaaccaaataagttgcgtgtgggatttccccacggagtacattggtagttttgattgccggcgagaaaatccaagtacaggctggaatgattgaatctccagggggtcttgcgcttttttccaatctggaaaatcgaacggaacagccgtttgcttaccgacctttgtagaaacacatcctgccgtggtgcgtgctcatagctgaacccaggggatacattaattccttcaacaccaagttctgttgcggtatcaaaaaacgcggccacttcctcagctgtttcgctctgaaacaaggtgcagttgacagtcaccctaaaacctcgctgaagcgcctgctcaatcaccggaataaccttgtcatacactccctctctacataccgacgcatcatgccgctcccggtttccatcaagatgaatggagaatgtcagataaggagaaggctgatagtcgtccatacgagcgtctaataacagtgcattggtgcaaagatatacgaactttttacgttgaatgataccttgcacaatttgcggcatttccttgtggataagcggctcgccccctgcaatggaaacaactggcgctccacattcatctacggcatgcaaacattcatccacacttagacgacgacgtaacgtttcttccgggtaatcaatcttgccacaacccgcacaagccagattgcactgaaataacggctcaagcatcagcaccagcggataccgcttattaccccggagtttttgtttcagtatataactgcctacccggtattgctgcaaaagaggaacactcattattaaattttctccatttttttataccagccaatgtcttgattttttgcccgttaagaatcttgtgcaaccatccagtctttccggatagaagaatattatctccatcaagctgacgccaagaaaaatccaagagttgccggatcaggatacgttgacaccatctttatccattcaaaaaacgcaaccccaagcatatcctcataaaaccatgaatggcggaagaggtgggattcgaacccacgaacagtttcctgttgctggttttcaagaccagtgccttcaaccactcggccactcttccctggatgacagactgcagaaattaagaagcgggataataccctccaattaattattttaccacgaccttcatcttaaaatccggctgaaccaggaagcccaagagaaattgcatcctgtattgtgaactgaccagtcttaagagataatggcctcttttgccggtttttgttggtcatcatgtggtgcatcacattgcgggcggcagtttcagtttttgaataatcgaggacgagagcaaatgaaggaagcattcaacgactttggtgcaccagtattcaataatttgaccagtgcaattcgcgcattggctatggatgctgtccagaaagccaattccggtcacccgggcatgccaatgggtatggcagaaattgcagaagtgttatggattcaccacatgcgccacaatccggcaaaccccgagtgggcagaccgtgatcgttttgtattatcaaacgggcatggctccatgctgatatatgcgctgctccacctcaccggttatgatctgtccattgaagatataaaaaatttccggcagcttcattcaaaaactcccggacatcctgagtatggttataccccaggcgttgaaactacaacaggaccgctggggcaaggccttaccaatgctgtaggtatggcgctggcagaaaaaattctggcggaagaattcaaccggccttatttcccgatcatggatcatcacacctatgtatttctgggggacggttgcctgatggaaggcatttcacatgaggcttgttcgctggcaggaacactgcaattaggcaagctaatttgcttttatgatgataacggcatctcaattgacgggcatgtcgaaggatggtttacagacaacactccgaaacgtttcgaatcttatggctggcatgttattccaaatgttaatgggcacgaccccgtggcaatacaagcagccattgaaacagccaagaaagtacaggacaagcccacactgatctgctgcaaaacagtaatcgggatgggttcacccaataaggccaacaccagctccattcacggagcggctctcggaaaagatgaaattgctgctgcccgtcctcatattggctggaattatctgccgtttgaaattccacaagaagtttatgatgcatgggatgcccgtaccaaaggccaggcgttggagtccgcctggaacaccatgttcgcggaatacagcaaaaaataccctgccgaagctatcgaatttactcgcagaatggccggtgagttacctatcaaatgggttgatcatgttgagggaatcatcagtcagattaacgccagagaagaaagtatcgccaccagaaaagcatcacaaaattcaattgaggcgctagcgccggtactgcccgagctgatcggtggatcagccgatcttactggctccaatctcaccatgtggtcaggatccaaagtaatcagcggcaatactactgggaattatattcactacggtgtacgggaattcggtatgagtgcaattatgaatggcctgtcactgcatggcggaattatcccctacggtggaaccttcctgatgttttcagaatatgccagaaatgccttacgtatggcagcattaatgaaaattcgcaatatttttgtatttacccatgattcaatcgggctgggtgaggatggaccgactcatcaaccggttgaacaaaccgccacattacgcatggcccccaatatggatgtatggcgcccatgtgatacagttgaatctatcgtttcatgggtggctgccatagaacgcagagaaggccccacgtcgctcatattcagccgccagaatctgcctttccagaaacgagatgcagcaacgatcagcctgattaagaaaggaggatacattctttctgaagcagcaaatggaaacccgcaagtaattatcatagcaactggctcagaagttgggcttgcaatgggcgcacagaaggttctagctgaaaacggtgttgcagtacgtgttgtatcaatgccctgtaccaatatttttgataaacaggatctggcgtaccgagatagtgtcttgccaaagggaattagacgcgtggctgtagaggccggtgtaaccgatttctggcgtaaatacgtcggacttgaaggagaagtggttggaatcgataaattcggtgaatcagctcctgcagaaaaattattcgaatattttggctttactgttgaaaatgtcgtaaacgcggtaaaaagaattatataaacgcggaaagttcttttcttgtccgcaaaacaggtttttagtaaaaatacggagataaagggatggcaattagagttggcattaatggttttggtcgtatcggacggatggtttttcgtgcttctatagaagagtttgatgacatagaagttgtcgcaatcaacgatttactggaaccggattatctcgcctatatgttattacatgattccgttcatggtcgtttcaaaggagatgtatctgttgacggtaataatttgatagttaatggcaagaaaattcgcttaactgccaccaaagatccagaagaactgaactggggtgaagtcaaggttgatgtcgtggtggaatccaccggattgttcctgaccaaagaactctgtgaaaaacatatcaaggcaggcgctcctaaagtcgtcatgactgcgccatccaaggatgatacgccaatgtatgtttatggtgtcaacgataaaacatatcagggtgaagcaatcatttccaatgcatcatgtactactaactgcttggccccgatcgcaaaagtattgaatgatacttggggtatcaagcgtggtttgatgacaactgttcatgctgccacggcaacacaaaaaacagttgatggcccttccaataaagattggcgtggtgggcgcggaattctcgaaaatattattccttcctctacgggcgcagccaaagcagttggtgtagttattcctgaattaaataagaagttaaccggcatggcctttcgcgtacccacttctgacgtctcggttgtggatttaacagtggaactggaaaaagatgcatcttacgatgaaattcgtcaggcaatgaaaacagcttctgaaggctccatgaaaggtgtattaggctacactgatcaaaaagtagtttccactgattttcgtggagaaacccatacatcagtgtttgatgcagaagccggcattcagctggataagaattttgtgaaagtagttgcctggtatgacaacgaatggggttattcctgcaaggtactggaaatggtacgagttatcgctggccgcaataattaaagccaaaggtatatttttcatggaataaaccactggggttggttgtttatttcttaccctggaaattgtgctgtaaccggttccctactggttacagctttgttgcttcaataaacaagaaagctatttttcatcccaatccgggcaagaaattgcagataaatcagttgatgatctatagaagaaattaatcttgatattgccgcttctatgaacagatgcatctatatctttatcgtccttctcaattcaacaaccaattaatttccatctgattaccttataaaatcagcaagttatctaaaatatggagccaatgtgtcagttattaaacttgtcgatctagatctgaagaataaacgtgtttttatccgcgctgatctgaatgttcctgtgaaagaaggtaaggtgacttcagatgcacgcattactgcatccatggcaactataaatcattgcctgaagcagggagcaagagtaatggtaacttctcatctggggcgcccggaagaaggcgtgtggaccatggaaaattctcttcaaccagttgccgatgatattagccggagactgggaacaactgtccgattgatcaaggattgggttgatggtggattcgaagttgcgcccggagagctggtaattttggagaattgccgaattaataaaggcgagaaaaaaaatcttgaagaaacagcaaaaaaatatgccaatttgtgtgatgtcttcgttatggatgcttttggtaccgcgcatcgtgcagaagcctcaacacacggtgtagccaaatatgcaccagttgcctgtgctggcattttacttaccgaggaattggatgctttaaccaaagccttgcaccagccagcacgcccactggtagcaattgtaggaggatccaaagtttccaccaaattgactgttctggaatcacttactgagaaagttgatcaacttgtggttggtggaggaattgctaatactttcctcaaggctgctgggaacaatgttggaaagtctctgtgtgaggatgaactggtacctatagcgaaatccctgatggataaaatgaatcagcgtaatgcaacgattcccatcgcaattgatgtcgttgtcggaaaaaaatttgctgcagatgaacctgctgttctaaaagaagcaaatgctgtttccgacgatgacatgatttttgatatcggccccaagagcactcaagaactggttagcatcatcatgaaggccggcacagttgtctggaatggccccgttggcgtgtttgaatttgaccagtttggagaaggaacacacgcaatcgccaaggcaattgctgaaactgatgctttcaccctggcaggcggtggtgacacgattgccgccattcagaaatatgatatttacgataaaatttcatacatatccactgccggaggtgcattcctggaattcttagaaggaaaaaaactacccgctgtcgagatcctggaattacgtgcacagtgaggcctgagaaaattttcttccaggaatttcggaaatgatgcgaagaacaaaaattgtagcaacgttgggaccagcttccagcaaccctgatatcctgagacaaatgattgaggccggtgtcgatgtcgtccgtatcaatttttcacatggaacaaaggacgagcatattgcttccgcggagcaggtacgctcacttgcccattcacttggccgtacggtaggtgtgctggccgatctgcaaggaccaaaaattcgtatcggcaagtttgctcagggaaagatcacgctcaaagccggggaggaatttattcttgatgcagagtgcgagctgggtaaccaggaacgggtcgggctggattaccgggagctgcccaacgatgttgaagcaggtactgtcctcttgctggatgacggccgaatcgttctgactgtgaccaaagtcagggaaagtgaaatctattgcgaagttttacaaggcgggatactttccaataataaaggcataaaccggaaaggtggaggtctgagtgctcccgctctaacggcaaaggatctgcaggatatcaaaactgccacaattttacgggcagattatctcgcggtgtcatttcctcgctcgggagaagatatcaggcgagcgcgtgcattaatgcaggaagcccaggggcatagtttgctcatggcaaaaattgagcgctcggaagctattctggcgttggatgatattctaagtgcttccgatgcaattatggtcgcgcggggcgatctggcggttgaagtaggtgatgcagcagttcctgccttacaaaaacgaatgatacgatcagcacgtgaagccaataaattggtgattacagccacgcaaatgatggaatcgatgatatccaatcccatcccaacacgtgcagaggtatcagacgttgcaaatgcagtgctggatggtacggatgctgtcatgctgtctgctgaatcagctgcaggacaatacccggtagaagccgtagcagccatggcaagagtttgtctggaggctgaaaaggagtatacggttaatctgagttttcgccgttctccggatacacaaccagtcagtatcgaagacgctattgcgcgggctaccatgtacaccgccggttcgctcaagattcgagcaatcgctgcattgacacaaagcggcgtaacagcattgttcatgtctcgcagaagctcgaaagttccaatcttcgctttaagtccacaagaagatactctgagcaaggtcactctttttcgtggtgtttatcctataaaatttggacagggattgtgtgatcctgagattattctcagtatggcggaagatgagttgctcagacgcggcgcggtacgaaacgaagatttaatcatcatgacaattggcgaaccggttggcaaggctggcggaacaaatactatgaaacttgtcagagtaggtggttccaggggaacgacacagataacgaaagaagtgactcagcagaccttttctgatccacttaatttataaaattaaccctacaaacagtattagcgtatcggcttatacacccgtaagaacatgaagtttggtttcatcagaaaataaacatattaatttcatataaaggagacttgaatggcacttgtatctttacgccagttactggatcatgcagccgaaaacggatatgggcttccggcttttaatgtaaacaaccttgaacaaattcatgcaattatgcaggcggctgatgaatgtgatagcccagtaatcatgcaaggatcggctggtgcccgcaagtatgctggtgaagcattcctgcgccatctgattgccgcagcagttgaagcctatccccatatcccggttgtaatgcaccaggatcatggcgcctcaccttctgtgtgtattaatgccattcgcagcggtttctccagcgtgatgatggatggatcgcttgaagaggacggaaaaacgccttcatcatttgaatataacgtggatgttactgccagagtagtcgctatggcacatgctgtaggcgtttccgtagagggcgaactaggttgcctgggatctctggagtctggtcagggcgaagctgaggatggccacggtgctgaaggacaactttcacatgatcagttgctgactgatcctgaagaagctgccgagtttgtcagaagaaccggtgtggatgcgctggcaattgccatcggtacttctcacggtgcgtataaatttacccgaaaacccacaggtgatatcctcgctattgagcggatcaaagaaattcaccagagaattcccaatacccatctggttatgcacggatccagttccgttcctcaggaatggctagaaatcatccgtgaatatggtggtgaaatgaaagaaacctatggtgtacctgtagaagaaattcagcagggtatcaagtatggtgtgcgtaaggtcaatatcgatacggatatccgtttggccatgactggtgcaattcgtcgtcatctggccaaaaacaaaagcgagtttgacccgcgtaaattcctgaaagatgccactgctgctgctaaagatatctgcaaagcacgtttcgaagcatttggctccgcgggtcaagctggcaagatcaagccaatctcgctggaaactatggcaaaccgttacctaagcggcgaactaaaagcaattgtaaagtaatctaaaaacgggctaatccccaaaatgccccacaaattcctggaaagatattcaaaccagggatgtggggcactttttattcacgtcactaatcagtaagtctgcttataacaaaggcaccgcctctgcagcctatcacccctctccctctccctctccctctccctctccctctccaggctaaactgcctcaactttcacaggagctttaattttaaattctggtgaagattgtcttctgttcattcaaatcaatagtatgacttaacatcctttacagaatcatttaaccactacaggcctgaatcagaatcgatgtgacttatctgcttcatctaaaaaatgaaatatcaccaagaagccagaaaatagcattcaaacaaacacgaggcccctgcacagctaccctttttccatatgcgaatcataaataaacaacggcttgaatgtttattgcgatcaagaaaataagttgagcaggaatctcaatgctttggatatcccgataagtgataaacaacttgacagcttctaatatttgtaaagaaaatagttgaggcagcttagaatccaaatactcttctaggctgcaaatccctcagcaagcagctatcgtgtcgaggacaagcaagttaatacagtgctgctagttaattactgcaacacaatcaagagagagtgcaacatggatagtgcattactgagcttgctggcagcctttttattatcactcattggtttgcttgtattcatctggtcgctgcgtaaaggattactgtttgaaaatccgcgagcggccgccacgatttttgcacctggagaaattggcaaagcagatgatccagctctggatgatcaggctgcaaaacgccttcaagaggcgataaccgcttcccacggcagtgagccgcaagccgaagatccggatgagatcaaggatcgcatcgctgctgaccgttcatctgccttcccggtctttatgttcatttcctttggctgtatgtggctgatactgggcgcgacagctggtctcatttcatcattgaaattacactggccagactttctggtatccgaggcttggatgacctttgggcgcatgcgaacagtacatctgatcgcagtactttatggctggatcaccaacgttgggctgggcattatcatctggctgctgccacgcttgttgcgcacaccactgaaaggaccaatgtgggtcatgctgggggggacatttatcaacatcggaattgccagctccattggcgcaatcggttccggctggagcgatggtatggaatacctggaaatcccatggcagatcggcttgttcattcaggcaggtatggtttgtatcattggttcggtattttatacattgttccaccgcaaagcacatgaactctatgtgagtgtgtggtatcacatcgctgccttattatggatttcgctgctgtttaccgtcggaaaacttccgggtgttcattttggcgtacaacaggcgatgaccaactggtggtatgggcacaacgttctaggcctctggtttactccgatcgccttgggcgccatctactattttctacccaaaacaatcgggcgacgagtgcgctcctataatctttcattgctgggtttctggacactggcgtttttctacgcacaggtgggcgggcaccatctcgttggcgggccggtacctggatggctgattacgctatccatcgtgcagagtatgatgatgatcatccccgtagttgcattctcagtcaatatggcaggaaccatgtgggggagaatgcgtctggcactttattcgccaacgctacgattcatgatgtttggcggctttatgtatctgctgtcatcggtgcaagggtcatttgaggccttacgcagcattcaacaagttgcgcactttacacacttcacagtagctcatgctcaccttggcgcctacggtttcgtctcaatggtactcttcggtgcgatctactttatgatgccgcgtgtactgcattgggaatggccctacccaaaactaatttcgttgcatttttggctagccagcatcggtatcctaatctatttcgttttcctgtcttggggcggctggctacagggccttgcaatgctcgataccacacgtgaatttatggattcagtacgactaactattccttatctggaatggcgcagtgtaggaggtgggctgatgtggcttagccatgtgatttttgtcggtcatttactggtcatgatactgcgattcggccccaaccgtaccggggaagcactgtttgcaccggaaaaaatgaaactggagatgatgcatggaaaatgaagctaagctgactgctggcgcaataacgacttttggaattgccgtcgcagcactggtggtgcttccatatatccaggtgcgtgatattcagccgcctgaaggactcaaaccttacaccagcgcagaattacgtgggcgagaaatttacgtcgccaacggttgtttgtattgccatacccaacagccgcgcgaccgcagcttcgctccggattttgatcgcggctggggacgggtcaccacgcctggtgactattattacgacaaaccacacttgctaggcagcatgcgcaccggcccagatctaatgaatatcggtgtgcgccagccaagcatggactggcatctaggtcatttgtatcagccgcgtgcgtacgtgccagattctaccatgccttcttatccttatatgtttgaagttaaagatcaagccgaaaatgacgagataatcgtcaagctgccaccaaaatttgtaccatcagggaaagtagtggttgctcgcccggaagcggtagatctggtgaaatatttacaatcccttgaccgaagttacccgatattaccgccggatccacaaaacgcaggtaaaaaggatcgctaaatgacatcaataaatcgctctgccacatacaggcatgatcttttcaaccaaagaggtacactccatggccgataatgatgaccatcgcgcccaagtccgtgaaaacattgaccccaaagaaatcattcgcccaattccgatgacgacaacattagtcacgttgggaatggttattttcggcgtagtatatttatttatgtcagaaccactgacgacgtctcgctatggtgatcagcgcacattggccgatctttccagaccactgcaaacagccgatggtgataatacggttatcgatggcaagaccttgtacgttgcacaatgtgcagcttgccatcaagtcacaggactgggtgtaccaggcgttttcccgccactggacaactcagaatgggtacagggtgaaccacgtattctagccaatatcctgttacatggtgttagtggtgaaatagaaattgctggacaaaaataccagggtttaatgccagccttctcgcaactaagtgatgcggaactggctagggtggcaacttacatccgcagtgcctggagtaataaagcagatgcagttgcagccgatctgttcaagacagaacgccaatccagtgctggacgcactacaccatttgaaggtggagcggcactgaaagcactaagtgaaaagaatcactagcggcaagctgccaaggcgcacttgcactgataaccagagatgatacgcactgtaattacaagtgtattaatcattttgctcggctggagtgcagcatcctggctaacttatgatttccagatctggactgatgaagacgcgcgccgtctggaagtcgctttgcatcctgtcgaaatctcccctatacaaatcgaagggccggatcttgctgaaacggatcttccgaccctgttacgtcaagagaatgttgtaacgatcgcagactttatctacacccgttgccaggccgtatgcccctcattgggtagtatttttcagcagatacaaaccgccttactcaacgatgcgggtaacgagcgtccgagaaatgttcgcttgctttccatcagctttgatcgcaaacatgacgatccgcctgcacttcgagtttatgccgataacttgagtgccaggccagaactctggcgttttgttcgagtactacaggcaaaacaggaacaagctttgctgcaacagcttggagtagtggtgatacctgatggccgtggcgattacgagcacaacgctgctctgctggtatttgatggtgctggacgcatggtgcgtgtattcgatattgaggagcaccagctggcacttgattatgcgcgccatctggcacgcaagcagatacaggaaacttcgttgtgaacaagtgttggcaagctgttttaggcataggcttactgctgttcatagccacacctggcgtacgtcatgcaatggaaaaaagcatgtggtgtcacatgttggtgcagtttccactctggatgggagcagctgccttgcttgccggaggaatgccggcacgaatatgtaaggttattgctcgctggaatatgtatggaatcagcggattactcataacaggtgttacgctcgctgtgctgatgataccacgtgtgcttgatcaagcattactgcacccaaaaatggagttggctaaattaaccgcattggttctggcaggcatggcgctacgtctgtcatggcgtccagctggtttgattctgcaatttttctttctgggcaatatgctgcccatgatgggagtggttgggtggttgtatactgaatcaccgctgcgcctgtgcaatgcctatctgcttaatgaccagatacagcttggcaactggttgattgggctggctgccgtaatcgctatagtatggctgtcatggattacatggcacataacctatcaggaaatccggcagacatcacatcgttagagtaatttctttacaccctaactctctccttttaccatcatcactatcactcagtgatagacccaaacgctatttctttcctgacagcctttctacagtatccgggatacttattccgagccagccatataggtatgaggaaccaatatcggcttcggagaaccagaagcgcttatggtattcgctgttcgggtagcagcctccaaatcagggaacggccctacaaatattttgtgcaaaccacttgtttgattgatataggcctgttgagtgattgaggggaaattggatcttaattgtattagataagattgagcattatgggcagagccaaacgcggcaagctgtaaataaaatttaccagtatcgttactggacaccctctttggagccatatctggttgggattgtgttgtcacagaataaggactgctgaaacgatccggaataatactttccacctctacccgggcactgccatttgccaggacaccgagcttatgagccgcaacataagacagatcaatcaggcgactttccaggaaaggtcctctatcattaatacgaacaattactgagcttccattctgtaagtttgtaacacgaacatagctgggtatgggcaaggttgggtgggcggccgtcatggaatacatatcgtaaacatcacctgaggctgtacgttgaccgtgatagcgcttgccgtaccaggaagcctgtccgcgttccttgtaaggcttgagtgtggtcatcggtgtgtaggttttaccaagagcaacataagggcgcatcgttgctgtttttaaaggctcaacccgaggaactgcatcaggaacagcatcaagattagccgggggattttcttccggcccatcatcgagatagtagccccctcctccacttcccgcaatagatgagctcttcgtgtgtgcttgtacggatgattgccctactctgggagtattactgcaagctgagagcataaataatatgacaacagcagaaaaaacaaatagtgcacttctgcttggaatatcagaatggaaataagaatttggtttcatatttttaagtcttaacaagttttggatgagtatgtatgctcattaaaattccaaatcccagcagtatggtgaccatagaagtgcctccataactgatgagtggaagaggtatgccgacaacgggcaagataccacttaccatacccatattgacgaacacataagtaaaaaaagttaaggtgattgatcccgcaaccagccgtgcaaaccgtgtcggcgcactggccgtaataaccatgcagcgcccgattacgatcagatacagcgataataacaaactgttaccaatcagcccgaattcttctgagaatactgaaaaaataaaatctgtactcggttcaggcaagaaatcaagttgagactgggtaccttttaaccacccctttcctgcaattccgccagatccaatagcaatactggattgtatcgtatgatacccggcgcctagtgcgtcttgtgaaggatcaagcatagtcataattcgcttgcgctggtaatcatgcataccaaaagaccagagtaaaggcagactcactgtcactgccacagccaagccagtcatgagacgccatgacagacctgccaaaaaaataacataaaatccgctaatcaagatcagcaaggcagtcccaagatcaggttgccgcacgataagcgcaaccggcagcagcagaataagtgcagcaataacataatcccgccaacgcagagtaatgtgagctttgtcaaaataccacgctatcataagaggaacagcaattttcagcagttctgaaggctggatatgaacaattcccagatttaaccagcggcgggcaccattctgcacttcaccaaataacgccacagcaatcagcaagacaatacccagtacatacagcggaaaggccatgcgcataatcctttgcggagggatgttcgcaaccacccacatcactacatatgcaacaaccatgttaattaactgactgattacccgggcagagctcccaccggtagcgctgtatagcacgatcaacccggtcagcattagcagaaaaatcccggcaagcagaaaattatcaatatagcgcgtaaaataatgccatgcttgcttgatatccggagtaatcatctcgcgatcaggaattcatccgctaccctgctttcttagcaggctctggcattgttcccaggaaaaaataatccagtactttgcgagcgataggggcagcggttgatccacccgagccaccattctcgatcagtactgtcagcactatcctgggattttctacaggcgcaaaagctgtaaacagcgcatggtcgcgatgccgctcgtcaattttactggcattgtagcgttcaccctgcttgatattgattacctgagaagtaccggttttcccggcaaaggtataagcagtattagcaccggcacgggatgctgtaccaccagggcgggtaacatctgctaatgcctgcctgacagaatccagatattcctgcctcagattcagtctgtaaatttcctctacaaaattatctttcacaaaattcttataatgatccacctgctgtctaacaaaatgcggcctgtaggccctaccatcgttagccagtaacatcatcgcaaacgtcagctgaagtggcgtggataaattaaacccctgtccgataccaaccgaaatggtatcccctggcagccagttttgattaaaccgcctctttttccactctggagaaggcaataatccagcagcttctcctgggatatctattccagtttctttaccaaaaccaaactgcccgatgaaatcatgaatgttggtaatacccaaatcatgtgcgagcatgtaatagtaagtgtcacacgaaattaccagagatttgcgcaaatcgacccagccatgccctcccggcttccagtcacgaaaacggtgtgaacttccaggtaaactgaaaaaacccggatcattaaatgcataatgaagagagcgtttacccagctccaacccggccagcgccataaatggcttaaaggtggaaccaggagggtatacaccccgtaaagcacgattgttcaagggtctgtctatggattcattaagcagacgccaattaaggtggtcaatgccgtccacaaacaaattgggatcaaaacccggtttactgacaaaagccaaaatttctccattagatggatccagcgcaaccaaagcaccgcgataatccccaaaagcctgtacagctgcctgctgcaacccaatatcgagagaaagcgtaagatcgttcccggcagttggcgcaacacgggacaaagtacgtacaggacgaccaacagcatcagtctcaacctgctcaaagccagtctgcccatgcagcacactttcgtagcttttttcgataccaatccgcccgatatgcgtggagccgtagtaattctttagccgcttatccgcttcgagctgttccagatccttgtcgctgatacgtccaatgtagcctatcacatgagaaaccagctctcctttcgggtaatgcctgaggggatgcgccttgatatccatcccgggaaaacgatactgattttccgcaaaacgagctacttcaaaatctgtcagacgggaacgtatgggcaggctcttaaatcttgtattttcaagtttcagcttgttaaagcgtctccgatcctcgggagtaatctcaatgatcgttgccagttcattgatagctgcatcaagatttttaacttgatcggggattatctccaaagtgtaggccgtgtaattttgagccagaatatctccattacgatcaaatatgagcccccggttaggggtcagcggctggatagcaatgcgattcgcctccgcgagagtcgtgtagtgctcttcttgcaatacctgcagataaaaaaaacgaccaaagagcaaactgaacaaaaccacgacaccaatcgcactgatcaccaacctgatgcgaaaatgccgagtttcacgtatatgattacgtaactctacaatatcactcatacttcatcgcgatcaattcgctgcttacgaaatattcccagcagaaaaaccaataagggccaacataacgccccggttacactcgccaggaaaatataccactcaggaatatacgatcctgccagaatcccggtcaaaaataccactccttgccctgataacagtatccataaaactgcgggaatttgctgaaaggcattgaacaagcgcaaacgtctatacaggatcaaggcaaaaaacgtgatcaggcaatatgcaatggcatgctgtcccatgatactgacatcgatgacatccatgaacagaccacttatgaaagcgatactcatgcccgcttgctgtggttgatagatattccagtagagtaatgtcagcgcaacaaaatccgggcgcaaaaccagtatcactttatcaaacggcatcaggttaattaaaactgccgttatcaaactgatataaatcagtgattttcttgcaggaaataaaaattcctggatttcgtaatcataacgcctgattctagattttccgttttgtctgggatgcatgggattcagggttatctggtatttccgtaacaggtggtggcgaactggtcaggatgagaacttgcctgtgccgatctacgcccgccacgggagtacatataatacgtgcaaatttatgtgaacgatcgtactcgatatgagtcacccgtcctacaggtaatcctggtggataaacccctccgatccccgaagtgatcagcaggtcgccttcctggatatccgtgctaatggataaaaaccgcaactccagttcgccatttctacctgtacctgaaattactgttcgcaagctattacgctcaatttgcacaggcaccagatggttcttatccgtaatcaacgtgatttctgccgtccacggataaatctgtgtcacctgcccgataacaccaagatcatcaatcacaatttgcccagccttgacaccacttgagctccccttacctactgttatcttgcggctgaaaggatcacgtggtacataaagtatctccgccagaatagtttgaatttcagtttgtttagcagccccaagtaaagcacgcagacgctcattctcgctagtcaatgcccgtaaccggaaaaaatcatagcggctgctcagatattcatgcctgagatggtcaatttcttcaatgagtttaaagtctgaaatatattgttccactctttcttgcaaggaaaaaggcaaatatgccaatttttgtaacgggaaaatgacaatcgcaattacacgccgtacttcagaaattgcatcagaacgagcatccgcaatcatcataaagacagatagcaacacaaagaaaaacatccgcgtcagaggatttgagcctggcttgaaaaattgtggagaagtttgcatagcgcctctcagtatttccgtattccaaactcatagattggaacatgccacttgctaaaaatactaataacagcccgaaaacttgaataaatgatatgcaataaagcactataccaaagcgcttgaggcacggattctgtacctgaagaccgcttgagaagggtaagaattcgacgaaggccaatccgatctatccagacttgccattttagcaaattaatcgtcaagatttgtggcgtggttattacgtattcgatataagcaggttaattggcagcacataaacagatctcggaaatccgacgcgcccttacgttatatgacaacttgcaccatggaagaaggtgggaaagacaaataaattaataatctctaacaaaaattccaaccggatgatcaatgctatccagggccattcccgcgccccgcacaacacaggtaagcggatcatccgcaataataaccgacaaccctgtctcttccataatcagacggtctatatctcgcaacagcgcccctccccctgtcatcaccatccccatttctgcaatatcggaaccgagttcgggaggcgtttgctccaatgcagttttaactgcactaacaatactattaagcggctctgccaaagcttccagaatctcattgctggagattgtaaagctgcgaggaataccttcagccagatttcgtcctttgacttctatttcccggacttccgagcccggataagccgatccgatttctgatttgataatttcagccgttacttcaccaatcataattccgtaattacgacggatgtaattgataattgcctcatcaaacctgtcaccaccaactcgtaccgaattagaataaacaactcctcccagagaaattactgcaacttctgtcgtccctccgccaatatcaaccaccatgcagccaattggagtttcaaccggcaaatccgcgcccagtgctgccgccataggttcttcaatcagctcgaccttacgcgcccctgcgccgtaagctgcttcccggattgcacgccgttccacctgggtggaaccacaaggcaccgaaataacaatacggggatttgctgaaaacaaacggggaggatgggcttttcggatgaattgtttaagcatctgctcagtgactgtgaagtctgcaataacaccgtccttcattggccggattgccgtaatgttgcccggggtacggcccagcatttgttttgcagcctgtccaacctgctgaatcatgcgcttgccgcccggccccccttcgtggcgtatggcaaccaccgaaggctcattcagcacaatgccctggccacgcacatagatcaatgtattggcagtgcctaaatcaacagccatatccgtcgaaaaatagctgcccagaaagttattgctcaggaaattaaacataatgacgatattccagtatgacagatccggtatgttacacgcactgcaggtatttcattatttcgctcttggagcaaacgctgcaaatgtataaaaacatgtgtttgacaggtgtgcatgatactctattacctgttttggtttaaacagaaagctacaaaaatgacactatcactgagcgatatcaagcgcgttgcaaagttggcccgtatcgaaattagcgagacagacgcccaacaaagcctaatccagttatccggaatattcagcctcatcgaacaaatgcaagctgttgatacacaagggatcaagccaatgagccattcccaggacatgacacaaagactgcgcgaggatattgttacggaatctgatcagcacatacaattccaatccaccgcaccccaggttgaagatggatactatctggttcccaaggtaatcgaataacaccggcaataaaaccgtatccctgcttatcaattttccaaatattccaccgcactgacagatcatgctaaatgccagtctcaggcagctctcttcgctgctctcagaaaaaaaaatatccagcacagaactcaccggggaatttctagcccggatcaaggccctcaatcctgacttgaatgcctttattacaatggatgaagaaaaaagtctggatcaggccagaaccgctgacgagatgatcgccacgggacaatccacactgctcacaggaatacccatcgcccaaaaagatattttctgtgccaacgggtggctgacaacttgcggatcgaaaatgctttcgaattttatttcaccctatgatgccaccgtggtgaaacagtttgatcaggtggggatggtcaatctgggcaaaaccaacatggatgaatttgccatgggctccagtaacgaaacttcctattacgggccagtgaaaaatccctgggacaggctcgctgttcctggcggcagctcaggcggctcggcctgtgcggtagcagccagactggctccagcagcaacgggcaccgatacaggtggctccattcgtcaaccagctgcattatgtggaatcagtggaatcaaacctacttacggactggtttctcggtacggtatgatcgcatttgcttccagcctcgatcaggctggaccaatggccagatctgccgaagatcttgcgctgctgctgaatgtcatggtcggatttgatgaacgtgattcaaccagtctgcagcgggaaaaagaagactatacgcaagacctagagaaatcggtgagtgggctacgcattggcttacccaaggaattttttgcagaaggtatgagcagtgacgtttccagtgcggtagaagcggctctggcagagtaccgcaaactgggcgccacatttgtcgaggtatccctgccaaacagcaagcttgccgttccagtctattacgtgctcgcacccgccgaagcatctagtaacttatcgcgttttgatggagtacgatatggccatcgtgccgcgcaatataccaatctggaagatttatacgcaaaaacacgcgcagaaggatttggcgatgaagtaaagcgccgtattcttattggcacgtacgtgttatcccatggctattacgatgcctactatcttcaagctcaaaaattacgccgtctgattgccgaggatttcaaaaaagcttttgaacaatgcgacctgatcatggggccgacttcacctaccgtagcctttaatattggcgagagatgcgacgatcctatccagatgtatctctccgatatctacaccagcgcagccagccttgcaggattgccaggtatgtcgatacctgttggatttggcagtaaaaacaggccggtaggcttacatattattgggaactacttcagggaagcacaaatgctgaatgcggctcaccgctaccagctggcgacaaactggcatgagcttactccaccggaaattaatcgctaaaaatcttcaggcctctgctctctggttaatatcaagcaactaaaagaaaaaggattacctgatcatgcaatgggaaactgtcatcggccttgagatacatgtgcagctattgacccgatccaaaattttttctggtgcatccgttgcgtatggcgcccgaccgaattcacaagcctgcgcagtggatattgccctgcccggggtattgccagtattaaaccggcaagcggttgaatatgccatccgctttggtctggcaattaatgcaaccattaattcaccctcaatctttgcccgaaaaaactatttttatcctgatttacccaaaggctaccaaatcagtcagctggcacatccaatcgttgaaggcgggcatgtcaccatccggacaggggataaagaaaaaaccatacacctgacacgcgcccatctggaagaagacgcaggtaaatcaacacacgaaggttttcatgacaagacaggaatcgacctaaatcgtgccggaaccggcttactagaaattgtctcggaaccagagatgcgcagcagtgccgaggctgtggcctacgcaagagtacttcattcactggtgcgctggatcggtatctgtgacggcaacatgcaggaaggatccttccgttgcgatgccaatgtttcagtacgacctgctggctcggacgtactggggacacgctgtgaaatcaaaaacctcaattcattccgttttcttgaaagagcaatcgattatgaagtggcaagacaaattgatattctggaaagtggcggcagcatagtccagcaaacacgactatatgatgcagaccgggatgaaacccgcaccatgcgcagcaaggaagatgcacatgactaccgttatttcccggatcccgacctgttgccagttgttatccctcaggaatggataaaacaaatcagggagaaattaccggaattaccggaagatagacacaatcgctatattcaggacttcggtctatccgcctacgatgcaaatatactaaccgcgggacgtgaactggctgactattttgagcaaaccgtcaaacttctcccggaacaaattaaactttgtgctaactggattataggagaagtcagtggaagactgaacaaggaaggactcgaaattgaccagtgtcccgtcagtcctgagcaactggcaggattgctgcttcggatcacggatggcaccgtatcaggaaaaatagccaaggatgtatttgacagtatgtggcaaagcaacgatgacagtgccgatacaattatcgatgcaaaaaacctcaggcagatttcagatgacagcgaaattgagaaatgggttgatgaggtgcttgcagcaaatcaacaacaagtagccgattatcgtgctggaaaagaaaaagcgtttaattccctggtcggccaggtaatgaaaatgtcaagaggcaaggccaatcccatccaagtcaatacactgcttaaaaaacgcttgatagaataaaacccaggatgaattccagcataccgctcaaaacaaaaaattcaggttcgatagctgtgccagatcgagcctgaatttcatgcataaactctgttttactaatacttattttttcagcgcatcgcacccatcaataaacttctgccgctcggcttcattgtttttgtaataatccagcgctctttccatccctcttcctgcacaattttcaggagatacttcaggagcagcgttaccacagccaactaaagcgacaccaaggccaagagtacagatgatgtagtatgtaaatttcatttaaagatttcctctataaaaatccgttaaaacctggcgcacacgtcaccgttttcgcttgttaaactagctgccaactatccaatatcccgaatcagacattcaatcgttaacgcctgcgaccgccaaacactcgcagctaataaccacaagtcaaatcattttacctgagttctcgcggcttaaaacagtttcaccctcttttcccggaaaatatccacaatgcagcccccggaaaaaccatgttaattgcggtaacatagaagctagtttcagcaaccaaacagaaatccattcaatatcttggcacatagggttgagggaaaaactgaaaccagctgattagacaaacggaacccgtgggtcccgtttgtcatccgacttattctgcagacacagcgattttcttgggttgaacagcttcctgcttaggaatggtaacaaccagcacgccatctttagccactgctgtaatggcgcccagatcagccgtatccggaaggctgaagcgccggaagaaagaaccatgcgtccgctccacccgtttatatccttcctcctctaccttggcctcagtctgtttctcgcctttgatggtaagcatgccgttatctgtagttatctctattgcttcaggttttacgccaggtaaatccgcatgcaaaacaaacttatcttcctcctccttgatatcaacagcaggcgcccattccgcaacagcaaaagcaccttcctcggtcgccatatcatcacgcacccgccccagttcccgttgcaattgagatagtaatccccacggttcataacgcataattgccataataacctccataccaagaaaatatttaccaaaacaggctgtcatttaatccgcatgacatcccgacccaaacatccacctggatacctccaatatcattccaaaacaccagtctggatgatttctaaatatacagacattaatataagtatgccttcagtattttcaagtcatatcccccgaccgatttgccccaagcttgatccgagccaaattcttctatatcttctataaaatgcataagcttcgttgctcggacaactgaaataataaccctgtagtagatagtaatgatgtttgcgtaaaaattccacgtgcctctctgttcccatgccttccacgatcacactcaacccaagattatccccagcgcgataatggctcgggaaatcgcaaaatcagaccgttcatctcccgtatgatcctattcaatgctttgaataaaagattcatctattttcagggcatccagtggtaattcgcgcagcagactcagtgaagattatgtttagtcccacggtgtgctggaatggatcaaagataaaacggaatcaagtggagatatcagacaggctcaaaagcaactcggacatgcaagcgtcactatgacagagcactatattcgcaccaggaaaggtgagaaagtgaagccgaaaaagtaggaatttcggaaatgattaaagattaataatcccgataagtctttgattctttggtgccgggagggggaatcgaacccccatgatgtcaccatcgcgggattttgagtcccgtgcgtctaccaattccgccatcccggctttagtttgtggcaagagggtaattatcactgaaattaccttgcacagcaaccaataccatattctctgtcataacaaaaaaatcaagagcaaaaaaaaacttaaaccagctcatctagaacatatcctgatcacgccttcttcaacaacctgtattctgacgagccatgggaatctatttattttagatctaatcaaaaaagctctatttgcaataaacacgagaaaaatagcaagatctgcgcccatttcacattggtaaccacaggaaggtacaaaccatagccacgaggttttcgtggttttgtttgaatttatcaaagcacaggaccaccgcccggcactgtttcaaccgtgcgaaaatattttctaccaggtgtcggcatcggtacagccctcgatccagatctgcattatctgttttggagttaccccttccctggaatgactgccttggcaccttgttgttcgctttgatcacgtatggcctgactgtcatagtcctttgtctgcaataatggattgaaccgcatccagcctcctggatcgcagagccgatgtgtgtgtgcaatcattgatctgactactggtaatatcgaatgcgatgggaagtccctgagcatcaccgccatgtgaatcttgcaggtattaccggccctggctttttccgattgccttatccttaccgctcgcactgtgctggtgagccttgatagctaccatcgatgaaaacccactccatgtccggctcaaccaccagagcctgaaataccttgagccatttcccgctggcagatcaggcggtgaatcgtttataaaccttgctccagctcccgaatgaaccggtaccactgcggtacagtatgccttcgacagtcgtacagcaaatcttgcttgttgtagaggtgattgtgaagcaaaatggtcagtggctttgaccagagctcagcattgagcagtaatcggggcattgcaagttcgtattgttggtgagagctacgaagatacgagcttacttctttaaatcaatattgagattaaataggaataggccctaaaatttccccaagtagttaaattaatagcgtttttataaagggcatgttaaaaattaagattatggctgagcgatgagatcaacctatgtaaagattcttcgcactcaatgtagttagttagcttaatgcatggctaatatagccgcacatagacagagaggtgacctgcaggcttgaaattaatcctttgggttagaaatagtcctcacagcacagcggttcacggccgacaaaaatcatttcatacataaaaattttagaatttcatgtcagaagctattttgtatgacttaaatgactccgctgttattacatcaaaagcggggctgctttttgacgaggtatctcaatatctcaagcctgaagatatggttttacttaaaaatgcttatttcttcagtcaggaagcacactccggccaattcagaaaatccggcgaaccttatatttctcatcctgttgcagtcgccagaatactgggtgagctccatctggatacgacaacgctcgctgccgctctgctgcacgacgtggtagaggataccggcatcctgaaggaagcaatcagcaaacgatttggtgcttccgtagctgagcttgtagatggcgtttccaagctcgatcggatcaagttccaaactcaagcagatatgcaagtggaaaatttccgcaaaatgctgctggccatggcacaagatatacgagtcatattaatcaagctggccgatcgtctgcacaacatgcgcacacttgaggtaatgccacaagagaaacagctccgtattgcacgagaaacgcttgagatctacgcgccgattgcacatcgcctcggcctggaaaatatctatcaggaactgcaagagctggggttttgtttttcttatccaacccgctataaagttctgctcaaggcaatcaaggcagcaagaggcaatcgccgggaggtagttggaaaaatcctggaagcaaccaaacagcgcttacaggaagctgggctggatgccatggtaaccggccgcgagaaacatttgtacagtatctacaagaaaatggcggggaaacatcttcgtttctcggatgtactggatatttatggttttcgggtggtcgttaaagatgtttcatcttgctacatggcgcttggggccctccatagcctatacaaacccatccctggaaagttcaaagattacattgccatccccaaaccaaacggctatcaatcattacacagcacattacttggaccttatggattgccgatagaaatccagatccgcacccaagaaatgcaccatatcgctgaggccggagttgcttcacactggctttacaagaacaagggtagtcacactgcaatggatgatttgtacatgaaagccaatcagtggatgaaaggtttgctggagaccttgaatgactcatccgattcgctggaatttctggagcatcttaaagttgatctatttccaggagaaatatatgtttttactccgcaaggcaagatattaacgttaccacgaggcgcaaccatagtagattttgcttatgctgtgcataccgatatcgggaattgctgcgtagcagccagaatcaacggtgaaatcacaccgcttcgcacccgcctgagaagtggagatcgcgtggaaattattactgcacctgcagccaaaccaaatcctgtctggctatcctatgttgcaaccggcagagcgcgttccagtattcgctattttctgagaaccattcagtacaatgaatcggtcaggcttggagaacgcctgttgaatcaggcattgcattcctttggtacgagcgcggaagctatcgagccttcacaatgggaaaaactggcaagagagagcggggctaaatccaaggaagcacttttggcagatattgctctgggaaaacagcttgctgcagttatagctaaacgtctcgctaccccatcaggtgaatctatatcaaatattgaaggcaacaactctatcaccatactcggaaccgagggaatggcagtcaaattcgcacgatgctgctaccctatacccggtgacggcatcgtcggattgattaaaaaagatcaggggctggtgattcatacacaagattgctctgcagtaatcagaatcaaggatcataaaaacatagacaatcaactggacgttatctggggaacaaatattgacagaacctttccggtcaatatattcatgacggtagtaaataaaagcggggtgttggccagagtaaccgcagagattgctaaagctgactcaaatattgacgatataacgttggaaaatgacaaagattacaccacgatgcgctttatcctgcaggccagggatcgtcaacatcttgcacaaattttccgcagactgaagcatatcagtgaaatagtcaaaatggggcgcatcagaaaccaataaattaattactctataaaaatgagtgctgataacctgttgcttgatttcacctcacccggggcaatcccccccgatcctgtcgaggagattcggcgaatagttaatgaaacacaaataaaaatgcaagcacttgaatcactactggagaatgaacaagtagaagatgtagcagggtggaaattactggcgatgttttatctggcaactgaccgggtaaatgacttggctaaaatagaaagattatataaaaacatagcaggtgtatctctatctgctggtttaaaacaaaaatacacccgatggtttaatgaagaagcagccagtaatccaattgtatttgagattccgaaaaaaattactgcagaaacattgcctgctaatatgattatccagtgtagccgcagctctcctggcgacatattgcttgatttttccaacgtacaggaaattgataacgacgggctcagaaagcttgcaaaacttttttcctccatggcccaggaaagtatcaaacttgagctgaaacagatagatcactttatcgcccgtctgcaaaataaggcagaggcaagcaccaacacacgtgcgatatgggacgtgttgtttgcctatgaacgcctccaagacaacagaaaagcttttgaagaaaaagcaatccaatttgcgattctttacggaatctcacctccatcctgggaataaaagccggtattactgccgagttttcctttcttcacgaaccttttcaatcagctgattgagaaccgaaattgtatcctgtggaagaccacctactttcccgctggtcagatatttgccatcaatcaccagagccggcacaccagtaagctggtattgccgtgttatttgagcagctctgtttgcctgattctgtacagtaaatgaattgtaagcacctatgaatttatcgcgctcaaccccctgctgttcaatccagttaaacagtgtctcctcttttgacaaatctgttttttcatgatgaacggcatgatagatcttgtcatgaagtatctcaccaagacccagactttctattgcgtaaaaaagcctggctgcgggtgcccagttattacggaaaattgctggaacataccgaaattcaacatcagccggcttgctttccagccagcggccgagatagggattcagatcactgcaatgaggacagccataccagaagaattcgataacttcaatttgttgtgattcggtttccgttagctgaggtgttgaaagcaccttgtaatccttaccttcaatgatttccgcatgaacagttagaattcctgccaggtttatagcgacaaaacccaagagaaagcagataatttttcttacgttcatccaattttcctcgttttcaaagtgacagaaagaatattcacggaatttataccagaaagccagcttatttcaaacaacacaacgacatcagccggagacctttgttatttcagtgcctagttgttgcccgctgcgcgaacaagacttgtcgttatcccgtttgattgtagtgaggcacgaaccctgtccagctcttccattttagtaaatgggccaacccgtacgcggtgtacaagcacattactatcagatcttccgagctgaaccgaagcaataatgcccagcatagcgagttcagccttcattctctcagcatccccagagtttttgaaggaacccgcttgcaagtaatactggtccttggtcacagcagctttttcaggtattctttcgggcaatttctccggagttttcttggttaccgcagcagttggcggcagtggcgcaagatcgaatgtatcctcggctggaggctcctcaatccccggcaagattttatagaaatcaaagcgtgatccactcgtttccgcctgatttgtctggggcgggatctttttttctgctgataacggcggcgacgattgccgtgcggacttcccggatgactggctctgagtctctttcccctgggtaaggaatgggctgggagcctggctaatgtatagccacaccccgatagcgcttaccaggcccaaggtatagccaacaaataagccaagccataaagaactaccgttctttcgtgtttttaccgaatttctggatttataatcccgactcatcaatctttccgtattccattcagctacatcttgcggggcgaagttacccccagcaacgacaacccttttgataacacttggcaaacggctgaaatcagcgccaatcttgctattttaagcgcttcatccggaacgaggaaacgcgtcgaattgtagtaactatgaaattcgcttgccaattctcgcaaaaaaaacgcaacaagatgaggggcgcgttcctttgctgctgcttcgatagtatccggaaaatcaattattttctgtagaagcaccaactcggctggatcagttagcaattccgtttctgccctgccaagtatatccactgcccctccccactgctcaagtacgctgcagatacgagcatgcgcatattgcacatagtagacaggattatcgttactttgtgatttggccagatcaagatcaaaatccagatgctggtcacttttacgcagcacataaaaaaaacgggctgcgtcgttacccacttcctggcgtaattgtctcaatgtaacaaattcccccgaccgggtggacatggaaattttattgccatcccgatacaggacagcaaactgaaccagcgctatttcaagcttatctgaatcaagagacagtgcttcaatagcgccttttacccgggaaatatagccatgatgatccgcaccccaaatattcagcatgtaatcaaaaccacgttcatatttgctgaggtggtaggcaatatcagatgcaaagtatgtatactgaccattctcccgctgcacaacccgatctttctcatcaccaaatccggtagattggaaccaaagcgcaccgtcttgccgatacagcagctttttatcatccagcaactgtacagcacgcgctaccatcccgctatcgaacaatgattgttctgaaaaccagttttcaaactcgacaccaaattccatcaagtcatttcggcaatcattcaactgctccgtcagaacaaaattgtggagataggcataatcctcaccaagaatagactttgccgcggtgataagattgtccaggtattcgtcttctccgtcagcagccgctttagcattgatttcagccagctgttgcgtcggagaatcagagtaatgagcatagcgatcgccgtgtatcctatgtatttccagcgccatatcaacaacatatcgcccttgataagcattgctgggaaacggaagagcaataccacataaatcaaggtaacgcagccatgttgacaaagccagaatatccatttggcgaccggcatcgttaacataaaactcgcgtgtaacagcatatcctgccgcagccataatattggccaggctggcaccaaacgctgccccacgaccatggccaacatgcaacggcccggtcggattagcggatacaaactcaatctggatggtttttcctgcccccagtttactatgtccgaatgaatcagccgcctgcagcactgtaagtaaaaattgctgtttcgctgttttcttcagaaaaaagttaacaaacccgccaccagcaacaaccgtttttcccacataaggagaatctggcaaggctccaatcagcacctttgccagttcaagtggattccggcgtaaacgtttagccagtttcatggccagattagtggaataatcgccatgatccatctgtttggggcgctgcaactcgatttgtatctctgtttcttctggaagaacttgtttcactgcttgagcaagcagctgtacacaatgagatctaaaatcgaagggaattgttgtagccatgacaggaaagtatttcggtaagtccgcattataacggcttgcctgcaaacttgtttgcgtgttttgatgaacagattgaattcggaaacctgcctggagagccttggcaaaggctctccatttgctcgaaccttccttggacttacttttacttttcaggatttgtggatttcatgtgttatccagccagtatataatgagaaattaaaactgttatcgcaaaggacgaaaatcctgatcggctcacaatggaaaatacagaagaaaaattcgaggaagagatacttgatgcctgcatcaagcacacaaaagaagttttagcagagcaactgccgcttgttaaagataaaaaatatgattttgcaccacaattcaaggatttgactattcagctttatctcgttggtgtcatgcagcagttttatgatcaatacgaagcaaccacagcagatgcacaagaaaaggcatttcaagcgctgtaccatatgatggtcaaggatggtgtcaaatccaaccgcgccaaaaagcaggctgtattcgtcagaaaaatgtctgtactggaggatggtgatgaagcgctggcactcgcattgggctatgaatcaaaacccggtgatcatagcctggctgaggtctttgatcattatgtcggtgaagccagagtatcaaaaggactctggcactcctatgatcaaggaaaaatcattttattactgggtggtttgctctttgccatggctggtatatggttcgtaacaatctatcttccggaaagcgatggcgtcaccattctggcgatcgggttactgacggcatttctgttcataacgcccgtgttcctgattggcctcttgatttatcgctacaaaacaaaaagaggcaaacgctccaaaactccgcctctttaactgagtagcccttggagaagaccagaaacgtataaaaaatttgccaggagaaaaacattttggcgaaaatttcctaaatcagccttactgatttaagcaggctatttacctgctctattcgatacctcctgaattttatgagtgcaacgattatcagcggtaattttatcgcaagcaaactacgcgaagaactgaaacaacgtgtccgaatcctctcggaaacatggatgcaacccggcctggcagttattctggcaggagacaatccggcatcttccgtatatgttcgcaacaaggcaagaacctgtggagaattgggtatccactccaaggtttttaatttctctgctgataccccccagaaaattatattacggcagatacaggatttgaacgctaatcccgaaattcacggtattctggtgcaattgcctttacccagccatatccagatgaatgaagtcattgccgccatagcaattgaaaaggatgtagacggatttcacccctgcaatgtaggcgcattggcaacaggacacgccttgtttcgtccgtgcactccctttggcgtcatgaaaatgctggcggaatatggcatcccgcttcaggggcaacacgcagttgttgtcgggcgcagcaatattgtcgggaaaccgatggcgctcatgctgctggaacagggcgcaactgtcacaatttgcacctcacaaactcgggaactagccagccacacccgcagcgccgacattatcgtaatggccacaggcaaagcaaatttactgacaagtgatatgatcaggacaggtgcgactgtaatcgatgtcggtattaatcgtctggcagatggacagctttgtggtgatgtcgagttctcaggcgtaaaagaaaaagcaggatatatcacaccggttcccggtggagtgggaccgatgactatcacaatgctgatgaataatactatcgaagctgcggaacacgcgaaagcaaaagctcagattgaagctcggtgcggttctatgcagtaatcttgaacttgtagacttgtaaacagggagcagaccccaatatggatccactggatatcgacccccaggaaacacaggaatggctggatgccctggaaacggtgctaattaacgaaggggctgagcgcgctcattttctactggaaaaattggtggaaaaaacgcgccgcaccggcgcctacctgccctatagcgctaacaccgcttacatcaacactattccaactggcagagaagaacgttcacccggtaaccacgcgctagagcatcgtattcgctcctacattcgctggaatgcagcagcaatggtattacgcgccaaccgccataccaacgttggcggccatattgcgagctttgcctcagcagctacgctctatgatgtcggctacaaccatttctggcgcgctgccagtgaacagaaagaaggagatctggtttacgtacagggccactcttctcctggtatttatgctcgtgcttttctgttagatgaactaactctcgagcaaatggataattttcgccaagaagtagacgacagcaacagtctttcttcttatcctcatccatggctcatgccggatttctggcaatttcccactgtctcgatgggcctggggccacttatggcgatctatcaggcacgcttcatgaaataccttggggcgcgcaacctggctaaaaccgatgaccgtaaggtctgggctctcatgggtgacggcgaaatggatgaaccggaatctctgggggcagtttccttgggggctcgtgaaaaacttgacaacctaatttttattatcaactgtaatctgcagcgtcttgatgggccggtgcgaggaaatggcaagattatccaggagctggaaagtacctttcgtggcgctggctggcacgtaatcaaggttatatggggttcctactgggatcctttgctggcaaaagataccaagggattactgcaacaacgcatgatggaatgcgtcgatggtgaataccaggctttcaaatcacgtgacggtgcttacgtgcgccagcacttcttcggaaaatatccggaactgctggagatggtcgccagcatgtctgacgacgatatctggcgattaaatcgggggggccatgatcctcacaaggtttacgctgcctacagtgaagcaatgaaacacaccggccaaccaaccgtgatactgaccaaaacgatcaagggttacggtatgggtgaggccggtgaggcgcaaaatatcactcaccaacagaaaaaaatgggtacgacctcgctgaaggcatttcgagatcgttttggactgccagtaccggatgacaaaattgacgagataccctatctcaagtttgaagaaggttcgcctgaatacaactatatgcgtgagcggcagcaagcaatgggaggtttcattcatcgccgacgccgcaaggccgaagctctacaagtaccaccgttatccgcattcgagacattactcaaagcaagcggtgaggggcgtgaatcctccaccacaatggtatttgtgcgcatactcaacatcctggtaaaagataaaaacatcggtaagcacgtggtgccgatcgtagcggacgaatcgcgtacattcggtatggaaggcatgtttcggcagctgggcatttggtcatcagtaggtcagctttatactccggaagatgccgatcaactgatgtactacaaagaagacagaagcggacaaatcctgcaggaaggaatcaatgaagcaggggcaatggcatcatggatggctgcggcgactgcctatagtacacatggtgtgcaaatgatcccgtgctatattttctactcgatgttcggtttccagcgggtgggtgatcttgcctgggcggcgggcgacatgcgctgtcgcggcttcctgctggggggaactgccggtcgtaccacgctgaatggtgaaggattgcagcatgcggatggccacagtcacctggccgcctccacaattccaaactgtgtatcctacgaccctactttttcttatgaacttacggttatcattcaggatggcctacgccgcatgtaccaggagcaggaagacgtctattactacatcaccgtgatgaacgaaaattactcgcacccggaaatgcccaagggtgccgagcaaggcattctgaagggtatgtacctgttccgtaacgggaataaacataacagcaaattgcatgtgcaattactaggctccggaacgattttacgagaagtaatcgctgcggcagatattctggaaaaagattacaaaatctcagcggatatctggagtgtcaccagctttaaccagttacggcgggaagcacttagcgtttcacgttggaatctgcttcatccagacgagccagccagactatcgtatgtagaaacctgtctgaaagatcgtgaagggcctgttattgcctcgaccgattacatgaaaatagttgccgatcagatccgggaattcattccgagtcgttaccgcgtactaggtacggatggattcggtcgctcggatacacgcgagaaactaagacacttctttgaagtggatcgtcattacgtcgtagttgcggcgctcaaggcattggcggatgaagaaaaaatttcggcatcagaggtaaccaaggcaatccgggcctttgcgatcgatccggaaaaacccgaaccggtcaaggtttaagctcgttcacaattggtagaataattttgtctcaccctgacgatatttgttgcagcgaatcaaggagcacatgtggctgaagtcaagaaaattctggtcccggatatcgggagttttgaagatgtcccggttatcgaaatcgtggtcaagcctggcgatagcgtacaggctgaagatcctttaatcgtgttggaatcagacaaggccacggttgaggtgccctcgccttactccggaataatccgagaaattatgcttcaaccaggcactaaggtctctaaggattcagaaatcctgactatggaagtggtatcaaatgctgaagaaaaggtctccaaacctcagccatccgggtctccatccgaaccacaacccgcacgaacagaagcagcagccgaaccaaatcagcctgaaactataccggtggtcaaatctacacccaccacagcagcgaaaccagcgacccctccttcttcattgccgaaacttgatcaggaagtcggagcgcatggtaagacaatgcctcatgcaagtccctcgataagacggtttgcccgggaattgggagtggatctgaccagagtagttggaaccggccccaagctgcgtattctcaaggaagatgtactggctttcgtaaaacaggtattagctagcgaacacaatactggaagtgtgcttaacctactgccctggccatatgtagattttgcgaaattcgggccaatcgaactgaaatcattgtcacgtatccgacaaatttcaggtgctaaccttcatcgcaattgggtcatgattccgcatgtcacgcagttcgacgaggcagatatcaccgatctggaagcgctcagaaaaactcataatgaaacccggcagaataacggcaccaaactaaccatattagcttttcttatcaaggcggttacagcagctctgaaaaaattcccagaatttaacgcttccctggacaacagtacagaggaaagtcaactcatcataaaatattactaccatttgggatttgcagtcgatacacccaacgggctggtggttccagttattcgggacgccgatcagaaaggagtaatcgatatcgctcaggaacttgccaggctatcctcacttgcccgtaaaggtaaattaatgcccagtgacatgcaaggtgcaagcttcactatatcgagcctgggaggtatcggtggaaccggctttacacccattatcaatgcgccggaagtagccattctagggatatcccgtgcaagtctgaaaccggtttatcagaatgaaaaatttgttccacgcctgatactcccgttctcgatatcctatgatcaccgggtaattgatggtgcagcggccgcacgtttcactacacatttggccagcattctgacagacatgcgacttgcgctgttctgagtgatgcacaaccaatcaggcaatgcggtgcctgattgtctatttatcggcaaatggctgaagtaacagcatactcactcatcggaatttacggtggaacatttgaccccgttcattatggacatctgagaatagcggaagaattgacaggaattttacggctaagccatctgttttttttacccgcaggccagccccggttgcgcgatacgcccattgtacccggagcacatcgcgttgccatgttgcacgaagccattcgtggaaatgctatgttttcagtggatgaccgtgaaatcaaacgatctggtgaaacctacagcgtcgaatcactgcaagaaatccgacaggaatatcaagcgaaatataaagcaggcaagcgtattgcactttgtttcattattggagccgatgcctttatcaggctgccacactggcaccgttggcgtgaattgtttgaattgtgtcatcttattattgtcaatcgacctggatcagctctgctcaacaatctgtccgatctacccgatgaattgaaagctgcttgccagactcgccaggcagttacggtcgaagagttgaaaaatttgccctgtggccacatctttactacacccacaaccttactggatatttcatccaccaagatcagaagcctcattgcttcgggaaaaagtgcacgctatctgctgcctgaagcagtcctcgactatattgacaagcataatttttatgccggagaaaaatgaaattacctaacgaacaacttgaaacagtcataatggctctggaagaccttaaggccagcgatatccatgtcataaatgtcagcaagctgactgcattattcaataccatggtgatagccagcgccgattccacacgtcagaccaaggcactggcaggccatgtacaagaaaaggtaaaggcagctggaaggatcgtttacggaatggaaggcgaacaaacaggagaatggatgctagttgacctgggcgatatcgttgttcacatcatgcaacccgctatccgtagttactacgacctggaaggactctgggcggaatcatcctggcagctaccacaggaaaattccgctgtatacggttaactcatggctgcgaaaattggttttaaaataacgtagcctcttcctaaacctgttcattcctataaatttcgcacgcttattattctgcatcatgaagctccatatcctggcggttggcaataaaatgccggactggattaaaaaaggatacacagaatacagccagcgcatgcctaaagaagccgagatgcagctggtagaaataaaaccggaaaagcggatcggtaaaaagaccgagcaactattgcaagccgaaagtgaacgtatccgtatcgctttaccgcccgggtgccatattgttgttctggatgaatcaggcaaacaagccaccactgtcaggctggctgaactgatgaccaattggagagaatctggccgggatgtaacgttcatcattggcggagcagatggactgcaccgggatattaaacaaatggctcacgaaaaactggcgctttctactatgacattgccgcacgggctggcgagagtattgctggcagaacaactttatcgggcattttccatcacccggaatcacccctaccaccgtgcataatttgtaatcctgctgtagagttccagctacaagtgcacatttgcttatggaaacataccttaaggcttgatccgggaatgattactacagctggcagttatatttatctggtatcacgcagtgctcgcagacgcgatctgctcaagcagattggcatcaggcacaccatattgctcatgcgggaaaccttatcccgcccggttgacgtggatgaaacacctgttccagaagaatctccagccgattatgtctacagaattacccataccaaagcagaagctggctggctacgcctgaaacagcggagcctgcccgttttgcctgtactggctgcagatactattgttgttctggacggtcgtatcctgggaaaaccaaaagataccggacatgcggaggaaatgttgcgcgcactctctgggcaagaacaccaggtgcatacagcagtagggctggcattccaggggcagatcaggttacgtttatcaacaacaatcgttcgattccgggatatcagtccgcacgaaatccgggcttatattgccagcaacgagccgtatgacaaggcaggtgcctacgctattcagggaaaagcagctgctttcatcatcaacatcagcgggagttatagtagtgtagttggattgccactatttgaaacctcccagctactggaagaaacaggaatccccattttctgaacaagaataaatataatcggatcccagtttatatgagcagcgagattctcattaatgtcaccccgcaagaaacgcgtgttgccatcatagaacaaggaatcacacaggaactgcacattgaacgcaccagcagccttggcattgtaggcaatatttataatggacgcgtcagccgtgtattgcctggtatgcagtcagcttttattgatattggtcttgaacgggcagccttcctgcatgtggcagatatccatgaatccggccagactgagcacaataagccgatagagcaactcctgtctgaaggcagcaacatcctcgtacaggtcgtcaaggatgcaattggcgtgaaaggtgccagactctccacccagatcagtcttgcgggacgtttgctggtctatttaccgcaagaatcctatattggtgtatcccagcgcatcgaagataacaatgagcgcgaatcgttacgccagaaattacagagcattcttccacctgattcttccggcggctacattatccggaccatggccgaaaccgctgatgaatcagagttacaggctgatatcgattatcttcacaaactctggcaggacatccagaaaaaatcattaaccatttctccgccttccctgctttatcaggatctggatctgagtcatcgagtattgcgcgattttgtcaatgccgacacctaccgggttcgggtagattcacgcgaaacttaccaaaagctgactaccttcgcccaggaatacatgatgagtgacatggaaaaaatcagtcactatactggggagcgaccattattcgatttatacagtgttgagcaggaaatcgaaaaatcactggccagacgtgtcgatctgaaatctggcggatatgtaatcatcgaccagaccgaggcgctgaccaccatggatgtcaacaccggcggctttgtcggggtacgaaattttgatgacaccatattcaaaaccaaccttgaagctgctcaggtgattgcacgacaactacgactacgtaatctgggcggtatcatcatcatcgattttatcgatatggatcgcgaagaacaccgggctgcagttctggctgagtttaataaagccttgcaaaaggatcggactaaaatgactgtcaacgacttcaccgcactggggctgatcgagatgacccgtaaacgcacacgtgaaagcctggcgcaaatcctttgcgaaacctgcccgacttgccagggacgcggagaaatccggacagcacaaacaatctgctatgaaattctgcgtgaattgttacgggaatttcggcagttcaacgccaaagaatatcgtattctggcctcacaacaagtaattgatctctttctggatgaagaatcccagagcctcgcacaactgggtgatttcattgccaaacccataggcctccaggtaggtacgacctatacgcaagaacagtatgacgtcatcctcatttaacctttcttctgcgacaatatgtcgcattgcaacccgcactaggctggtctaaaattttcagacaaagcgatgaggagattgataatcgttatcaattctgatagcatccaaaattaatatacaagcatgttcaacttgactagcttaagcgttttagttttcgcaacaccaaacagttaactctaaaatcgcgtaaacagaaaacacacattacatacatggtatggctaaaatctatcataaaccggtccttactggtatatctctcatcagcttcctggtagtggtagcagcgcacgccaccgtactttacggcatgtggcaatatcgcttcagtgctacagctccagaaacaatcacactttacgcgcagttcattgcgccacctgaaaaacaggaagaagttgccgaagcgcccaaagcggagctgaaagcagaacatatgcctcctcaggtaaaacccaagccaccaatcaggaaggtacaacctcaacctaaacgccagctggtagccaaggcacctgctgttacccagcaggaaaaggttgtgcccgagccacccattgaagaacacaaaccggaaccagaaccggaaaagaaaatcgtcaatgaaacggtcgctgcagccaaacctgcacagatgccagcaggtccggttaccctgtcttccgaattgtctgtatcctgtccggatctggccagccctgcctaccctgctctatcccgtcgcctgggtgaggaagggaagctgatactccaggtgaagctggatgaaacaggtcgaataagcagcgccaaagttgtcgagagcagcggatattcaagattggacaatgccgccctgtctgctgtcaaaacctggcgttgccggccagcaatgcgcggtggacaagcagtaccagcaattgccctgcagccttttaattttgtcatcgaaggaagttaatagatggaaaaaacactggggttctctaattttctgacacaggttgactctgttggaatgagtgtgctgatacttctacttgccttgtcagtcgcaagctggtacttgattgtgaccaaaagtatcagcaatatgattgcttctcgtcgcgcaaaagattttctcaagcatttctggcatattgattctgtgccccagcttaaaacagagatcagtgcgatgactgatagacatgcgtttgttcagctggctaaaacagcattgactgccactgcagattcacaaaagcacggactggagaaactggcagcagctggtggtacaaacgagctgctcacccgctcgctgcgcaatagtctggatcaggaagcggcccgtattgaatatggtctcaccatcattgcttcagcaggctcttctgcaccctatattggattgttcggcacagtctgggggatttatcatgccctgatccagattggcctgtctggtcagggtacgctggataaagtggctggtccggtgggcgaagcattgatcatgacagccctgggcctggcggttgccatacctgctgtactggcctacaacgccttcatacgacgcaaccgcctgtggatggcccaactggatgacttcgctcatgatctctacaccatcatgacaacaggcagcaagtccagcgaagaaaataatcaaaaaacacctcaaaaagaagcatcaaccatctcacagcatacccgggtaacagaaccgaccaatctatcagcagacgttatcagcggagaggggcatcactaatggctttcggtgattcaacccgttatcagagcaagacggccatgactgaaatcaacgtggtaccgctagtggatgtaatgctggtattgctgattatttttatgattacagcccctttgctcacacactcggtaaaagttgatttacccaaggcatctagcaccctcaatcaaacccaaccggaacatattgaatttgccatacatgcagatggtagtttttactggggtggagaacctgttacgctggatcagctacctgcacgctttgccgaggcagttaaacaatccgataaaactgagttacatattcgtgctgaccgtgacacacattatgaattggtaaccaaggtcatgagtattgctgctacggcagggctggcacgcattggttttgtgactgacccaaccgagaatcaaccctgacaaggactggactcatccatagaacaggaatcggatacgcagttaacctcaaaccactacacccgcagttcaaacaacttctttcgcagaaagtgagttcaacccagtttttgccttttgaacatgctgacggcaggtttcaaacaggcatatgccggcactgactgatacattcaaactttcgatactgccgctcatagggatacttacaagctgatcacaggtttcccgagtcaggcgacgcattccctcaccctcggcacccaatacccaggcaataggtcttgtcagcgtaattgaatcaagtgtgtcggatgcatcagcagttgtacctacaatccagatgccctcctccttcagttcacgcaaggttctggccagattggtcacagcaaaaaagggtacagtatccactgcaccactggcaactttatgaaccgttgccgataaaccgactgccctatccttggggactatcaccgcatgtacaccaaacgcatcggcaacacgcaaacacgcccccagattgtgtggatccttcacgccatccagcaccagcagaaatgccggcccggtcagtccatccagtaaatcttcaagcgcagtgtactgctgcaacttcatcacatgggctgccacaccctggtgacgagtcgtaccggtcattttacaaagccgatcctgattacagagaatcagacgtgaggaagtggtttcagccagattcatcaaatcacgcgcacgctgatcctgtcgattggtatccagataaatttccttgatgctgtccggatgttgccgtaaacggctggtaatggcatggaagccaaaaatatactgggaatgagacatgatggcgatgaaaaatgaagaagaatattatttgcttgatttcttgcgtgcattgttattgtctgcaaggacaaaatctatcttgcgggtggccagatcgacccggacaagttttactcgcaagttgtcacctaaccggaaactgatcccgctacgttcaccacgtaatacatgcttgaccgaatcatgccgaaaataatcactgggtaattctgaaatataaaccagaccttcaacataaatagcgctcagggtaacaaacaacccgaatgcagttaccccggtgataacgccatcaaagcaatcattaattttatcctgcatataaaagcacttgagccaagattcaacttcccgcgtagcttcatcagcacggcgctcagtttgtgagcaatgttttccaatctcatgccagtcgccagggtcatagtgcttgccggcaagcactgccttgatggcacgatgtaccagcagatccgggtaacgccggatgggtgaagtaaaatgggtatacatttcataggacagaccaaagtgcccggcattatccggactgtacattgcctgactaagagaccttagcatcactgtttgcagcaattgtgcgtcagtccgttcccggatatggtcaagtgtcctggcataatccttagcgctgggcttatcgccaccacgtaactgcaagccgaattctttcagaaaatctcgcaacgccaccagcttttcatcggacggcccttcatgaacccggtataaaacgggctgttggtgtttctccagaaaatcagcagcacacacattggccgccagcatacactcctcaatcaagcgatgagcatcattacgctctactgggcatattctttcaatcttgccctgattattgaaaaccatttctgtttcaatggtctcaaaatcaatcgctccccgttttctgcgggatttatgcaacaccttgaacaaccggtacaataattgaatatgcggtagcagttgtgtatattctgttgcggtattccctttgggctgatccagcaactcggcaacaatgttataagtcaagcgcgcatgggaaagcatcaccgctggataaaaacgatattcgctcagctcccccttggcagtccacagcatttcacacaccatgcacagccgatcgacctgcggattgagcgagcacaacccatttgaaagcacttccggcaacattggaataactcgtctcgggaaataaaccgagttgccgcgatcaaatgcttctttatccagcgcatcctgatcgcgcacataatggctgacatcggcgatggcaacaaacaatctgaaatccttgccttcctggcgacaataaacagcatcgtcaaagtctttggccgtttcactgtctattgttaccagcggtaaatggcgaatatcttctcgcttggcaaactctttcttcagaaccttcttgggaaacttggtggaaatgatttctggcgaaaattcatggggcaaatcgaatttgcgcaatgcaatttcaatctccattcctggagctgcataatcccccagaatctcaacgatatggccaataggctgagcgtgttggcctggctgctgaataatgttcgccatcaccacctgcccagcatgcgcattcatgatattttcctttgggacaagaatatcctggttaatacgtttatcttcagccacaataaaaaaaataccgtgatcttcatataacctgccaaccaagtgcgtattaacactttccagtactctgacgattctgcattcccgccgcccccgccgatccacgtcattggtaagcctggcaattacgcgatcaccatgcagcactttatgcatctcttttggggtcaggaacagatcagtactgccatcatctggaatcaaaaaaccgaaaccatcactatgtccctgcacggttccttttacgagttccagcttgtctgttacacaaatatcacccttgcgattacagataatctgcccgtcacgtatcatcgcagacagcctgcgatgaaaaaattcagattcttcagcagtaatatccaacaactcaagcaacttgggctcgctgattggcactccctgtttatccaatacttccaggataaattctcgactgggaagcgctaacccgtaacgtgtctgctcacgcttaagaaaaggatcaagctcgcgaagctgatttttcttatttctttttctcttgattgacaaatcgaaggtttcctatagaatttgcgatcttcatgtgttgtttatacctgcctggttttcacaaaaccaaccagcaacacagcaataatcaaaataatgcccagatggcggaattggtagacgcgcatggttcaggtccatgtgccttcgggtgtggaggttcgagtcctcttctgggcaccattgtactttcctcaaaaaataacacatggcattaacttgtattgtatagattctctagtgaagccagtgtaatttaattaggcagtattcccgatacacgcaatcaatatctggcaaaccctcgacttccatatcttcagctctacccggttgaccgctcgaattactccgtaatttttgcaagatgacaataattttatcagccacggcaacagcatcgatgtaaaggcaaaaacacatcgtatcatcaaatgtacggatatctggaaatacatcaggcctcaaacgaataccattaaactactttctcttacaatatcataccgtcaaatttcgccagtacagcttgggcagccggcccgattattttcacagccagtgattacagcttttttatacactggaatctgctcaaaaacattcttgcttcatgaacatgaaaaatcgccgcatcgctcatctggatatggatgctttttatgcttcggtagaactgctgcgttatccggaattacgagggttgcctgtcatcattggtggccgatccgttcaccaaccaatcatgcaacagaatggaacttgtttatatgcaaagctgcgcgaatattccggtcgtggcgtagtaacaacttcaacttacgaagcgcgtgcatacggaattttttcagcgatggggatcatgcaggcggcaaagctggcacccgacgccatattattaccagcagatttcgatacttatcatcattattcgcggttatttaaaaatgcagtcgctaacatcgctccgcatatagaagatcgtggtatcgatgaaatttatatcgacctgagcaaacatcccgatgaaacaactccacttgcactgcgtatcaaacaggcggtacacgaaaccactgggttatcctgctcgattggagtagcccccaacaaactgctagcaaaaatctgctctgatctcgaaaaaccgaatggattgactatcctgacacatgttgatatcccacatcgaatctggcctttgcccgttcataaaatcaatggcattggccccaaaacgcaagcaaaactcgcagatctgggtatccataaaattggagagttagccaatgctgagcccggtttgctccaggttcactttggtcagcgttacgcactgcagttgcatcacgcagcacttggcaacgatgatcgtccagtagtaaccagctcggaacccaaatcaatcagccgcgaaactacctttgaacgagatttgcacgcacgccaggatcgggaaaaactatccgctatttttaccggattatgcacacacattgcggaagatttgcaccacaaaggctatgtcgggcgaactatcggcatcaagctgcgatatgaagattttcaaaccgtcacacgcgatcaaactttatgtacccccaccgctgatgcaaccaccattcgcaaggctgctggaaactgccttcggcgcgttcctctcgaacaaaaactgagattgctcggcgttcgtgccagcaacctgtcccgagctgatgaactcatgaaagaaagccatcttttccaggaagaactgttttgtagccaatagaaagcccttattctgtaaatttatctgcagaatatcccctgaaaatccctgtgagttcactaaatatctagaacaccctattgattctcacccgccatatttatgaaataagcacttggcataacccggcaatccagtaaaatcttttatccgcagtcggtcaaaaggaaagccatgaatatcacagccatcagaatgatacaaagaggtttttcattctcttttcttattatggcccatcgggagcctggctgacacacgccctcttcaattttcacttcattaaaacactactttttcgtttgaaaataccagtgatggaggttgaaatagctatgaaagtctgggttcattggatgagcaagtatcagagacaagctactcacgacattattactttcctaattgaacaaggaatcgaaataaaagaccatgatgattatctttctggtcatcctggcgtagttttcagcaaggaaatcacatcggaaacttgtgaacaattacgtgaacttagtcatagcgggcagataccgactcttttctgttgcgattgtgccatttcgggaaatactatctggcagcttctggaagcaggtgcctgcgatgtcttgacgtgtacagagtacaggataatcatccatgaaatcattacccgcctgcagcgctgggaaataatagattgcatggtaaattcacctgccgtacagaatacgctagtaggagaaagttcggccctgaaagcaattttgcgccaggttgttgaagtagctcattttaccgattcttcagtgctgatcctgggtgaaagcggtaccggcaaggaattgctggcaaatctcattcacaccctggacgctcgcctcgacaaaggtgatctggtaatactggattgcagcactatcgtgccggaattatccggtagcgaatttttcgggcatgaacggggcgcgttcacaggtgcggtatcctcacgggatggcgtattcgcacttgcaaacggtggcacattgttccttgatgaaataggcgagttgactctcactctacaaactcagctgctgcgcgttattcaggaacatactttcaaacgtgtcggtggtaatgcctggcagcgcacctcatttcgcctggtttgcgcgaccaatcgtgatctccgggctcaagtccaaaaaggtgaatttcggacagatctctattatcgtatcgccagctatatctgccatttaccccccttgcgggaacgcactgaagatatcctcccgctggccaggtactttctgaagacagatcatcctgctcaggatccacctgagctagatacaccggttcaggaatatttgctgcgccgtgaatatcctggcaatgtacgggatctcaggcaagtagttgcacgcatgctatgccgctatacaggaaaaggcgctattacagtgggctgcattccgccagatgatcgaccgacaaaagcagaaggctggaaagaatggtgcgactcaggctttgaacgggcaatccgagtagcgctaaaccggggtatcggcctgaaaactatcagccgaaacactgaggaggcggtatttcgcatcgtgctgaagcaagtaaacggcaacacccaacaggcagcgcaacttttgggagtaaccgaccgtactgttcagaactggaagaaagatagatcatcgaccggtaaggctggaaatactttgtaatcgtttggccaagctaatcagcggccgcttcaccacccacttaccaatgacagcgttcggggacgcttgactgtactgatcagattccggaaattctctcccagaatcaaggcttcttgagaagacggcagacgtaacgccctgatcttgacaagctcaactccagggtgtagccacgggccgtcagaaccaaacagcagcttggctgctccagctcgtttgactgcttgttgtagtaaatcaaagcgccgcacgccagaggtatcagcatatatattcggatgacgaaccagatgatcaatcagggccaattgcgcccgccagtcatcagcaaagctacccaggtgcggaataatgaaattgacatccggatattcctgcgccaacagctcacagacagatacttcacccgccacatcgtacagtaccggcaaggtataagcccgggcagccacacaaatatcgcgtgtaatggcagcatcatgacgatgtatcttgatgccaacaaatccgtagcgcttgacagctatctcgaccagcttatgcacgcgtcctcgatcacgctctgcatgtataaaagcaaaaccgtagaagcgatcgggcctgctcgctacaatgcgtgccacctgctgattggcagcggcatagtttgaatgaaacgcagaaaacaataccgtgcgccgaatccctgctaccgttgcccggcgcaaataatcctgcaagggcgcccgtgtatcccacggtccggtcagtccatcgccgcttccggcatgacaatggcaatcaatgatcatcacaacctccttgctgctatattattttgattgcccggtacgcgggatcaatgtgccccaccgactgatttccgctactggtttcaaacgaagagctcttcaccaagctcaggctgtttggcttttccccatgttcgccaactatcggggataggattgccgctaccaattttgaaattttgcccgccatcccgtaaacccagattattgattgcccattgaccaacgtgataccaaatatccggaccaggatcgttttcacgacttgcactggattgtcgatgtgccagaatatgagtaaggcccatgtttttaacaagataacgaatcaaacaacgtccggccttgatctgttcggcagtcagaaccccttgaggtgatgcgccgttcggataaacatagcgtttaccccttgtatcaggaaaattacccgcaaattcaacggctacactgccagcattaaatccatttgaagcattgaggcgagctgtcaatggatgcaattgtagtgtttgtccattcggcttgattacaaaatgtgccgtgacaccatcgtaccggtcgggtggcgtattcctctgattgccggcagtctgatgcaacaccagtgcgtataccttactcatatcgcgcggttttcctttgcgcttgtctttaggcgtaaaacttgtgcggtcttcgataggcgtacaatcatgcagcatattgatcaccccaccggagagcctacgagctcccgtgctaatcgagttccatgcatcaccgagaaatgcttcctgattggattgcctcggttgaatgctattgacgtgccattcacgatgagttgtatcgcctacctctaaatttcctcctcgaaccactgcagaaagatttggcacatgcatccgggctgcggccgtcaaagcagcattggcgattgtttcaggatcagtacgcgggtcagccaaagctgcctgcctggctgctgtcgcagcaatacgcacaaaccgccgtgccatttccagttcggcttcttccgaaggcaaaccactgaattcaagctcaagcgctttactgacagccgttccgatagcaccgccgatagccgtaccgacacccggtatcggaataaaagatcccagcgccttgccaacaattggcagtgcaaccttgccaatcgcttttaaacccctacccaatgcaggcaatacttttttgccaacgaaacggccaaatttcttcaatcctcggccgatccccttgaataacttgccaagaaacagatccagttcttcttcactggaaatggccagtaattcggcggcaagctcaagttcctcagcttcgctgaaagggctttcgaatgcgagttcaagctcccgctgattggtgatcaagccggtcggattcagagcagtccggagatttgcttcgattgctttatgttgaggagtcagtacccagcagaaggaataattatcaggattaaggccaaaggatattacatcccggtgatacccctgcatccggtcataaaggttcccggtctcgccaacataaccgatatgtccgctggatgagcgattacggaaaacaagcagatataccccccgctgccggggcacacggcgatattgcgaaagccggtaacatcgtctggtagcccagagtttctgatctgccggtgacatgtgacgcagaagtttgctgtagttgtcccggaatgcagcgagcaattccatctccatccactcactctcataacccgattccatttccttcactgaaggctgaatattccggctctcacaagcagacctcaatgcctcttccgtatccggcccggcaataccactcaccctcaacccttgctgccgctgaaaactccgcactgcgctgcgtgtatctgcccccataactccggtcactggaagtcgcattccggccgcctgattcagacaatcctgcagccagcgcacgcgctccgaaccggacgaactgtccggttcagcgggataaggctcgctcacgaccggataaggttcataaaggagggcacccccgaaaggccgccgcaaccccttgaagggagagcgtggcctggaaaccggaaacaatggacgtttacttcccgttgctctcaaaccggagtgaaaaccgggccgcgcactatagcctctgggtcttgttggtgaacggcggattcctcgctctctttccacttcaaactcttctcccgcaacttccggaatcacctccagcggtatggttttaaatcttaatccctgattcatgatttacctcttgtatatagtgatcactttataaagtcagagtatttggtttcctatagtggacccctccgtcaagacaataatgtatcgagtttaagagggtaaccttcttcatgcagcggaacggcgctgccccggttttcggtttctttttttgtttctacttctgtgtgagatttttctttctcactatatttgtccacaatccttgctccgccaccactcgctgtacggtatacctgatctggcgtgtcgtagcccagcgattggtgcggtctttctgtgttgtaaagcacaaagtattctgtcagacctatcagcaattcaggcatcgtgatgtaacctttcagatacacgtcctcgtgtttgacgctgcgccagagccgttccacaaagatgttatccagtgcccggccacgcccgtccatgctgatggcgatttctttttttaacagcacgccagtaaaagcttcgctggtgaactggcagccctgatcggtgttgaatatctcgggcgttccatatgtctgcaatgcctgccccaggcagtccacacagaatccgctatccagcgtattcgataactgccacgacagcactttacgcgagtaccagtcgatcacggccaccaagtacacgaacccgcgtgccaagcggatgtatgtaatgtccgtactccatacctgattggggcggatcacattcacgcctctgagcaggtacggataaactttgtgctgcgggtgcgggcggctggtattcggccccggcgccatgccggcaaggcccagtatgcccatcaacctctgtacgcgcttgcggttgatcttgtaacctaaaccacgcagataatgcttgatcttgcggctgccgtaaaacggatgacgtgtgtattcggcgtcaattagtcccagcagtgccaattcctgctcgtccggttttgcggccatgtgcggcgcatagaccgtggagcggttaactcccgccagttcgcattgccgggtcagcgccagtggttcgatggcgctgacccattgcttgcggttttctactggctgatcccggacttttttttgagccagtccagttccatcttcaaccgcccgatctcggaatacaggcgctccgggctagctgacgggtcggcaggctttgggccgcgcttggaatcaaacaggctggatgcctgctcttgcagctccttcttccacataccaacctgtgtcggatgaaccccaaactcctggccaatttcgttaaccgtcttgatgccacggaccgcttcaagtgctaccttggccttgaactcgccactaaaattcttgcgcttcgtttcgctcataacctgctcctcagttgttgcagcaggttaccaccttaatttattgtctgaaaatcgggggccactatattcctttacgatgagcgtttcttcaaaaccatgtatcgctgtagccagcacatcaatgcagtgatcaatttctccggcagtatggcgtgctgtcattaaaaaactcagatgaactacactgctgccacggggacgagacaatacggtttgaataccctgccgggaaagaaactgatgtacccgtactgcctcgtttccatcgatccctcgcaaaatttgaacgggaaaccagccaccaatcgtattcaaccccatcgctgccagaccactacggaaccggataacccgttgcgccagtctctgccgcagccaatcaccctgtgatcgattcacaatcagcgcatgccgggcagcctgaatgacagccacagacggcgggctgccgtgcacccgggtgtcactcgccgttttaaatcgtttgatcagctttctactcccggtaagaactgcaaccggaacgcccaaaccttttgccagagatgaacccactataatgtccggcccggagtttccactccagcgcaacacaccaccgcctcctttcccataggggctgtgtaatgccggcatttctcccagaattcccaaagcctgggtatcatccagcaccagtacgccgccaaaatgcctgacgatttccagatactccccaactggcgcagcacaaccgcacgccgggcaaaaaccatcggcaattgccaccggatattttcttctgccatacgcaagccgcttgatttgtgtcaacagcgcatcaggatcatgatgacggaaagtatgaacttctcccccttttgcacggaattgctccactccccaccgaacaactgcataagtcccttcatccagaaacaatgccgcccgctgctgaaacagcatgccaaacaaatcccagaacaagtgcaatgtggaaggcagcaacaccccctgttcacaaccctgcaactgcgccagttgttgcgcaacttcaccggcaccgggcggttcagtaagtgctgccggaacccccaatgagagttgctgccacggctgcaaaagccggcttggatgatgcaaccccaagtagagtgccgaggtgaagttgatcatggccatgcatctcagatagttcgttgctgactggccaaacgtttctgcaatagtgctgagggcaaagtcgaatcaacccgggcactgacagtcggatcggctgataagtcaacacccgttgttgcgcggtaggcgtggatatagccctgtacctgtggacggaagaatcgtgcccaattgagtgccttaacaggctcaaactcatcactccaatggccccagcggatggaaagcaacagctgttcgccaaacatgccaaggttgcggaagtgcagcacgctggtatccgtccatccctgcagcttcttcatcgcatcgacgcgatccatccatggctcgggataagcgaccatgatgcgggtcggcagcaactcccggaactcgggccttgccagcatccactgctgcatcagcatctcgatgcgggcagtcgagggcaggtcaccaaactgattgtgtgctccctgggacaggatcaaatgcacttcctttagggcattgagtaccgggaaagcatcggccttgacagtggtatcgtcatcctgtttgtagaacacggtacacagtctcagcaaatgatggaaagcttcaaggaacttggagcgcgtatcggcgggccggaaattctgtactgccttgccttccagccgcaacccgtaatgatgatcgtattcgtaattacggcggttaacagtcaggcggtgctgttcatcctggatgtaaccccatagcaggttattgagcggacggagcgggtccatttccatgctagcaagtggatctcgactggatgaacgcacattctgaaaccgccgggtaatggcattggatgtttgcaccagcataccttcctcatgccaatacgaccaaattaactccagcagacagggattggcaagtttttcctgtaacaacccgtagcattcatctgcgtcaataaccccctccctacttttactcgccgcttcttcaaacggcttggtcttgattgggatatcaggtaatttgcggcgaataacggagagatagggcaatacatcaccattcccatcgatacctactagataatctttgttgaaagcacgattcaagccactgggtggtattgggagatcacgacggttcaagtatgcttcatcccgagccggatcaaaaggttgtaaatcattgtgatgaacgccacaatttaccatcacaaaagcttctgtagccgctttgaccacacgataagcatcagaatctgtaaaaggtaaaaaacgattcttcaataatttatcccgccacatcacatgcttttcatcatagcggtgactctcaaattgacttaattcccgcggtttctgcttgccacagaaaatccaatccatgaaactcaaataattattgaatgaaagggcctctgtactattacgaatacttgtccagaatgcggtatcttcagtgaaagatgtttccgttcgagtgaggctggtcgttgttctggcatcaacatgctgtatgttacgtaccgccgtgccagtcaagtttgtggcgattgatgagccgtcaggatgcttcagaaatgtattaaagaagtaaccaccttgcattcctgtcgtatcgacggctatttcgtatactcgatctatgccatctacaaagatggaaggttgagacaaaccgccttgattagaagacaattgaatatccggatttcccaagtcggcactatgcgaaatacgtagcttagccggttgacccgctacaatatcttggcataacagttcttcagatcgcgggccgcacattaccagttgttgcgtaaaatttaccggtactccaagaccaatctgtttggtgcaattacaatcgatcgaaaataatttttgtggttcatcacctgaatatgctgccggttcttcatgaaaaccaaaggcattcttatagactaagccataccgatgtgaatcacctccgagaagctcaaaaaccgcatacccgttttcatcagtagttcgtgtttcgatatgctgccattcgttggatttccattccagaacttcaatactcgctcctttgatcgggattttattgccgcccgaatcatataaatgcactctcagcatgccattacattgagcttcaccgctctctatttttttagattttgtattcatgtcattctcctaaatgaataattaatagaacgattctgttggtaggagcttgccggcaaaaactcaagttgccccggccttgctgaataatcaaccgatgtcctcaacgtgctgcgcagcgcccagtggatgagcaatttccccaacagggcgctttcctgttccgggctcatgcgtccgtcggcacgtgcctggccgatcacagcaaaggttagaaccggcgaggcctggtacatcctcgcaggctgttgccgccagatggagaacagtgtctgaagctgccatggcgagcgactctgtacctgtaaagcctcggccaaactcgctccgcgcagactttgcgggcgatgattgatcagcagcgttacaaatccaggcaatgtcgcctgaagcatttcataattgtgccgttgggcaacatccaacccggtcagcgggtagtaggtttcccataattgcgccagacgctgccattgcggatgaggataaagtgcctgcccgatcgcacaacccagtttgacgcgaatccagggtgacggatgagggtcatcccgactcaggcggaatacaaaggcacgtggcaggctgaccacacccatcaatccgagtgtggcggcaataccaatgcgggcgatcgaccagaaatccgcaacgatctctgaaatccaccgttcccacagcgaccaggccatgttgtatactccactgccccgtttcattccctgcaaaacaggccgtaaggaattgaccaggttaagcagtgcagcagactgatggcctacttcatgaatcagggaagaagcaacgccgctaccaaccatgcgttcccggggaatacgaatcaccgctaccggattctcgccaccacccggcaaccgtgttcttacacggcgaatcgccgcaccaataccacgatcgagataacagataattggcggcacctcgtagtaatgtcccggaatggcaagtgcatccgccgaaactacttccaggccggcaagccagaccccaacttcattttcactgcgctgcgtgagggcatcgtcaaatagatcaaactgcgtcagcactgtgttgaatcgcaaccgcaacagcgaaaacaaccgctgtgcatgggcaggcgcggcccttcgaccggatggactgcgcagccatgcaatgtaacgttgaatcaaccctttgagttcgcgcctcccttggattagatagcgttcaataccggtttgtgctgccggtaacaacgacgctgcaggcaacatggtttcgtgcaaggcaaaaggtttgacccgtttcagcctggtcagcaatgcacgagcctcctgctcaagcatccatgctgcgtatgaagcggtaaccatggcgggttatgctccgaacagaatgattctgtttccacgccgtatccagcgaccgctcatagcaccccgtccacaggaagggcatggactgccagctgtgccggcgacggctgttggagtaccgcgaatcaggcccggggcaagttgccgtgcggcggctgctatcgcggattgcgcggtagttacgggatttgctgcccgtggtgctaacgcagcattttttgccgcagctccggcgagttgcacaaaccttttggcaacttcatattcctggtcttcatgactcaatccttccagttcaagaccaaaaatcctcccggcgttagaagccacctggccgccaaccctggcgccgcttgtgccaccaaaataaccgccaatagcactgcctaccatgggcagcgctttcttggctgcactcttcaataaaccgccaagttgctgccctactggcgatctaatgaattttccggccacctggccagcttttttgatgagattccctaaaaactgatccagctctgcctcatcactgatctccagaagctcggccgcaagttccatggtttcggtctcgctaaaaacacccgtttcaccaccccactctgcttcaccaaattcaccatattcatactggtcatgttcgtaattttccagatcagtgttggtttccagggtagtacgatcgatatcgtgcatgtttattctccttatcacagggttaaaaaattgcttaacaattaacgatgacgatgttgcggccacgccggaaccatctgcctccctgcccttttcccggcatggtggcaggcatggccatccttgctcttgctgctgtcagattgggtgcatatatttgtgcagctttatttgcagccatttgtgcggcactgcgtggatcgacagatggtggtgccgagactgcatttttgacggtgttagcagcgaaacgtacgaattgttttccgccttcgaattcacgatcttcctggctcaacgcttccaattccaaccccaatgcactgcctgctgcagaggcgagaccgctgccgatcttggctcccagggggccgccgaaataagcgcccagtgcgccgccagcaatcggcaaagcttttttggcaacgcccttgagcacgccccccacagcccggccgatgggagatttcactaccttgcctaaggcgctaccggctttcttgatcaacgaacccagaaaacggtcaagctctgcttcattagtaacttccagaagttcggcggcaagttccatcacctcgccttcgttaaatacctctccccactccgcttcaccatattcgaattgctcaaactgttcgccttgatattgttcgccctcaccttcatattgctcagcttcaaaaccactcatttccggattgaattcgaatatattttcactttcatacatggttaattcctccaattctcagatttctcatcacaccttgatcaataaccaggtttctcaccaagtttggtgttagcgctttttggggctcatcaccgtcagatcaaccagctcaactcaggttgtcctcacaatagataaaagcaaataacatgccaaaataaaaatacaactcttatttttgactcgctacgcacttaacatgctgaaaataaattagatgtccaataaattaccagtcataacaaatatgattgagaagtaaaaacataaggactggcgaaacatatttcggttaatggcgcaaaaacactttgcgatatgaaaattgtttcggagatgctagaaactactttgatttgctattagttgttgggagagataactgtagtgactcagcaattccagacaggacgtgaagaagtatggggtggcgtaattaatgtgttttttctggatgatacgaacaggaaccccatggagggatttgccgccaggctacgggggctggaacaatatatttagtccatattgatttagcagaggagtcaaataagcagatgacaattttttaaagttgaagcctcctcaaagtcccgtgcagttcttctggtaacgtaaaatcagttcctcaaagcaaataccttttctatgtttagtaacagccacactgcggcaggtatcagtcagttttttcagtgccagtacagttttgttcaaggtagattggatgtgccgattattcgcagcagggataaattatcagtagtttttagataaagcatcctataattatttgtcataccaactaatctacaccacaggattccgtatttatgccaaatgagcaaagattctttgtcaccggccctgccgggaagctggagacagttgtcacactgccggatgatgcgccacatggcattacagtcgtggctcacccgcatccgctttaccatggcagcatggataacaagatcgtctatattcttgccagggcattcattgagcagcagtacatcacggtgaaattcaattttcgcggagtgggcgaaagtgaaggcaactatgcggaagggaaaggagaaatcgaggatgtgcttgctgtcacgcaatctatccgggagcggtatgacaccggatcaaccccattaccactgatactggccggattttcattcggtggcgctgttcaggcatatgttgcacagcaactgcggcctcacaagctgatactgatcgcgcctgctgttgagcgtctgcaagcaccacccgtaattgattgcgctgagcatattctggtcatccagggggatcaagataccgtcgtgccgctgcaaagtatattggattgggccacaccgcaaacattgcctgtaaccatcatccctggtgccgaacattttttccacggcaagctgaacgttctgaaagacatcatcctgcagaattgcgcgtagctatcggggcaggggcggtcagttttcctggctgagctacacaccacccatgcggcgcacacgaaaaaattagcgcttaatctgcgatttgacaacctgccaaacaggcaagaaccaaaatacgtgatgggactgagaaaaattcgaacaaataaggagcttccccggatgccagagccataccggggaagaattatttacagctcaccagattagtggcttgaaagaattgacctttcattcagatcctgtgctgatctggcattgttgctgtagaaagttttcatttgctctaattgagctgctgaaatcgtgattgattttgtcaaaatataccattgcacgccttcgctacaaggcggagtcgtcaatgaaccagccagcgttaaatatttcagattggccgcattcatacctgacggtaataacttcgccagtttgaacttaaccccggaagtcgaattttctttgccgctttcatacggcatattatccagaatagtctggaacatcgcattctctttcccgatatttatggtcacggccagtaccgcaattcttccatccttattgatatgtacaaaatgtaattccgctggaaattttttgccctcaacaacatgttcgctaggctcatggaaatgtagttgaaccagcggcagcgattccttcccgacttttaatccacccgtaaaattctgggaagtattaacttgtatggcatgccctgtattgaagaaagatggcgtatctgtaccatactgtgccgcaagtttatttagcggcctggatttcacaatcttttcatctgctagatctaccggcgactgatgtttaccaataccacactctgcgtagggataacgcaatggtatcgattgagtagcgtcttcaatcgctccccagttaggctcctcttcataagaccaatgaggtggagcagaaactgcaactgctgtgtaacttataaagattatagaaactagatttgccagtattttagttctcacgagtaattcctatcataatagttattaaattagcaggtatgtttcctgcaatagtcgatcattaaagattttttatctaagccgatctcttgtgaaggctgtgatttagtttttttcttttttgccttaatctgggctggttgcctattttcggtcgaaataggctcggcctgattagtaactgacaacgattgaggctgactctcccccgattcagcaaagcaagaaacacctaaactcagcacagcagtcagaaaaagcttaatacgcattattttcctccttttgcaaatatgcaaatcgcaaaattttgttctggtccttcaatagaaaaaacaacaagatatgatgattcaaaatttctctatttcaaacaatatggcttgcatcaagaaatgtgtggagttcgaaccatactctccggtaaatattttagccggggtctcgacaatttcagcaagattcacttcatcacgttccctgattccatcgatgatcgagttattatcagctacgcacaaaggctcttatgtccgcaatatcatgctcccgtctttgctgcgctccaagcacactaaaaccggtcttccaattgcaatgcctcgtaatatcggatgcatatcgctcaaaaatacagaccctgatgcttgcaaagtttagtggagaaactactctcgccatcaatttatatagtggcttaatgttgcactggtagcacatctttctgaatggaatctgaaaactttgaaagccagaatacgctcagtacaattttcatgatataaagctgcagtgttaaaacagcccgtagcagaaaagctaacatcaggctttcaggttattgaacaagcaggtaaggagaacaatttgggacgcggattttataccatcatggcggcacaatttttttcatcactggcagacaatgctctgctggttgtagccattgctctgctgattgatctgcatgctcccgagtacctcacccccatgctcaaattcgtatttgtattattttatgtattgctcgccccgcttgtcggcgcgtttgcagattccatggctaaaggctgggtcatgtttatcagcaactcaatcaaaattatcggttgcgcattgctgttttttgctgcgcatcagctttctgcattgggcgcatacgcggttgttggattaggagcagcagcttattccccagcaaaatacggcatccttacagaactgctgcccccagagaaactggtgattgccaatggctggatggaaggactgacggttgcatcgatcattcttggtacagttattggcggcctgcttattaccccttctgttgcttccattctacttactgcaaatctccctctgatcaataccgctgtagatgccagcatcatagtcatcatgctgttttacattattgctgccattaccaatttatttatacctgataccggaattgatcaccggatactcaaaaaaaatccggttttcctgtttcacgactttgtgcgctgtgtaaagctattgtggtttgacaagcttggccagatctcgctggcggttaccaccttgttttggggagcgggagcaacgctgcagtttattgtattaaagtgggctgaagtggcgcttggttatacgttaaacaaagcagcgctactgcagggtgtcgtcgctattggtattgcattgggttctgttctggcagcgaagctggtttcattacgccgatcgctggatgtcattcctctggggattgccatgggaatcgtggtaattctcatcattatggttcaaaatatctggttagctgttgttttgctggtcataattggtggattagccggattcttcgtagtacctatgaacgctttgctgcaacatcgcggacatattctgatgggcgctggacactctatcgcagtacagaatttcaatgaaaatcttggtattcttaccatgttgtcattgtatgcactgctaatctggttcgatgtgcatatttataccgtaatcgctctgttcgggttatttgtatctaccaccatgatcatggttcgcaaatggcacctgagtaaccagagcaagcaagattcattacacctgataggaacacagaaacgacaattctgagtttttactttgtcaccctgaatttccaattccgcgagaaaataaggagtattactgacgtatcacaggcactaagcggaatagcatttatcactcttgcgagtaaccctcaccagaattctcctgccggattttctcgaataaacagattgcagcagccgcagcaacgttgagtgattcggcacaccctggcatgggtattgccacacgttcacgcacaacttctagcagctcttctgatacaccgcacccctcattaccgaaagcaaacatgaccggccctcgcaggtctgtatgataaatattgtcagcgccagccagtgccgtcgctataacatttccattaaattgacaagcaatctggatcagatcggaatcttcatgaattctcaaagaaaaatgcgcccccataccggctcttaatgttttgggcgaccaactatcagcacaaccactagacaggaacacatctttaacacccgcagcaaccgcagaacgcagaatcgaacccagattacctggatcctgaatagcttccagcgcgatgcaaaaagaatcttcataggagtcaacagaccgggtatgccggggaatacgaacgagtgtcataataccaaccggtgttttgactagcgatatctggttgaatagcgcatcactcaacattagacaatcagctcttccgaaatctttaccaatactacctagcagctgattaatttcagcatgttggcctcctgattcgctaacgatcagcaattccggaattcttcctgaagcaagataagactgcagcaaatggatgccatcaagcaaagcaagtccttcatcacggcgctgccgtgacgaacgttgtagcttgaacagctttttaaatacgggatgctcgcgagaggttatacggcgcatgttgcttgagaacctgtttacgatcttttgagtagtagcgccaggaaggccagatgaatgaactgcaagctggtattgagcttacgctcgcagtttttccataaccttcggctcttctccagccaggcaaagctgcgctcgacgatccagcgtttgggtatgactgcaaaagtgtgcagttcactgcgcttggcaatctgcaccgtaacaagttttcctagaatttctcgcgcgccttcggcaaacggctctccagtatagccgctatcgcacagcaggctttgaacctgccccagactctgcttgcagcgttttagagcttgcaatgctcctttgcggtcagtcacttccgccgtcgtcaccgcaatggcatgcggcaagccctgggtatcgacggcgatatggcgcttgatacccgataccttcttgccggcgtcataacccttctggccagccgtgtccgtatttttcacgctctgcgcatccacgatcaagaacgtgctgcaagcgttgcgcccccgtttctcgcgggccgcgccaacctgatttttttaatgcctgctccaacacactcacgccgtgctgatcgggctcactccatttgcgccaatgagcatacacgctctgccatttgggaaactcaccgggcaggaatctccattggcaaccggtgcgcagcaggtacagcacagcgcagaatacctcatacagatccactgtcgtgggcttggtgctgcgtcgcacgctgcgcaatagcggctctatctcggcaaacttctctctgctgatatcactggcatattttgttctcttcatctgcacattatcaaggatagcagaaagatcgtaaacaggttctgagatctgcatgttactactttggctacggattgatacggaatactgtcaagaacataacgagagaaacaaacgtttcaggattgctgttctccccaaatcctcaaaaccaccttcttattgtcggaatttacgaacaaactctgcaaaaaccacataaagaatataaattcaaaaaagtattaaatatactaatctggataattttcaattgagaaccaataataccggggtcggcgacctgtgcctgtttcaattttgaagtaaaggaaaagtaatcggtcttgactaccttccccacaaaaggcagaatacgcgctatgtcgttcagatagttggcgaattagctcagtggttagagcagcggaatcataatccgttggtccggggttcaaatccctgattcgccaccattaaaaatcatctgcttaatgacttgctttcgtaatatacaacacagccagttgtagttgtgatcatcctgatttatctgatgacatagaagttccaggttacgctcagtcaagcgcctcggaattaaaagagtcgcaagccgctagatctgacttactgcacgctggaagcttggatgccagattacgtaatgctgtacgcaaaccttcttccagcaccggatgataaaacggtattcgcaataaatcccacacacttagagattgatcgattgccaaagcaagcaaatgtgcgaaatgctccccagctggtgcacacatttctgcacctagcaatcggccatcatttgccgcagcatacacacgtaaggcaccacgattagactgggccgaacgtgcccttccctggttagagaaagagacttcacctatttgaatattttcgtgttcgagtgaatgaaaggattgaccaactacggcaatattaggatcagcaaatacgatagctagtggtactcggcgcttaaagtaaattaattcttcacttgttgtatttaaaccggcaatatgcccatcatctgcagcctcatgcagcagaggaagacgctgatttgcatctcctgccagaaatactggtaaatctgcaatctgcagggtaattggatttactgatggtagccctttttcatcaagcggcacatccaatgtatcgagaccaatatcatcgatatttggttgcctccccaatgcggctagtacactgtctacctcaatttcgatattctctgcacggacagtaagcacattattatccggatttatggcgacactcgctttgctaccaagatagagtggaaattcttctgacaacagcttcactgctgtctgattaatgaatggatcacttaccccccctactgagctgcgaaatccgaagcccgttacatgtacaccaagcctggataatgcctggatcatttccagaccaactggacccatgccgatgacagccatacttttcggcaacgtatccagctcaaacaaggtatccgtcgtcagcaaacgtttgccgagattcagccagttcttgggcacaacaggccgggaacccgttgcaataatgattttatgagcgctgagtttctctccattgaccattacttgatctggcgacagaatacgggcacgccctgatattgcacgttcacccaaatcattggttattttaagggtgctggtaacaaaatcatcacgtagcctgcgtagacgttgcagaacctttttgccatccagttccagttgatctgcgcccataatcccgaactcaccaaaattgaaccgtcgatgaaaagcattggctgcctcaatcaataacttagaaggcatacacccgactcgtgcacaggtagtaccccacggaccatcgttgatcagtacaaaattatcagttcgttttcttacctcacgcaaggcagataaaccagcacttcctgcaccaatgattatcacatcaaatttatgcatcagtattcgagtccccaatcaatttgtataataaataagtaaacacattacaatttatgggtccaatcagtttgttattctaatccttaacataaaaatctggaaagccgcagtctggatgatacttacctttcttgtcaattgagtttatcggtataattcctaccaatcgtttttaccaattctcttttcctgccaggaaatatatcaaataccaaggagcagaatttggtgctttcacccgttcgtattactgtcaccggcgcagcaggacaaatcagctacagcctgttattccgaattgctgcgggagacatgctgggcagcaatcaacccgttattcttcaactcctcgacatcccggaatccaggaaaatactggacggcgtggttatggaacttcaggattgcgcatttccgctactggctgacattattgccactcacgacccgatggcggcatttgatcaggcagatatagcaatactagttggggcccgcccccgcagtaaagggatggaacgtaaggatttactgcagaccaatggcgaaatattcagaaatcagggcaagatcctgaatcaagtggccaaacgtgatgcaaaaatactggtggtgggaaatccagcgaacaccaatacccttatcaccatgaagaatgctccagatttaccagcagaaaatttttcaggaatgctccggctcgatcacaaccgggcattatcacaagttgctatgaagttaaaccagccggtcagcaatatcaaaaagatgattgtgtggggaaatcattcatccactcaatttcctgatttgtatcatgctgagatcggtgataccaaagttattaatctcatcaaagatccgatttggatcgaaaactactttatccctacggtacaaaaacggggtgctgtggtaatcgaggcacgtggtttatccagtgcagccagtgcagctaatgctattattgatcatctgcgtaactggttttttggaacggacgaaggtgactggactacgatgggaatcttatccgatggtagttatgaaataccggagggggtaatttatggcttcccggtcgtctgcaaaaatggtatgagggaaattgtacagggacttgaaatcaacccattctcacgtaccagattagatgctgcctacaacgagctaactcaggaactggattcaatcagacacttgctaccctgagatcacgaaactagattctatagtttccaagcccctcaagtgctcttatcacattatatttccttgataaatgctaaaacttcctcagcatgccctggaaccttaacacttcgccacgctttatatagcttgccttcccggtcaagtataaatgtgctgcgctctatcccgcgtacctgcttaccatacatattctttatcttgatgacaccaaacagctcacacactacctcatcggtatcactcagcaaattatagggaaaattatatttttctctaaacttctcgtgtgacttcaggctgtcacgagaaataccaacgatttcacaatcttcctgcacgaactctggatatagatccctgaattgctggccctcattagtacagccaggtgtatcatctttcggataaaagaaaataaccaggtatttgctctttatacctgacagacgaaactgtttgttacctgtggaagccaactcaaaatcagggaccaaatcaaccgacatacaaatatatacccctcatcaacaaattaaatttacgggacaatatgatcaattgtaatagaaatattttcttcaccaattttcacaggaatgctgtgaccctcaagatctccactggagggaatagcctgtccggttttgctgattctcgcccccaccaccacctctggaaagcttgagagcttcatcgcgggggtcatagccatgttgtcatcaagcttaaacgaaactggaagatccttagcatgcagcctcaaaatagccaatggcatttttggcccttggctggcccttgcaaaaacgaaaagcgtatcatcaggcgaaacttttgctgctaacgaggcatccagagtaaccgagccagaaacgcttggtatgcccgtagcagcttcctgcttctcaccagagggcaatgtcacaggcacatcactctccacatttgaattctgcgccagctgtacaggaatagattcatttctacctttcatggccagagatttagcctgggcgatactgtcactcacagatttataaaatttcgaatcttttgcctcggcgggtataacattcagcaggcgctcccagtaagtaactgcctgatcaaatttttcccgctcaaattcaagcgtaccggctaaagctagtgccttaggataatccggatcgatatcaagtgccttgctgatcaactcggcaggtttaccctgtaagttgccattattcgttatggccagcatatcggcataatcactcaagaattgggggttatccggagccatttgaaccagtttggcatagactgtgccagcttcatcaaaacgctccataattatgtaagaacgtccaagcatcacccagccttctatatcgtccggattatccttaagacgggcagcaagactgtcaaccattgccttgatctcagcatgatccggcggcattccttccgcatcacccccctgaaactgcgtagcattagccagttgagattgcggaagcagcccgcgagtatctccaattaccagataaaggtagatggcagcaagtggaactgccagagcaacaataacactcacaatagcaccatgacgattgacaggagttacgcgaacagtttcatcatcttcagataaatcctgcaacattcgcttttgtaattcctgcttgctgagttcatgctgctccttggaaagaacatcatcaagtaggtcacgatccagctcagcaagctgatcacggtaaatagtaatatttgcagcctgacgttcaacttgatcttgaagctcattttttttatttctcagcaatacaggtataataaacagcaatgctgccatgataaatataccgactataacccaaaataccgtcgtcatatactttgatccttgtccatttctttaataagagattcagcctgtaaacgctgattttctgtcagtggtacctcgttttcctttattcgaatacgacgacgcctcaaataaaaaatgagcgcagaaccaccccccaaaaacaaagtgaacggaccgagccacaacaaccatgttattgatttaaagggagggttgaaaagaatgaaatctccgtagcgagctaccaaaaaatctacaatttcctcatcacttttattcattcgcatctgttctctgatttcacgcctcatatccttagcaaaatcagcatgtgatgcagctagtgtttcattctgacataccaaacagcgtagattctctgccaaattattcaaccgactctcaagttcaggatcatcggcgacaggtggggcttcatttgcatagccctggaaagctgtaagagacagaataatcaccattaagcaacgctttaacgagtccactctcatacatatcagttgtttcatcattaccaacttaactcttcagttccttgattaaaggaagaattttatctttcagtgattcaaccgttaccggaccaatatgcttatacctgataatgccttgcttatcgattacataggtttctggcacaccataaactccataattaataccgaccttcccatccgcatcgacaatactggtttcataagggttaccatattgtctaagccattgcatggcagtatctcgctgatctttgtaattcagaccataaattggaacaatacccagctttgagagttctaccagcacagggtgctcatcacgacaagccacacaccaggaagcccaaacattcaacatccatacttttccaagattatcctcagacgaaagcgtcttactggaatcatagagttgttgcagatgaaaaatgggtgcgggtttatctattaatggagatggcacttgacgcggattcaaggtcaaaccaattcctagaaagattactaatattacaaatatcgcgagaggcagcaggaaacgcatcatgctttaccaccttcctccgaaagagtaacagaattggtcaccataatatctttggcaggtatatctgcagcaccaggtgtttcagctgctttgcggtgatattttttattaatagcaaggcggtaacgccgatcactgacagatagagctcctcccagagccatcaatatgcaaccaaaccagatccagttaacaaaaggtttgtgataaacccgtactatccaggcatcattctccaatggttcacccagtgccacatacagatcacgcagaaaccccatatcaacatcagcctcggtcatcggcatacctgaagcggtgtaagttcttttctcagggaaaagctcacttattttcttgccctctctgaacacctcaatctgtccttgagatgcattgtagttagggccaggaagcgatttcgttccattaaattgaaatgtgtaatctttaagtgttacggtactacctacttccatacgcacatctttttcagtttcatagccgttaaccagcgtaacaccaatgataaatactgcgataccgaagtgtgcgcaatgcataccataatagctccttggttgtttcaccaacttagtgatcaacccgccttccccactattctggagtcggtgcctaataccgacaaatatactggtcacaacccagaaagccagtagcaacccaaaactgaccataggtttccattcacccataatgaacggcataattcctgcagccaccacgctcaccacaaatgcccatctcaacagcaccgtcagggcgggcaggctagctttcttccaacgagcaactggccccagccccatcagaaaaatggctggtgccattaaaggcacaaaaactgcctcaaaatagggagggccaacagaaattttccctaaattaagcgcatcaataagaagaggataaagcgtgcctaataccacgctacccgccgcaactagcagcaatacattattagcaagtaaggtagtttcacgtgagacaatctcaaagttaccccccaaacccactttggaagcgcgccatgcaaacagtgttaatgaacatcctactaccagcgatagatagatcaggataaatatcccacgtgccggatcagtcgcaaaagcatgcacagaagtcagaaccccggaacgtaccaggaaggttcctaacaaacttaatgaaaaggcagtgattgccaataatatcgtccagctcttaaaacttccacgtttctcagttaccgccagtgaatgaatcaatgctgtacccaccaaccaaggcataaatgatgcattctcaactggatcccagaaccaccagccaccccagccaagctcataatatgcccaccagctaccaaacatgatgccaatagtcaggaaaatccaggcaacaatcgtccagggacgtgaccatcttgcccaagccgcatccaactgcccactaagcagtgctgcaattgcaaatgcaaatgcaactgaaaagccaacataccccatatacaacatgggtggatgcataaccattccaggatcttgcaacaatgggttcagatcattcccttcgattgcggcaggtaataatcgatcaaatggattagaagtaaacagaagaaacaacagaaaaccagcactaaccaatcctaaaacagccaaaacacgagccaccatgtcatccggtaattggcgactgaaaacactcacagcaaccgaccagccggcaagtatggttacccatagcaatagagaaccttcgtgagatccccacgtggcagcaaaacgaaaatgtaaaggtaaatctgaatttgaatgagacgccacattcaatacagaaaaatcattgttcaagaatgaataggcaagacagccaaaagcaatggtagtaaatacaaactgaccctgcgtgactgggcgcgccaaggctacccacgaaggtattccacgtgtcgcaccaataaggggcaaagttccctgaatcaaggccagcaacattgcaagtatgagggcgaagttaccaagttccggaatcatggtttaaaattattccttgttttaaattacgggataaaactcactgtgtaaaagaggttttctgtgctttggcagcttgttccaatgcagcagcagcttcaggtggcatgtaattttcatcgtgtttggcgagcacttcatcagcataaaaaacaccatcatctgccattttcccctgtgctacgacacccttcccttctttaaacagatcaggaagaatccctgtataaaccactcgaatcacctctgcagtatccgttatggcaaacttcatggttgtaccgtctccatgtcgcttgagtgaaccttcttctactaatccacccactctgaagctttttccaacaggcgcttcttttgcagctacctgactggggctaaagaaaaaaaccaaattactctgaaacgcattcagtaccagtacaacagagactgccaatgcactaacactcaatgtaataacagccatttttttatgacgtggcttcatttctatcctcgcaaaattgatcttctactctgaccaaggtgcttgtataaagttcgtttgcgaccacgaatcaatacaacttcaccaattacgcatatcattgcaacaagataagacccccatacataaaggccataaccgcccatagcaaaaaaatcagacaagctctcccatttcattctaatactccttccttcaactccgatacccatgccgtgtggcgctcacgctccagaataatgagacgagtacggataagaattattacaattgaatacatccatgctgccaaggtcatgatcagcatgccggataacatggcagttgccatcttgggagattgaaccaggctaacggaagcaccctgatggagggtattccaccactgcaccgagaaataaataatcgggacattgacaacacccaccagagcaatgaccgctccagccttatccgcacgctttggatcatcaatagctgcctgcagcgacataaagccgatatacaaaaagaacagtattaactctgatgttaggcgagcatcccagacccaccatgttccccacattggtttcccccaccatgctcctgtccacaaagcaaggaaagcaaacatagcacctgtcggcgctatggcactggccaccatagatgaaagtcgagtgttaaatgccagccccactccggcccagaatgccataaccacatacagaaacattgacatccaggcagccgggacatggataaaaataattcggtaggcctcaccctgttgaaaatctgtcggagctacaaaaaaaccaatatacaagcccacgatcagtaaagtaatcgctaaagccgtaaaatagggaagcatccggcccgccagaaagtaaaaacttgcgggagaggcatatttaaaccaattgattgtcatgttctgaatattctctctgaattgatccagtagataaaattacgctctactaccataccaacaaacgcaacatcactattatttctgggcacatcctttctatcagctcatggatatccggagagaggcagctgttgcccaaggtgaaaaaacgatagaaaccagcaaaaatgcacccagtatcgaaaaatgggccccaaactccatcccggcgctactcgcttcaaccgcgcctgtaccaaaaattaataccggaatgtagagcggcaaaaccagtatcgacactaataccccccctcctcttaatcccagtgttaacgcagcaccgattgcaccgatcaaacttagtacaggagttcccagcagcaatgaaagcgtcagcacaagcaatgcatctccggctaagtcatactgaatccccaataccggggccatcaataccagaggaacccctgttaccaaccagtgtgatattgctttcccggtgaccagcgtcgccagggaaacaggggaaagcagcatttgctccaaggtgccatctgcataatcactggagaacatacgtccaagtgataacatcgaagccagcaaagctgccacccagaccacacccgaggccattgtccgcagtatgctgggttcaggccccacacccaatggaaacaagctgacaactattatgaaaaaaaatagcgttgtcaacacatcagagcgtcggcgcattgccagcaataaatcccgtttaactatccaccagatcatatcgaatcaggataaagtcaaatgatgaacagctgcagcagtcatgacaatttcctgatgagtggtcataatgaccatgcctcctttcgatagattatgctccagtatctctttaatcagcttcaccgctgcagtatccagtgcggtcaaaggctcatccaatatccacaatttactatgcaccaccagcagacgcgccaaagccacccgtctgcgttgtccttgtgataacactttggccggcagcatttcacgccccgccagcccaatctgccctaacgcatctgctgcttgattttcatcaatctcacaatcagccaatgcacaggatatccgtaaattctcgagagcagtcagatcatccttgataccacccagatgccctagataggtcatcatgccacgataatctccgtccagctcccgaatatccattccattccagagaatctcaccactatcaggtgacgataatccacacaacaatcttagcaagctggttttgccgctaccattaggtccgccaacaaacatcagctcaccgggatttactgagaaggaaatgttactgaagagtttatgctcccctcgtatacactccaggttcctggccgtcaacatctaaataataattgagccgcaatcataaaagttggagattatagcgtattgctgatttcttagtggcgctgccagtgctcggatatataaaaatcattctgctcttttttctagcctattgaatcagctaacccgcctgctgctgtaacagcagccaacacaaccattcttctgggtgcgatgacctcggaatcaacccactctccgagaccaagaaaaatattctccctatcgtatagctttaatttgggactggccaggaacagagggcgcgatctgtccttcctgattttctgcccttgctgcaaacgtaccacttcatcgtcatcaaacaccatagaaggaatgtcgcttaaaaggctatcaattggatacaaaaatttcaggcggtcagaaggctgctcggattcgagctgatccagattgcaagcttgcgataaatcgaaatggccgacaccagtacgggaaagcgcggtgagataagcgccgccatagccaagcgcctttccaatatcttctgccagtgtacgaatataggtgcctgaactacaacggaccgcaatcatcatctcaaaacccgacaaagcattgagagatatactgtgaattacaatttcacgcaccttgcgctcaattgtaattccctctcgtgcatatcgataaagtggtttgccatgcagcttcagcgcgctgaacatgggcggaatctgatttgatcggccaagaaaggtttgcaggattgcagttacttgccgagaatcaggtggacacgcatcagatttagctacccgcctaatttcaccctcagcatcccctgtactactgatataaccaagctgaagagaggctttgtaggttttatccacactcagtaaagctgaagaaaacttggtggcttcaccaagacaaattggcagcaagccttgtgccatcggatccaacgtgccagtatgaccggcctttgttgctgacaacaaacgcttactgatttgaagagcccggttagatgagatgccaacaggcttgttgagtaacaaaaccccattacagttaactgatttaagctgaacagatcttgctgatgataagagtttgaccaaaaaattttagctagctaaatgtaattctaggttatatcgccatatcgcataaaacgccaattctgtagatatcaccaatcaggatcaggttttacctacagcctcatcgatcaatctggagagttttattccgcgttcgatagattcatcataaacaaattgtaacttcggaataattctcaacctgattttaccagccagctgactgcgcagaaatcctgcggcccgcttcaatccttcctccgcaagctgagcattttcattacctcccagcgtagtatagaaaaccttggcataagtataatcccgcgtcacctccaccccggttaacgttatcatcccgattcgcggatccattatttcattctggatcaacgaagccaattcacgctgaacctggtcagccactcgtaaggtacgggaaaaatccttcggcatgattacctcctcttcaatcaggcgaattattcatcgcgcccgatgtacagcatcacaatacacgggcggtttcaacgatctcatacacttcaatctgatcaccctgctgaatgtcattaaagttcttcaatgaaagtccgcattcgaaaccggatttaacttccttgacatcatccttgaatcgcttcagagaatccagactgccactatgtataacaacaccgtcacgcagtactcttaccggcgcatcccgtcgaattaatccttcaagcacataacaaccagccacgacaccaactttggatatccggtaaatctcgcgaatatcgaccaaacccagtattttttccttgcgatctggcgtcatcattcccgacaaggcctttttaacttcatcaactgcttcatagatgatgttgtaatagcgcacatccaccccggttgaagcaatcagcttgcgtgcccccaggtcagcacgacagttgaacccgatgacaactgctttggacgcaagagccagattaatatcagattcaataattgctccgaccccgctatgcacgatattgatcttcacctcatcggtttccagcttcttcaatgcgtaagccagtgcctcgcatgacccctgcacatctgccttaataatcagatttagtgtactgatgtcctcctgatggccgaacacatcttccatttttgccacatgaagtttgtccagtcggacatcgcggaatttaccctgacggaaaagagcaatttccctggctttgcgttcatcactaagcgctataaacacttcacctgccgcagcaacttcagacaatccctgaatctcaacaggaattgaggtgcccgcttcactgacggatttgcctcgctcatccagcattgccctgatcttaccgaatacagctccagtaaggacaacgtcacctcgtctcaaagttccggactgtaccagaactgttgcaaccgggccacggcccttgtccagacgtgattcaataatcactcctttcgccggcgcatcccgcacagccttcagctccagcacctctgcctgcaataaaacagcctccagcaactcatcaattccctgaccagtttttgctgaaacaccaataaacatggcatcccctccccaatcttcaggcacaacgccatgattgacgagctcttgtttaatacgttcaagattggcttctggcttgtccatcttattaacagccacaacaataggtatacttgctgccttggcgtgatgaactgcctcaatcgtctgcggcatcacaccatcatcagctgccactaccaatatgactatatcggtaattttggcaccacgggcacgcatggccgtaaacgcttcatgccctggggtatccagaaaggtaactacgccacgcgaggttttgacgtgataggccccgatatgttgcgtaataccgccggcctctccccccgcaacacgcgttctgcgaatatagtccagcaatgaggttttgccatgatcaacgtgtcccatcaccgtcactaccggggcacgcgactccatcctggcttcgtcaggagataaatcaacttcttccaagaaggcttccgggttatccggtgcagcgatcttggctacatgccccatctcttcaacaacaatcatagctgtttcctgatccagcatttgattgattgtcaccatgttgcccattttcatcaataccttgataacttcggctgccttgaccgccattttttgtgccagtacagcaaccgaaatcgtttcagggatcaatacctcatgcacaaccggctcagttggcgctgaaaatgcatgctgggattgcgactcatccgacctgctcctgccgtgtttatctttgcgcatgcgccattcctgcccaccagatacatccccacgtgcttttgattcacgacgcttaactggctcatccttccatgcttcctgctgtctggcctgtttctttttcttctcgcccttttcttccggttttacagctggcttctgcggagcacgttccttggccgccggagtcgtttgagtagttactgtaatcgtagcagagggagttacagcagctatttcagtagattctggttgagttgcagctacagatcctggcacagccaccgtttccgatccaggctcttgaacctgggtagattcttttttcacctcagtctgagctgttacttgctgtcttcgtttttcctgtttctctttcagttctgcagcctggcgcgccattaattccgatctttttctggcttcttcagcacgcaaagcgatttgttcagcatcaagtacagattttaccggaacagcttccggcgcttccggtacttcagctgttctcagagagacatcttcagctgctcttttgccagccgcatcagattcatcctgtttggtagtcaacacccgtttttttctgaccttgacctcgatagttctaggtcttcccgcactatctgattgctttatctctgttgtttgcctacgcgccagagtgatcttggttcttgatccactactaccatgtgatttacgcagataatcaagaagctgcgtcttatcctgctctgtcacaaaatctgctgcggaacgtttagcaacacctgcagcttgaagttgttccagcaacaaattgggcagcatacccagatcatgtgcaaattgctctacagtcatttgagtcatcagcaaccctttaccccaaatccaacaaaaatcataaaaaacaaaatcaatattcccttaaccaactcatatcccgctccggaaacagatacaggactcgtccgctttatatcaaaattcaagtaaaccagggttcgcgtgccttaataataattttgcttgctcgatcaagatccacacccgtcaactcgaccagatcatccgccgccagatcagcaagctcttcctgagtgctgatccctttagcagccaactcacgcacaagatcaatatccattccttccaacgcaagtaatgcttcagacgcatgtccgattttttcttcagttacaatcgcagccgtcaacaaaacattgcgggcacgattacgtaactcttcaattgtctcatgatcaaattcctggatttccagcatttcttcaattggaatatacgcaatttcttccagtgtagaaaaaccctcatctaccaggatacgcccgacctcttcatccacatcaagcttttccataaataattcacagatggaagcagcttcctcctcacttttttcatgagattcttctactgtcatgatattgagctgccagcccgtcaactctgatgccagccgaacattctgcccgcctcgcccgatagcctgagccagattttcctcatccactacaacatccatactatgcttatcttcatccattactatactgctaatcacagcaggcgccagcgcattcacgacaaatgtagcctgatcatctgaccattgaataatatccacccgctcacccgccagctcaccggtaaccgcctgtaccctagaaccacgcataccaacacaagtaccaattgggtcaacacgcgcatcatttgatttaaccgcaatttttgccctggaacccggatctctagctgctgccctgatttccagaataccttcctctatctccggcacctcaagttcgaacaatttgaccagaaaatctgctgaagtcctggataacaccagttgtggccctctgacagcacgatcgattttgagcagataagcgcgaacgcgatcccccattctcagattctcatgcgaaatcatctgatcacgcggcaaaactgcttcgatcttgccgaattcaatgatcgcattcccgcgatccatacgcttgatcacaccacttactagatactccccgcgctcaagaaaatcattcaaattctgttcgcgttcggcatctcgtattttctgaaagataacctgcttcgcggcctgtgccccgatccggtcaaatgtaacatcctccatcagctcttccgtatattcacccagaacgaattgcggattctgctttacagcctcaaccagtgcaatttgccgttcaggatgctccactacatcatcggcaacaatcaaccatctgcgaaagcattgaaattcacccgtatctcggtcgatagagacacgtacatcaatatcatcccgggcatgcttcttggcagcagaagccagagccatttcgagtgcggtaaaaacaatgtttttatccacattcttctcatgcgccaaagcattgaccaacagtaaaatctcgcggctcatattcctccagccctatttttcaaccttaaatccatcgacagatttacccgaattacaattttggaatcagccgggccttttccagatttttcaattcaaactgcaacaactttccgtcaacattcaacatcagggcatcatcccccacttcggtcagtgtccccacaaaatttctttgcccttgcaaagcaattcgcaacctaatccggatagattcccccacaaaacggacaaaatcagctctttttttcaaaggcctatccaagcccggtgatgaaacctcaagccggttgtaatcaatattttctacagccagcagctgacttaaatgattgctgacagcaacgcaatcagcaagcgttatcgccccatcctttttatccacaaacacccgcaacaatctgcctggagcagattgttcaatatcaacaagctcataccccataccagcaatcgttggttcgagcagctcaaacaatgacatagccccaccacaaataaaaaatgggccaaccagcccaccttcaaaacacatttgtattatagcaaggattacagtccataaaaacagaaatttattttacaccaatgtttccaataggttatcacgagttacatctaaagcacacattaaagcaatcgatcccgtcgacataaatatcggcctcaaataccccaattcaggattaataccttctgcacttgcagatgcaaaaacgactggattccaatcttcgccagataaccgtcgaggtcagggtctgtgcctagtgtatacggattgtgcctcatcctgaatttgtccatcgggcataaattctgtgtatcttcttctatatatttccaatggattactgagattcaattcacgtatgcatagagacacagtaggtgggcaaaggatggaatcctattatttgggcaaggcagacgatccagggcgcagcggcacgagcaatcgtcaatttgtagaagcttgattgtggataacgcactggccgcccctgacgcgatttaccaggcgcatttggcaaatggaacacaatctcttcaagcgcttgcaggactggagcaaggtttggtgtattcaagcgtattactttgcgctgcaacaaaaccgactacagcttctcgtcagtcatttacctgctatctgttatctcagccccaagtgaatctcaagagagtctaaccaaaacacaacctcacaagaaattcgtaaagaaaaatctgccacgaataactgcgtgatcaggaagcaggggcgctgtattgtagctcgatcaataaagtcagaaaattcacgagttatcaatatttcatgttattttaccctgaacaataacagcccttcccggggcgattacctcagccattaaagcttcaccagctttattatgttgaataatcaggtatcaagacaaatccaccatcacttttagcagacaacagccttgtctgtcttcatatgcaaacacagatattagaatttttgcaggatttacaataatgttcaatccaacaagaaaccaggcacggcagctattctttgatacgtggcacaaataccagcaaagagaaccactatccggcatggaaaccatagcagtggaagttatcctacagcacccggaatatcattccatgctgcaggataccgaacggtaccttgacaaggattatccacctgagcagggcaaaataaatccctttctacatatgagtatgcacatcgccatccgagagcaacttaccatcaatcagccaaccggtatccttcagcgcttcgaacaattgaaaatcaagctacaaggggacgagcatgaagcgatgcatcacacgatggattgtcttgcagaaatgctctggcagtcacagcgcaatcaatcatcccccgatgccagtatttatctggaatgcatggataagcagatcggaaacaaataaaaagcgaaatgcacccccggggtatcggatgcattccgctcacagcctccgtatacggggtatacgtagacgtactatctcttaacttgcaggcctgattgactggaataataaaatgccagattttcgatatcatctgcactcagggcagccgccataccggccatcaccgggtctttacgtgcacctgatttataatctttcaatacttttacaatataggttctagcttggccaccaattttcgggaacatcggcaccggactgttaccatccacaccatgacaggatgcacaaacttcctcggctttctttttgccagcatcaatatctgctgcgatcagctgccccgacagaagaaatattactccgctaactgcggccaccaaatagcttttcatgttatttatatcccttggattaagaagaatgatcaattgtcagcgtaataagcagccaaggcatcaatatcctcatcggagagtgttcctgcaataccaaccattgtcgggtggttacgctctccagatctgtaatctttcagcgccttaaccaggtaaggcaggtgttgtccgcccagtttcggtacatgataaacaaacggatatgcggtgcgatatccttcaataccatggcagccctggcacatggcgatcttgctcttaactgaatcagtgtttccagctgcatctgccacgccggaaaacgacagaatcatgccagaagcgataagtagtttaacggcagctgcctttttcacttttgcatcctcctctcaaaaaagcgaactttaaacgatgggtgttgtttagtcaatgaaggttgtagctatgtccctgttgtgtatagggaaattatttcttcagcactttttatcctttctttttacaaattgtttccacgatgatctgcttgttttccagcatctcccagcgggaatagtatgccgcaagctctttttccagctcggccgcacgcgcctgcaataccattgcatcatcagggttgtttttataaataacaggggtactcaatttctgaccaactattatttgttctttttcaaggatatcgattttctccggcaatgcttccagctctttagtttcctgataacttaatccggcagggccaggtgatttatcttttttgaccacctggggcgatttgattatcgatctgagagagtcactactttcctgctgtagcgtttttacatttgatttagattgcaaccattcctgatagccgcctgcatattcacgtagatacccatctccttcaaacacaatggcctgggtcaccacattatcaataaaggcacgatcgtggctcaccagaaagagcgtaccgctatattcctgcaacaaggcttccagcaattcaagtgtctcaatatcgagatcattggtcggctcatccagaaccagcacattagccgggcgtgtaaataagcgagcaagcaacaaccggttacgttcaccgccagacaaagattttacgggcgagcgggcacgctgcggtgggaacaggaaatcctccaggtaactgatgacatgcctgcgcacaccatcaatttcaacaaactctgaaccctggctgatggaatcaaccaaagttttatcttcatccaattgctcccgcagttggtcaaaataggctatggataacttggtgcccagtcgtatcgtcccagaatctggttgcaactcacctagtattagtttcagcaaagtggacttgccggaaccattagggccaagcaacccgacacgatcaccccgcatgatacgacaagagaaatctcgaataatcattttatccccgtagcgcttggtcacatgttccagctccgcgaccagctgcccggaatgctgccctgcatccacccggaaactgacattcccaatccggtcccgccgagccgcacgctccaacctcagcgcttccagtcttctaactcggccttcattacgcgtccgtctggcttgaactcccttacgtatccagacttcctcctgatccagcgccttatcgaatttccggttatgaatcgcttcgatttccagcagctcagctttcttctgctgatatgctgaaaaattaccgggaaaacttttcagctccccacgatccagctcaatgatgcgggtcgctacgttatccagaaaacgtcggtcatgagtaatgaatatcacgctgccggaaaacccctgcagcatttcctcaagccattctatcgacgaaaaatccaggtggttagttggctcatccagcagcagcacatccggtgacacaaccagcgcccgcgccagtgccacccgcttgcgtcctcctcccgataacgttcctacaatcgcatcttcttgcagatcaagtcggttgatcgccgtttctactttatgatgaagactccagccattttgggattcaagcacgctctgcaactgctgcatacgatcaagcagcttctcggtatctgctccctcctcccccagcgcatgagatacctgatgataatctagcaaggtctgtgccagtgtaccaagccctcgggcaacctctgcaaatactgattcattctcatctagcaccggctcctgcgggatataagcaacgtttacaccaggcgccatccacagttgcccgtcatccagtttgatctcacccaccagcgcacgcaacagactggatttaccggtgccgttgcgcccgatcaatccaacccgttcgcccggatcaagttgcaacacggcttgattgagcaaagcatggtgaccaaaggctaaacaggcgttatcgagtgtcagaagcggcatggaaaattattaatcaactgaggaaaaacagtgtctttgaagcagagatattactgtcctctaaaatatcaagacaggctaactcaacaaccataacattattatactactgcctcaaactggcgacagaagatcgctgtgctgacaacctgaaaacccgtttaattcggcactaaccagtatttcacggatactcgttacagcagaacactttttattttgaatatttatgcatccagaaaaaatcgcactgacacaaacggtacaaaaaggcgggtgtgccgccaaggttgccgccacaacattacaccggattttgcagcaagtcagatttccagctgcacactctgcgttgatggtggatggccgctattttgacgatgccgccatctacaaaatcaatgaacaaactgctctggtgcaaacactggatttcttcacgccgattgttgatactccaagactgtttggtgaaattgctgccgccaatgctatcagcgatgtgtatgccatgggtggcaggcccgttaccgccatgggtattctggcatttccgctggccaccttatccgaacacatcatcgttgatgtcctgcaaggtgccagcgataagatcgctgaagcaggtgccaattttgtcggcggccattcaattgatgatgacaccttgaagtttggcctatcggtcaccgggttagtcaatccgcagcaggtatggaccaatgccaacgcacaatcgggagatcatttggttttgaccaaggcgctgggaacaggcaccctgacagccggaataaaacggcaacaattgcaggagaaggacatcatggacgcgctagaaagcatggcggccatcaataacgtcatcgactatctatcaccggatttgctggcagctatccatgccgctaccgacatcaccggcttcggcttttccggccacgccatgcaactagcaaacgccagcaacgttaccctgagcattgcaactggtaatcttcccaggtttgacaaagctttctactgtctgaaaaatagttttctgaccaaagcacaccggaccaatgcagagtacaccacgccacatatcgacgatgcaaaactggatgcgctgtacaaactgctaattcacgatccgcaaaccagtggtggtttattattaagcgtggtacccgaagccagccagctcgtgctgcaggcactgcgcacatacttcaagccagcagcaatagtgggaaccgttcatcctcgtcaagataaagcggtgcaatttgaataatccaaacattgatagcgatgagctaacagctttattcacagcggatacgccactgattgacgtacgtgcaccgcttgaattcatactgggatccctgcccggctcagtcaatctgcccatcctcaacaacgaagaacgtgcactggtcggcactacttacaaacagcaaggttccgaggcagcagtcatgcttggccatgagatgatttcgggtcaggcaaaacaggatcgtctgcagcaatggcttgattttatccggcaacatccccgaaccgtgctgtattgctttcgaggaggaaagcgctcgcagatcacgcaacaatggttgaaagatgctggtgtcgacaggccattgatcatcggtggttataagcaggcacgccaatttttgatcaacacaattgaccggttcagtgaaaaccacacgctactggtcattaccggaccaacgggcagtggcaaaacccagctaatccaggagatcagaaacagttacccggtacttgacatcgaagcccttgcccggcatcgtggctcggcttttggaggaatgtctctcccccagcccacacaaatcgattttgagaatcagttggctgtcaatttgctcaaactgaaacagaactatctgtttgatccagtcgttgtggaagacgaaagccgacataccggcagggtatatttaccagccagcttctttgaacacatgcgcagctctgaaatcatctgggtggatgaaccattgaataccagggtagataacatattcggagattacattgttgctacccctatcggccaagcacagcaggctcggcgcaacacacaaccattgtcttctgctacggaaattcaggaaatactgtgccaacaagcgctgttattattcgacaaatacgcaagtgccttgcaggcaatcagcaaaaaactgggaggagttaggtttcaggaagtatcacaggatctggaaaacgcccgatccagctttgtaaacagaaatgaaattcaatcaaacaagacctggattgaaaaactggtgagatattactatgacccgctgtatctcggctcactacaacgccgccaggtcaatccctgcttcaagggctcaaggcaagcagcaatcgattatctgcgggctcgcaaacaacacgcttgacgtatctccttccgcttgccaccccaaatgccatggatgattaccagcatggcggaagaaagtgccacaaaatcgttcagaatactcgcagataacagtaggaaaatatcgatagaaccagacaaataaacgaaaatgtggccttggtcatactccaattttatcttgacatgatgtggaatcaaatacctgtaagaaaccttacgtaatccatatccttctcaatacttaccgcctgcatatacaatagaaacaacctgcgtatctctttcatacgactactgttcactctgatcaaaaaaacagcttcacctgtttcgtagattgcaatccgcgcggcagcaatcatcattcttcgaaagtatcgagatcgattccagatttacccggcgccaagatattatttggatcgagcgctcgtttaattgcgtgttcgacccgacgctttactggaccatagctttgtgcgacacgctccataaaggcagtattgacgcggtagacggcatatccctctttttcgaattcattgatcagttcatgaaaacaccgataagcagattcggtttcttccctactggtgcgatcgtacagcacatcgatgacatgatgcatatcgcgccaaccgacaatgaattcacccacgtaatccaaaccgtgtttgttgaggatttttttggccagcgtcttctgtttgtcacattcattgccacgggcctggctaaccggtgcaaaccacatggagccgccacctccacgccagttgtacaatccgaattcctgcagattaggcacaccggacatcagctcggcacgatacttgaacggctgagtatcgcctgcttcctcctgagtaatgatcgtgcccttacctgattttttaattgtttcggtgacgatcttccagttaacgtcaacctgttcctgagtgccgtacaatgcggcataaacgttccaggcacccagatttttatcatgctgaatctgcttgagtactgaatccggtgtcgctccacgcccggtcatgtattcggagcgacgtacgttggcacttcccgcctcccacaaaacattagcaattaccaccgagtttggaatgacctgggtaatccgcaatggacgcagtagttcaacaatatcagcaatatcggattcatgttcgtacctgatctcgaatggcttgattactgggggcctaggcatcagccagaagcccatcttggtacaaatgccataattggcttgggtaaacatgccatccagagtcgggccgtagccccacttgaatacctgccagctgttatcccccttgacaccccccataccagttctcagtacttcaccgttagctaataccaattccataccacactgcatcataaaatgctcaccgtacggcgtatagccgacaccacgatccatggtattgccaactggcccggcaatcgccgatggtgcggaaaatgacaacatcagaggcaaattattttcctgaaggtagtcatataactgcccataggtcaccccaggctcgaccagcgcagtgcatagttctggatcaacatgaatgattttattcatttttttgagatcaagtatcacctggccacgatggtgtggtgcagcagagccataaccgaaattgcgaccagtagaaatggtccagattgggatcttgtatgtgttgcagattttgacaacctcttgaacttgtttcacagtcgttgcgaccaaagtagctgatggcgcatgctcggcatcatctaccggcatcatgatttttgtgtaggcaatgagctgttctggtctggtcaatacatttttatcacccaacaatttttggaatgcttcaatagctttctgaaattcctgctgggaaacaccacgaggcaacacatcatggttttgctcattcatattgaaactccttgaatcttaaaggcaaaggaaacgaagtgtccattcagcggcgctaccgacccgctgttaatctgtggagcctccgaaaaatcaaccagatcatcaccagtcagcgcaaatccaagatctgtgctccactgagcatcttcccgaaccccttcacgtgtgtacaaaatgggttctaatacttgttcttctctctttcgatggcttccatggatacagctgaagccacgtaaagcaagctgatgcccgaacaatccaccttgatcaccagcaaccctgctgctgtacaacagatggcgggattgttctggctccaccgtatgctgtcccagccagcgcatacaagcgcctgtggaacgagccagatcaataataagtgtgccactggcatcatccaccaaaccagtgataacacacccttctgtcgacatttccttaatgcggcgctgcaacagcagcagaaaatcccgttctatgttgatgtcatgtacttccatattggcaccaccagcaatccaggcaccctgcagaaaagctgaatgttctgtctccccgtttaccagcagtagagtcgtttccgggttgaaaaacttggcagattgggcgcggttagtagcggcggccagagcaacgcttggatttgcccatccaagacaacctgaaacaccgctcagaacgatacccttgagtagtaggcgacgctggatatccatggaattaccctcactttttttcaggagtggtttgttgaatatattgcccgagggatttcaaatcttcgttgctaatatacggctcaggaaaagcaggcatagctcgaaacccgtgccgcacgacatgggtaatatattcgggcggtaattgccggcctttgatagaagggccaatcccggtgtcatgacaataaccacacaccttggcataaacgttttcaccgcttgaccactgaccactatttccgagatctctctctacagcctcttcagcagcgtaagctggcaagataaacaaggccatagacagcgtcatgctgatcgtaaaaattcgttttacaaccagatcatcttttagaaagaacatttcaacacctccgtttattgctgacggaaaaagtaatccgcaggaaaaatatagttcctgcatataatctggcaaatcgtctagttgcagaaacaaaatcacctgctcttttccaaaaaagtaggttcaataggcgatcaaatgcgcattaaaacagcagcagagcggattgttcaggttgcttgattcaggaaccaatcacaataatcatccatacagtatattcgcacttatctgatgaatcaaaataaatccactctccatcataacctccagcagacctgttctcctgccctaagtggcactaacctgtctccaccaaactcgacctctccaggtatttgccagctttctttgcttaatgaaatttgatccgtgttgcgcggcaagccataaaaatcagggccgtagaaactggcgaatgcctctagccgatcaagccttccagcctgctcaaatatttcagcataaaattcaatcgctgcgtgggcgctgtaaatacccgcacaaccacaggctgattccttatcttttagtgggtgtggcgcactgtcagtaccgagaaagaaacgagaatgaccgctggttgctgctgctaccagcgcctggcgatgaatttcccgctttagcaccggcaggcagtaatgatgtggttgtaaaccacctgtaaataaagcgttgcggttcagcattagatgatgcgcggtaatcgtggcagcaatccggttggaaatcgactgcacaaactcaacggcctctcgagtggtgatatgttcaaataccaccctcaaccctgggaaacgctgtaaaagtgggatcagcacccgatctataaaaattttttcacgatcaaaaatatccactgcaggatcaaccacttctccatgcacaagcaaaggcatatcaagcttctccatcatcgccagtgtggccttacagcggtcaatatcagtaacaccagcatcggaatgtgtggtcgccccggccggatacagcttaactgcctgtacaatcccgctcgcctttgctcgactaatttcttcaggtgtagtggtatcggtcaggtatagtgtcattagcggctcgaactggcctaccaattcctgtggcaaggcagacaagatacgggcatgataggcagccgcctgttcagtcgttaccacgggcagtttgagattcggcatgatcatggcgcgcgcaaaacgccgagcagtatcaggtaggactgactgcatagccttgccatcacgcagatgcaaatgccagtcatccgggcgggtaaacgtcagcttgtttgtcatatcgttcaatccggttttcctcacaaatcaataaacaaacacaaattctcctctagaactccacagcagtaaaaatttccaaatctggctggatttgtcacatccctgtcttttgttccagcagcgcccgggtatacagttttttcctgctctctccggtaatttctgcagccagttgcacggcctgtttcagaggcagatctctttgcagaatggccagtgtatgcacggcttgcaggctgatatcttcctgatctggctcttcctctggcgccagcagcaaaacgaattcacctcgcagccgattttcatctgctcgcagccaatccagggcttcgcccagtatgcaggtgtgaatcgtctcgaaaatcttggtaagttcacgggcaaatgtgatttcacgggttgggccgaatacggcaaccatatctgcaacacattcgagtacgcggtgtggtgcttcataaaaaaccggaatgcaagcatacaatgtcttgagagacgtcaatttgcgctgacgctcaccacttttagctggtaaaaatccataaaagaagaagtgcggagcaatcaacccggaagcagacaaggcgcacagcgccgcattggcaccgggaatcggcactaccggaaaatttcgcgcacgcacctgttgcaccagaaaagcacctggatcagagatagccggggtgcctgcatcagaaatcagagcgacggattgaccagataccaacagctcaatgattttttgcgctgcgttaccttcgttatgctgatgcaacggcgtgattcgagtatgtgtagtgttgttgtgcacagcgatgtgtacagtgtgtgctgccagcagtttttgtgcgctctggacatgctcggctgcaatgcaatcgacagcagatagtacctccagtgcacgcagggaaatatcacgcaagttcccgatgggtgtgccaaccacatataatgttcctttagatactcctgctgcagttggcatattctggttataaaacgtctgttcctatgattttccacgggcataatcgcactatacggcagttcctctgctttttccatttacagtcagccagcttccagcctgtttaaccagcttaaatccaagccaatctgatattttatgacacctgatcacacaaccgccccgctggttcgtctgctgcgctatggccatctgtttcgtggccgcatctggctcgccacgctttattcgattctcaataagctgtttgatctggcgccacccgtgctgatcggtatggcagtggatattgtcgtcaatcagcaaacttccattttcgcccatctgggatttccggatgtctccacccagctgtggatactggccatcctcacgttgatcgtctggggatttgaatccatctgggagtacctgctcaagctgtgttggcgcaatctggcacaggatatccagcacaccttgcgtctggatgcctacagtcatatccagaaactggagctggcttattttgaggaacgcagtaccgggggaatgatggcaattctgaacgatgacatcaaccagctggagcggtttctggatgtcggagcaaatgatctcatccagctgctaactactgtgattacggtaggcggcatgtttatttatctgactcctggtgtggcgtggatggcgttattaccgatgccgttcgtcgtggccggttcttatttgttccagaagcggattgctccgcgctatatggctatccgcgagcaggtcagcattttgaacagctatctgtccaataatcttagcggcattgccaccatcaaaagctatacggcggagcagcacgaattgcgccggatcgagcgtgaaagtcatgtctatcaggaaaaaaaccagcatgcaattgccctcagcgccgcttttgtaccaatcatccgtatggtgattgcactgggcttcagtgccattctagtggcggcgggattaatggctgccggtggagacctcaatgttggcgcatacagtattctggtattcatgacccagcgcctgctgtggccgctcacccgcctgggagaaacacttgatttgttccagcgggcaatggcttctacccaccgtgtgctggatttgctccaggctcaacccaccattactgatgggccgcaaaccctgactactgcacagattggcgggaaaattgtttttgatgacatcagcttccattatgagcggcgtatttccacgttaaatcatctttctctgactatccccgctggcgagactattgcactgatcggcgctaccggcagtggcaaaagcacgattgtcaagctgctgctgcgtttctatgaaccacaacaaggccgtatcctgctggatggtcataacatccgggatttacgcctgcacgatctgcgcaaatcaatcggcctggtcagccaggatgtttacctgttccacggcacggtgtatgaaaacatcgcctatggttcttttggcgccagcatggaagacgtgatcgctgccgccaaggcagccgaggcacatgatttcatcatagaactaccggatgattatcagaccatcgtgggagaacggggacaaaaactctccggcggccagcggcaacgcatctccattgcacgcgccgtgctcaaggatccgccagtgctggtactcgatgaagctacttcagcagtagataatgaaacagaagccgccattcagcgctcactggaacgaattaccatcggccgcactactattgttattgctcaccgcctctccactatccgtaacgcccattgcatttatgtgctggacaagggggaagtagtggaaacaggtacgcacgaagcactcctgacacataatggcctgtatgccaacctgtggcgggtacaaaccggtgaaaagataaaagggaatttctaaaaatcagtaaaaattgcctttgcaaatgccaatggacctttagccgcaagtgtagcgtactgaagcaacccggaataattccccaataagttacaggtactcctatgtcatccactgaaaacaaaggcagtgatgccgaacaacaggccgccatttttctccaacaacaacaactaactctgctggaaaaaaattatcgctgccggtttggtgaaattgatctcatcatgcaggatggcgacacggtagtatttgttgaggtcagaatgcgcgttaatcaactctttggtggtgcagctgccagcatcacgcctgccaagcagctcaagctgacacgcgccgctcggcattatctggcaaagtgtgatgaagattttccctgccgttttgatgcgattctgatttccggaaaccgggaaattgaatggatacaaaatgcatttgacgaaggctgatgacgggccgcctaatcaatgcagcgccattaaacataggtagttgctggttatacagactgacaaacgtatcaaggtctgttccagatcttcagcactattgaatcgatgtgtcttgagtacgtcagcaatacacccgttgaaacgctcgaccatcccattggtttgcggagctatagtgctcccctttttcaagatagcaatttaagctggacactgccataaggaacgagtcgtaatgagcgaatcgaaaagcagaaatatcacagctccgagttcaaagccaaggttggcctagaggctctgcgtgggcgtaaaggcaatcaacgagattggccaggaatacgagtatcctggatgcgacagacagatctaaaaatggtagtgcgctccgattcccatatagtcaactttttctttaaaaaattgaccagtaggagagttcccattgaaatattcggcaaaaaattgaagtctcctaccgaaaatctgaaaatcttcaaattgaaatccagccttaacagagagatcagcattccaattgttttgttcgtaattcttaatatcaatcgccagaacaggccgtactggggcaatatccaagcgccacgggctcctgaattcgatgccatattgaattgaccaaggtttgattgttgagggttctttgtgaaagataccgccacctcctccataaacacgcactccatagggaagttcataagacagtctgagatcgataccttcgtaactaagattgacccgatcgaggtcggttagcttccttagtagaaattcatccccaagatgcgagctctgatgataaatccgcgcgaatgcagatgcattacctgcacgcatgcttgaataaatcgatgcaatgaaatctgtgttgatgagatcggatgaaggggcgtcgagattgaaatcgctaaacacgccagcttgcagccccacttcccattgtgcggagtatttcccgaaattggcccgataaaacggtaatgtttcaccaaaactaacagcagcgttattatcaccatcaatattgcccccaaggtaactgcgataggcagcagaaaaatgagcccaccgcggatctgccagtaacggcttaaataaatagcctgagggtaaaatccccgtcgcaagtattgttggatcatcggttgtgggtatgtttttttcttcttcagtaacggtatcactcggcgctggagacgtagtcgtgatgggttgctgatcagtgggttcctttatgcttactccagtcactcctggtatctccaagagcacctgtgtgatcctggcgtgatcttctggtaatacttcacttgctgataaggtaatatttccgttacgtacagttaacgaaggggtatcactcttgagttcgtacttgaggataccggtagcgtaaccagcaatataagaatcatccgttattgcagcgctggcagtggatatacaagccaacgagactatgatggttagcagaattcgcataacatgcctgaattttctcaaggtgcgatttgaacaattttgggccaaaagagaattctttgtttcgtgtattttctgcatctgtcttccagactatttggtttttgatcactcggctgaatactgagagtacgattgcttcactgcgcattatcaggaaagggcaaaagaaccttttcaaagtacttctatctgaaccaggatattaatttaatccaattcaatcggatgaagattcaattctgtttgaactgagcctgctggaacccattccaatttttagtagctaacccccttgcctacctctctaagattattacagaaatagcgcatttagtatgtacaccagcccacaaagccagagcaatcgcacaaacatcacctcaccgtagactgaggagttcagcgcgggaattgtttgatgtggcggcaatcaagcgtcgagtcttgaacctgcctttgcgatcggtcacttcggcagcggtcacaactgccgcgtgcagcaacctgaatcatccggaatgagacatccttcactatcttgccattatctacaacaggggcagtcgtctttgtgtgctagcgtacacatcaagtgcattatttctggtagtctaatttgaggattacgattaaaaatggaaaggtacgatgattcttgctcggcgggttctcagaaaaccgtttcctgcaataataaagacttatcgcagaatcgaacaagatcacggacttcagattgaataccgtacccaaagtagtaaagtaaacaaagtcccccttggtctaaaaaaattgagagggtgtttagctttatcaattattcgagagaaccttatcatgacgatgacgcagcttaataacaatttcttcactttcttcttaagtatcctaataatttctttgctgggctgtgcgcctaccgcaaagcaatcaggaaccggagaatatatcgatgatagtgtcattaccacaaagatcaaagcagcgattttcaatgaacccaccctaaaatctgctgaaattaacgttgaaactttcaaaggtgttgttcaattgagtggcttcgttagttcgcgagctcatgccaacaaagcggtcgaagttgcacgtagtgttgcgggtgtaaaatctgtcaagaatgatatgctaatcaaatagtaattgttgcattgcttaactgatcagccattgtattttttatcattatatgggtatataggtagaaaaatagaatggaatgtaaaaacattgtgcgaccaaggaggctcgctatatgtaatagtgcggcgttgcaccggtcattcaagctacttagatttaattgtctgcctggttggacgcttgccgcttgctcatcaatatttcgtcataatcataataagttgggttaacggggcagggtcttccttaatcgtacgaaccatgcgcaaatagtttttggtcgtcccctctactgtaaagaagtatcccttggatgcagctgaacggtaggggtacgcgcatatgacgaaaaggcctgctccctgcgcgtcttgccagtaatgactgtccagctccacctcattccatctggatatgtatttttaagaggtacttagattctgattcatccaatcatggcattgccaggaaatggaaatttgaaatcttaatccaaaacggaatacattataaatgaaaaccaatagtaactatatcctccgatatctgcgccgatggagcgtctatttgggtggtggtattccactgaaggatgcctttaatgagttgccgctacgtttagaattgctcagtgttgagcagatggaacaacgcggcaggcgtcttgcggccatgcataaattgtcacaggagcgctcgcagaatcagttgatacagcgcctagccgagaatgaagcgatcttaatcaatgtctgcagtcgacttacggcagcggtaaaagccaaccaacagatcacaccggccagtgaatggttgcttgataacttctatcttgtcgaagaacatatccgcattgccaggcgccatatgcctaaaggctatcaccgtggattaccccgattattgaatggttcttcggcaggattgccgcgtgtctatgatattgcactagaaatcatttcgcacggggatgggcgggtagactcggaaagtctcagccgttttgtctcggcttatcaaacagttagtatgcttaatttaggtgaattatgggccattcccaccatgctgcgactggccttaattgagaacctgcgacgcgttgccattcgcatcgccgctaatagagttgacagcgatcttgccaacatatgggccgatcgaatggtaacggtcgcggagacagatccgaagagcctggtgctgataattgcagacatggcgcgctcgcaacctccaatgtcaataccattcgtatcagaacttacgcgccgactgcaagggcatggtcttgctctaacactaccattatcttggatcaaacaggtgctttccgagtcagagctgactatcgagcaggttatccagtcaggaaatcaacatcaggctgctgaccaggtttccattagtcacagcatcagcagcctacgtcttctggggggaatggattggcgcgagtttgtcgaaagcatgagtattgtcgagcaaacattgagggaagatccggacggtacctatggcaagatggatttctccacccgtgaccactatcgtcatacagtcgaaaagattgcaaagcggagttcccttaccgaagccgaggtagcgcgaagtgcggtccaacttgcacatgaggctcaggcagcacatccggatggtgaagaacgcatagcgcatgtgggtttctatctgatcgatcagggcttgcacgagcttgaaacaaaagcacaagtacgcttctctatcgctgaaacactcatgaaaatgggggcgaagtatacattacacgtgtacctcggtttgatcacactcctgacactgctgttcagcaccggcctagtagccatcgcgcatactcaagacgtgacggatgaattcttgctgttgatcggtatattcgcattattacccacgagccagttagcactcgccctggtgaattggttagcaaccttgttggtgaccccacatttgctgccacgcatggatttttctacgggcatccccgcgcaatctcggacactagtcatcgtgccgagcatgcttactaattcgcaaagcgtcaacgacttagttgaagtgctggaggtgcattttttagcgaaccaagataaaaacctctattttggtcttttgactgattttcacgacgcacatgaagaaacgctacccgaagacgagcctttgctgcagctgactcaggcgcgaatcgagacacttaatgcaaaatatggtactgcagaaaagagtattttctttctttttcatcgcccgcgccgctggaatccacaagcgcttatctggatgggttatgagcgcaaacgcggcaaacttgccgatctaaatgcattgttgcgcgataaaacacgtagtaatgtcgataaacgcttttcacgtatcgttggtaatacctcttgtctcacaaatataaaatatgttatcaccctggatacggatacacggttaccgcgcgatgttgcatggcagcttgtagctgccatgtcccacccactgaaccgcccccgctacaataagacgcgagaacttgtatgtgaaggctacggcattcttcagccgcgcgtcagcgtgagcctggagagcactaattgctcgcgttatgcacgattacatggtggtgaggcgggtatcgacccctacaccggcgtcatctcggatgtctaccaggatatattcggcgagggctcttttattggcaaaggcatttatgatgtagatgcgttcgaacgaacattgaatgagcgctttccagagaaccggattctcagtcacgacttgctggaaggatgttacgtgcgctctggtttgttgagtgatgtacatgtatacgaagattaccctgcacactaccttgtggatgtgagccgccgtcatcgctggatacggggcgattggcaattactgggctggttgctgccagatgttccgggtcctggtaagcatcgaccaaaaaatcctctctcgcgtttgtcgcaatggaaactgttcgacaatctgcggcgcagcctcgtaccgattgcgttactgctgctgctattattaggttgggtagtgttggcttcaccctggttctggaccttggccgtaattggtacactcttgatttcacccttagtagaattggttgtggaaatctttcgcaagccagaagagggatcgttatatcaacattttgctgcgtcactcgacacggccagccaacgcctggcgcaaggagccgttactttagcatgtcttccctttgaagcctggttcagcttagatgcaatcatgcgtacggtgtggcgtatgtcatttactcacaaacggctgctcgaatggaatccatcaggcgaagtcgcgcgcagcagccacacaggcttcaccgccgtattgcgcgcaatgtggattgctccattgatcactattgctacaatcctctacctgctgctattcaaacccactgcacttgtagtagcgggacccattctactactgtggttaggttcacctatgcttatctggtggatcggacagccactcacacgaggtgagacacagctgacagctaaacaaactatctttttgcgcaaaatttctcgcaaaacctgggcattttttgagacttttgtcgggccagaagaccattggctgccgccggataattatcaggaacatcatggtgttgctgttacacaccgtacctcaccaactaatatcgggatggcactactcgcgaatttatccgcttatgacttcggttacctagcggccgggcagctaattgagcgtacgacacataccttcaataccatgcaaacactggaacgatattgcggtcatttctacaactggtatgacacgcgatcattgaaaccactacatccattttatgtttcgacagtggatagtggaaacctggcgggtcatctgttgaccttgcggtcaggtttgcttacgcttgctgacgaaaaaatctttgatgtacgctggttccatggactccacgacacacttggaatcctgttggatgcagcaggaaatactcgttcggatctgctcatcgcattacggaaagatatcgattccgcatgcagcgccccacctactacactcacacttgcacggcaatgcctcggccagttggtgaaacgtgcagaagcgtttgccggcagcattacgactgccacgcagcagccctctcaaacagagaatgcacttatatcaacccgtaagaagcaaccacccgccgaagctggggggtacctggtgatagacaagcatctcatgcacaaccccaccttggatcacaccggcgccatcatttccgatacaactcctgagagtgacatggtttggtggtcatatgcgctggtccggcaatgccgcgcagccttcgacgaactaacctttctggccccctggctggcgttgccagtcgcaccgagtgggctcgacaacaaccttgatatcaccgagattccaacgttacgagaattggaaaatatcggaaataaattgctgccagcaatcgaacaacgacttgaaatctcccttacgaatactttgacatctgcggaacatgcatggctacgtgagtactggcactgcatcacacaaacgtgtcatcgtgccactgagcgaattgcgaccatcgagcagcttgccatgcaatcgggtgaatttgcatgcatggcatatgacttcctatatgataaatcatcccgtttactggcaattgggtacaacgtggatgagttgcgacgagatgcaagttactacgacttgctggcttcggaagcgagattaatcaattttgttgcaattgcacagggaaaagtgccgcaagagagctggtttgccttagggcgtttgcttacaactgctggcggcaaacccgtgcttttatcgtggagtggatcgatgtttgagtatctgatgccactcctggtaatgccaacctttgaaaatacactgcttgaccagacctataaagcaacggtagcacggcagattgagtatggacggcagcgaggcataccatggggcatgtcggaatccggctataacctagtcgacgctcatctcaattatcagtatcgagcatttggtgtgcctggcctgggactcaaacgcggactcgctgatgacctggtcgttgctccttatgctaccctgctggcgctgatgatagcacccaaggcagcgtgcctgaatctacagcaacttgttgcacaaggactggaaggtaaattcggcttttacgaagcgatcgactatacgccatcacgtcagcggcgcggggagctaagcacaatagtacgatcttatatggcccaccatcagggaatgagcctgctctccctggcctatctactactgaatcgcccgatgcagaaacgcttcgaatcagagccattgttccaagcgactttactgcttcttcaagaacgaatccccaaagctacgacattctttccccgcacgacccaattttccaatatccagctggctgctcgtattgcagaagcaccgattcgcattttcagcaatgtcagaacgcctctaccggaagttcaattgttatccaacggacgttatcatgtaatggttacccacgctggtggtggctatagccgttggaaagatcttgccgtcacacgttggcgtgaagatacaacttgcgataattggggatcgttctgttatctgcgcgacgaaagcagtggtgaaatctggtcaactgcctatcaaccaacactgaaacagccgcagcattacgaggtgattttctccgagggacgcgctgaatttcgccgtcgtgattttataggcgatggcgattttgaaacctatactgagatcgtagtgtcaccagaagacgatatcgaactgcgccgtgtgcgcattactaatcgtgcccatacttcccgcaccatcacagcgacgagttacgcggaagttgtgcttgctgtacccgttgcagatatgctgcatccggctttcagtaagctgttcgtgcagaccgaaatcgatgagaaatatcaggcaatactttgcacacgccgaccgcgctcagctaccgagcaaacatcctggatgtttcacatgatgacaacgcatggagtggacgtcaatgccatttcttatgagacggatcgaatgcaattcattggccgcggtcacactgcagccgatccgcaagcgttaagcagcacatcctcaggaatgctttctggcagccagggttcggtgctggatccgattgttgctattcgtcatgccattacactcggcccggagcaaacgattaccctggatatagtgagcggcataggagagacgcgtgctgacgctataagtctgattgggagatatcaagacaagcgacttgcggatcgcgtctttaatgttgcttggacacatgcccaagtagcgttacgccaactcaatgcaagtgaagctgacgcacaactttacggacgtctggccaactctattctttataccaatagtttactgcgcgctgaagccagcattttgatgcagaatcgtcgtgggcaatccgatttatggggctacgccatttctggagatttacctatcgtcctgctacagattggtgatgtagccaatatacaattagtgcgtcaattggttcaggctcacgcctactggcgtttaaaagggttggcagtggatctagtgatctggaatgaagatcgcgccggttaccggcaattgctccaagaccaaatcatcggtttaattgcggcgagtaccgaggcgcacgtcatcgatcaaccaggcggcatcttcgtgcgacgcacggagcagatatcgaacgaagaccatattctattccaatccgttgcacgagtgatcataacagatacccgaggaacgctggcagaacagatcaaccgccgcaacatcggggatgtacggataccgcgctttcggccgagtcaaagctaccgtgcagatccccctaacagtagcccattgccgccacgtgatcttattctgcacaacggactgggcggattcacgcgggacgggcgcgaatacgtcataacgaccacagctacgcagatgacgccagcaccatgggtaaatgtgttggcaaatccacattttggcacggttatctccgagagtggccaaggctatacctggagcgaaaatgcacacgagttccgtcttacaccttggcacaatgattcggtgtctgatacaggtggagaagccttttatctacgtgatgaagagagtggccatttttggtcacctacacctctgccctgccgtggcgcaaatccgtatgtcagccggcacggatttggctacagtgtgttcgaatatactgaaggaggcatcgtctcagagctgtgggtatatgtggctatagatgctgcagtcaaattctcagtattgaaaatacgtaatgtatccggtcggccacgccgactctctgcaactggctatgtagaatgggtgctgggcggtttgcggtcaaaatcaatcatgcatgtgaccacggaagtagatcctggcagtggtgcggtgttcgcacacaatccttacaatatggaattcgttggtcgaattgccttctttgatgtggatggagtcaatcgctcaatcagttgcgaccgcgccgagttcattggacgtaacgggtcactcagaaatccggctgccatggcgcgcacacgtctttccggtaaggtgggggcagcattagatccttgtgctgcgatccaggtaagtttcgacttggcagacggagaagaacgtgaagttattttccgcctggggcaggccggtaggcgtggggccgaagatgcgcgcagtctggtgcatcgttttcgcggatcaacagccgcgcacactgcactcgaggcggtatggcaatactggaaccacactcttggcgcagtccaggtggaaaccccagatccgtctctcaacgtgctcaccaatggatggcttatctaccaaacacttgcctgtcgcttgtggggacgcagtggttattaccaatcaagtggtgcctttggtttccgtgaccagttgcaagatgtgatggcgctaatccacgctgagccaaaacgcgtgcgtgagcaattgctgctgtgtgcagcgcagcagtttgtggaaggtgatgtgctgcactggtggcatccaccatcaggtcgtggcgtacgcacccgttgttcagacgattatctctggctaccgctggcagtatgtcgttatgtattgagtaccggtgatatgggtgtgctggatgaatccgttccctttctcgaaggccgcccggttggccctgaggatgactcatattacgatctgccgggacgttcgaccgaatcagccagtttgtaccaacactgtgcgcgtgctatttggcatggcttgaaatttggtgagcatggcctgccgctgatcggttccggagactggaacgacggcatgaacctagtaggcttacacggcaagggtgaaagtgtctggctcgccttcttcctgtacgaagtattgatgcgcttcgctgagctagcgcagcagaaggatgacatgccttttggcgaacaatgtcggaacgaagctgaacaactgcgccaacgcatcgagcaaaatgcctgggatggtgcctggtaccgccgtgcatacttcgacgacggcaccccactgggatcggcgagcaacacagaatgtcagattgactcaatctcacaaagctggtcggtcctctccggcgcaggagaccctatacgttcacgcaagagtatggacgccgtctatgagcgactggtacggcacgatcatgcgctgattcagctttttgatccgccgttcgacacatccgatctggatccgggctatattaaaggttatgttcctggcgtgcgcgaaaacggagggcagtacactcatgctgctatctgggtcgtcatggcggtcgcggccttgggcgacaaccagcgtgcatgggaattgatggacatgattaatcccgtgaatcatggaaaatcagcaacagatgtggcgatttacaaagtcgagccctatgtcatgactgccgatatctacgcggtctcaccacacatcggtcgcggggggtggagctggtatacgggttctgctggcttgatgtaccggttgattgtggagtctctgcttggcttacgactagacgtggataaactctattttgatccctgtctgcccgcatcctggcaagcgtttaaactgtattatcggtatcgggaaactgtctatcatattaccgtgtcgcaaacgacggatactggcaatgctccacaaagcagtgtaatgcgcgttacggtggatggcatcgaacaatccgacaaaactattccgctaattgacgatcgtcaggatcatacggccgaagtaaacatcgtaaccccgcccagcgacactgatgatcaggcagataatcgagtagaatgaggccaatattaactagtcgcccctgaaaaactctcgctactgattgcagtttttggaatcaaatctgattttctattgttcattcagatcaattcgcatgaactgaggtttttatcagaagattggggtgatttttttattttccgcatgagaaaacggcaaaaaaatggccagtagccattgtttcagattccaggcgcaagcggccatcaagaggttgatgtgatcaccaatagcgcctttcaggtaatttttttccattcggtaatctgcttctaaatgaccaatgatggattcaatggctgcatgtcttttgcattgcttgcgctttttgtctcgctggtaacggttatcctgtttgaggatcttgtccggtagtacgatacgggttccgttgacttcacgcttgccacaatggccgcaatcacacattgcctgcctggcgtctcataatagcccgagtggcttacctccaggaggcaacacaacaactacgggcaacagagatcgccttcttttgtaactggtttgacgagctggtaactcatttcagtccccaggcaaagaaggctgacgcctttttaagatatcgacatccatcttcagttgccggttttcctgctcaagctggcggataagttgttgttcggcagtgagcggattgccgatgccaggattctcactttgttctgattcatattaagtcacccagcgacggatggcactctggccgatactcatgctttcactgatgtgggctatgctcagcccctgttccttaatcatacgtacgatttctagtttgaagctggtatcaaattgcctgcgttgctttttcatgtaaaactcctcggatgatgaattctccatctatcgaggtgtccgggcaaattagaccactcactgtccttcaccatttgatagctcgcgcttgtataaaccagtaagcatcggacgtaatgctccctagtcagtcagcgcgtcaatcttcatcactacgttgttttgtttcgcacgttgcgccagttccagggatccaaaattcatctgcatcttctactcctctcactttttacctttcgccagtttagttgtttatttggctaacgtggggaagtggtgtagaagtcttcctactgtaaatttaccggcccacccgggaaacggccgtctcacaaacaaataatcagaattcttaaaaagaatttttcttcccgataaatctggaaataaatgataaaactgaagtaaaacctggataattaaaccaagttgctgaaagaaacagaactggttaatgattgaacgcgagatagatcaagataaagttattacggaataaactattcttattattgcaacccatccccgccgcaggaaagctggaggggatagtgtataggtataaccaacacagcagcgagatatcgtgctatgcagttgtcaaaaagttagttcacaacaggcgtaagatgcacggctagtgcagcacatccagctaatagcaccaataaaaatacaccggcaaataacatattcttggtggtatcaatatcgctgtctttttccactgtactcatttttcataactcctttatcgtatgcattaaaaatgaaacgatgatgaattgaatttacatcttatttattaattcacattaacaaataagatgtggccagccagaaatatagcataaaaggcctactttttgtataactcggaagagttgtaatctttggttctcaatttacaggattcacgtagccaaatgtacgatctgtttagtcctaggtgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcattttatctttgacccattccagcacaccgtgggactaaacacctaggatatgcgggtctatcttagaacctgttcaaaaagaggataagggcaaaaacacagcaagaaaagcttagttgttctgctcggctttattttttgtaagagcagtaaataacgcagggataatctttttttcctgcctgtatgcgagaagcaaagattgagcatctgattgcttaggagttgccaattgcactggatttgcttgtggaatatagggttgcgtaaaaatggggtctttatgattttgtagcgcgcttctgcgtgatccggaatattttctagttttctcaccattagcaacttcggcttgcttattgctacgccgggcaatatcggctgacaccctatttttacgatctggcaagctcctgacaaataactccgcatcaaaaccagcaatctgctctatctccagtttagtgttcagaagtttttcgatactggtcagaagctctgtttcatgttcacttaccagagaaattgcctttcctttactaccagcacggcctgtacggccaattctatgcacatagtcctcgggattaccaggcaattcataattgaccacatgcgataatttttcaatatcaatgccacgcgcagctacatctgttgctacaagtatctgcacatcaccatgtttgaactcagaaagtgcttgtgttctctgttgctgatttttatctccatgaattgcaagcgccaagattttatggtgggaaagcatttgcgccagttgggaggctccgtgctttgttttcacaaaaacaagtgcttgtttcagatcttgctgtttaacgagatgcagcagcaatgcaaacttgctttctggttttatgcggtgaacaacatgtgaaatagattcatttattgtattctgcgctgccacttcaatccgaaccggatgtttcagcaaaccgtctgcaagttttctgatctcatcggagaaagttgccgaaaacatcagactctgccgctgtgaaggtaacaacgccatcacttttttaatatccggcagaaagcccatatccagcatacgatcggcctcgtcaagaaccaggatttctgtttttgaaaaatttacagccttgtgctcaaccagatccagcaatcgaccaggtgtggctaccagtatttccaccccattccgcaactctgttatctgaggttctatattgaccccgccaaaaacgacagtggttcgcaaagcaagatacttcccatacttcctgacactttcatcaatttgcatggccagttcacgcgttggagccataatcaaagcacgtacaggatggcgtgcaggcgacgtgctagagctcgcatgcacttgcaggtggtgtaataaaggcagagtaaagccggctgttttaccagtacccgtctgtgcactggccatgacatctttgccggcaagaatcggcggaataacctgggcttggatcggagttggattaatgtacccctcatcaataactgcccggagtatttcactggacaagtccagctgctcaaaagttacatcactactcatagtttatttttgcaacaagtaaaacaaaatttttcaatgatattgttttaatagcatacacgacaagaatcaacattcatcaaatttttcattaattaattgtcgcatcccggatgattgtatggttttttatgaaagagatgggggtgagttttataccattctttcatagcctgcattggagttttactcttgagggcagactgcggtagttgctgattatacaggctgacataacgtatcaaggtttgttccagatcttcagcgctattgaatcgatgtgtcttgagtacgtcagcaatacgcccattgaaacgttcgaccatcccattggtttgcgcagtgcgtggctggatcaggcgatgttcgataccgagttcctggcacagctagtcaaactgatgattgccactgggattacgttcacggctggcaaacagtctgtcagtaaattccttgccgttgtctgtcagaatacgggtaatcctgatcggacaggtattgtgcagcgtcttcagaaatgctctggcgctggctgcggttttgttgggtttgatggccacatacacccaacgtgtggctctgtctattgctaccaacaggtagcgcctgcggtgtttatcttgcatttgcggcagctatttgatgtcgatatggaataaccgggttgataatgcttgaaagccttgtgtgcgggttgcgcttctttgggtttgagcacattaagattacccacaccatggcgttgcaagcatctgcccagcccggagcgagagacgtcagggcataaaaattcacgggtgacggccagcagatcatccaaaggcggcagcagtgagcgacgcagataaatcacaatggcttcttgtgctggtgtaagcgtagtctgcagccggcgtggcgtgtgtgaccgattgataaaaacatcgcgatgcttccatttgcagatcgtctgttcggtgacgccatagcgttgcgccagcaccacagcagagtcaacgcttgcggcaatttcagaccgtatcgctggtgtagtacgagcattcttatgtaaagctattatcatttcatggctctcccggatggcttgaaggattctatcagctctctcatgacagctcgcgccatgaacagcggataacgagttttatctatacaatcatatgggactgaacaatttaatcattcacaaaaaaatcttaaaattacccctgtccccaaactaaaactcaagatccgtattcattttctgctcaaaattactttaagattaatctttttggttttaaaccacttgaacaaatcatctatcctgtcgaaaaaattcagaaataccggtgctccactgatagcaacagcatctaccagacaataccaggctgaaactccgctcggcgggttgccttgcgttagttcgaatattggttcaagagtagcccaccgccaagtgccagcagcagtaccaatcagttctaaccaggtcgtaataaagaacgcggccagatataccaatggcgatctgcccttgaacagataaatcagaaatactacataaagcaatgcgcccacctggtcaccgtgttcgggtaatccgctaataccccatactgaccacagaccacaagtgatcaccacaaatgctgtaattttcttggcatatttgagaaaaaaaccagatcgtgccagcgcgaccgctgtcagataaaccatgccatgacccggtggtacatacagcggaacattttccagacggtaggtatacccccccatataaattgatgcgaaatgttcacccgctgttgcaaaagctactgcaattacaacctgcattcttatttcgcgattttcaccacgaagtaatgtaatcaaaaaaatccaggcaataacacctaatatattttgaagcaacagcgtcccgtgagcatcaattacaaggctgattgcaacacaaaaaaacgtaaatgcagcgataaaataatcacgttttctgtgaactggactgccactcacctccggaaatctatcaaatatcttcaacatcttaaaaaataaaaaaccgtcttttccgacggttgaaaataatgactcccggtatattttgtctaccgaaccgaaaataaatatcgacagtaattgcaatcccgatcgattgataatcaatctggataatgtctgaattataaataaattgtaaaaatttcaaccctggatttatcccgaaaaggtatttttaccttttcgggataaaatagagcataactaacttaatagatactcactattttccttttttggcagttttagcgttggcctggaattcgtcatggaacttgaatttaggctctccgtcaaatacgccatccagtttgtaatgctcgtgcatggctttgacgtcttttaccatctcgtcaaacttgaaggtgtatttcggatccacttccggtgtatacggggtatagggaggttttgctcctttccagggtgacccttcatagttcagatggcaggcgctgcaacgttcttcaaaattaaagtcttgccccttgcttgccagggtcttgcgcggcgcttttttgcccgatttctcaaatgcttgcccagccttgcggtgatctccccggtatttacgtccaggcccgtggcaggattcacagcctacgccagtcagcatgggtttgggggagtctatcgtgtagccgcctttctggccaaatccatccacgtggcaacctacgcagtctttgtcctgggtgtagtccttggtaggatccagtttggctttttgtttggcttccactttgacattgggcttgagcgattccatcgccttggcgtgggcagtatgtttccacgactgggcttgtggtttgtgacaggaactgcactttttccgaccttcaaacggagcatccgctgccagactctgcccacttgtcagggtgaacagggctgcagcaaccagtccgcaggctattattattttcatgatctctcctcttttcttagatgtttgaacacagattatgattcttttgtcttgccgaccatcattgtacctgatcagtcagatgggttgaatccgtcgttttatcatgatccggagtgggttgcagattgtgctgggtttgtgccgccggggccttttctgccagttgatagacccagtatcctccttgctggtagatcaatcgcggggaggcaagctccagcggagaaggttggctggtaaatggcagcagcctggccagcagggtgtggtaactggcttcatctgtcagaaagaaggcgcgaatcagttcgtccgataacgattgcacagtgtaggcgtagtagccgtgattgctcatctcggtcttgacatgactgatcatgccatgcaggttaccggtcaggcggtagggtttgtaggcaatgccaaatttgtcagggtatagcagacctagtttgtacaggtcgctgatatgcacgatcaggtaagcatcgcgtgtaccggccagttgtcgcaaatcagccaggccactggccagcggattgagcaggctttgcgtaaaacgcagaaacagctcgcgttcctgtggatcggccgcagcgccagtttgttcgttttcatacgcgcggatcgcttgcgcatgcgcttgccattccggcggaacaatcagaggttcgtgcagtgtgctgtgaaacagtacgtctcgtccggtcaacagggccagttggcgtgaggtatcccaccagctgagcagtagtgcatctcgcggggcgtatttgtctattgccgttgcaagcgcactgagttcagcagctttctgatccagcgccagcagaggttctctggtttcgttcttccagttgagtaatacctgcggttgatttgcacgctgaccaaaccaggcttgtgctatcggttgatccgttccttccagatgaatgtcgtactggttgatggtcagatccggccaggcttccagttccagatcaggagagtcgtccaccttgccggtagcagccagctgataacgatagggagcctcatccggtgtcagcagcagccaagcgtacccgcccagcaaaatcaaacctcccgtcaccagtaaaatccccagtggcgggaggagtcggtcaaaccagcgcgactgtgcgcgccggtttggtgtcaacgaagcagtcaagcttgcgtttgcttacgtttacgccagccaatcagagcaatcgctcccgccagcaacatgccacctcccagtcctcccagcgagatcttttctcccgctcccttgaggtcaagcaggctggtttttttaccttccagtttgttaacacgcgcttgcagagctgtcatttcctgcatcttggtgtattcatcctggatttcaacataggcacggttcatcgggccccaaccttcggtatatgtccagccacctggattaacgtgtgccagtcctacgtgcattttggccaggttgttttctgccatttccagcactttcagttcaagtgaggccgggttgttacccttggaccagaacagttgggtgaagataccaaaacccggtttctctggcgccggtggattcggacgattggttttttgaccagtcagggtgccgtcttcatacattttgtgaacaatggcattggcttcctggtatttagccaacccttccagggtacctttgtccatgagatccaggtaggagcgggcaaaccgttccgagtgacattgggtacaggtcacaacccaggaatccagacgagcttctgaccagtcgctggtgatgttttctgcaatccccggaacaaacgggtagtttgcccagcgggtcttacgggtgatgttatgggtatattccccttcgtattccatgtggcaggctgcacaggtcggtgcggtctgacctcctttggagaaggcgtctttcagacgaacattccagttccagttctcccggttcatttcagccagtttgccgtgcttggacataatgtaggcttcatagttattatgatccacgccgctgtgacaggtggcacaggcttccggtttgcgggattctgccgccgaaaattcatggcgggtatggcagttgtcgcatttgttctggttggtgtggcacatggtgcaaccttctgccacttcacgttgcggcatggctgcccaaacggtggtttcaatgttggctgtgtagtccagtgcgtgggatggacgtccgtcaggccactggccattcggccagatcatggtgtcacgctcggattcacgctcggcaaattctctcaggtgacaggttccgcaaacgtcagctgtaggcatgcgtacgtctttggtgtgatctgctttctttttggcgttgatgtcaacgtgacagtcaatacagcctacttccttgagcgcttccttctctccaagtttgcccatggagcgcaggttgttctcaacttcttccagcttgccttttttgtaaaaaagcggatcttccggcttgaggttgcgtattttgtccaggttggcgtgggtgctgcgtttccatgctcttacccaaaccggcgtttcatcagagtggcattcaacgcagtctttgcgctcagcaatttctttcggggaaaccggtggtttgtaaaaggtgctcgggtccatgtagatactaagcgctatcggttcccagtagtctcccatcgtgcccttgccagcaccatgcgcaggatccttgtaacgcttcaccagcgcatcataggtctctttcggcgtggctttgctgcgatccagcttcaatgcttcatacgtctcatccggtaccgtcgatatatccgcctgtaccggcccaatcaacaacaggcccgcacacagcagcatccccttcaaatactcccctaatctcatctctctctcctttgtagctgttctatcaacattttatacttccatttctggaaatttttttgatacgcaggttttagtctcagtaactcaacccattgccttaactgcaccagaaagacgactcttatgtctcgatgccttatttttgtggattattcctttgcttgcgatcgaatcaataatactgactgattttctgaacacagtctcggccagatttttgtcaccagccactattgcctttctgacgcctttaatcgcagtacgcagcttggatcgtaatccagagttccgctctcgctgcttgatattttgcctcacccgctttttagcttgcgctgtatttgccatatgattcttttgttctccgttaaatttttaatacgctgctcatcaatgtctcgaaccgcgcgattttactttcatttccagcttattgcaaagatcggttacacaattttgccgaaatgcacactgaataattcattttgactgaaagattatacgaattgcatccggcataaattatttttaggagcatctgtgccaataaccatcattgatccaaaaattatgatttctttaattttccctgagattttatcaattctaggcaaaacacaactttttctggctatttttgtttcaagacgcactagagcatttttgacttatttgtttacatatccacatgaagcgaagtagttggcacactcctcaggagtgaacagatccaacactttgccgatctgcgcccataaggcatccatggttcgtttggcggctttgcataataaggctttgagtttggagaacattttctcgattggattcagatcaggtgatgaatacggcggtaagtagagcagcgtggcacctaccgcttcaatggctgcgcggacgcctggaaccttgtgacaagacaggttgtcggccaccacaatgctgctgctcgcgggcccactcagttcgtgcctgacgtacgtctgtgcgcgattgctcgctggcgtgcagggttttttttaaaactcaacccccatttgttcagttgatgccatagcgccggcaccttgatctgaatgccttccgcagccaaacgttcactaagctcgacaagcgttagatccggcgtggcttctatccattgccgaatctgcggttccttgtgcgcaatgcgggatcgccgataacctcccatcggcaagctatggcgctgaccttcttctttccatcgcttgcgtacctgatacacccacatgcgactcacctcaaagcgccgggcaattgccgccagactttcgccacgatccaatgcacccagaatgcgatctcgaagatcttgcgaaccttccccatcagctgtgatagaaaatagtctattacatatatatttaaatcaaaatgctctagctggattccggcttagtcggatgacgtcgctgacgttcattgcgctgacgttcattgccaatcagatttactattgaaagacatggcgcgcccagcacgattcgaacgtgcgacccccgccttcggagggcggtactctatccactgagctatgggcgcgtgagaaaaaacgatctgctgacatgccgttttatactccacccagggagtttgaaaacattggatggaaggttatatgcgcgagcattatactattaccttctaattaccgctcgaacacatcagaaatgaaagcgcggtaaatagcattactcctccgttttttgctcctgccccctggctggtttcggccaggaaaaatagacataactcttttgtggcgttctggcttccttaaaacgttttagcgcttctcgatcaacttctttgtcccaccagattgcacgagcttctttctgtttctcgataaggtcaggctgtttttcaagcaactcccgcatgaattttgtatgttctgattcgtaagaataatccatattgtctatccgtaaaattattaacttatgaaacctgctcttttaatctccgggctacagaatgttttattcattatatccgattgtcgtactgcatctgccctgagacagattcattcatgacaatccttcaataaaattccgcaaagattcacgataggatcatcaacctggtattaaaacagcaggagaggattttttgtcagagcaactaacacgatataaacaaacacaatttgtgccaggatccaggcagttacctttgcccggcgtgtcttagccagtctgaaagctgtataacccaacacaatatagactagcaaaccaataatcttggccgccagccaatgttcaacaagtggatttctgtgcgcaatcactgccatcgttacagcactcagcaataaaattgtgtcgttaacatgcggtgcaattttcacccaacgttgctgcaacagcggtgaaatacgcaacatccatattccacgcagcagaaataatgtgtaactggccacaacgctcgtcacatgcacatatttcagcgttagatagtcaatcaccatccctgcaccaaatcaaccataccatcactatccgattttaaacgtgaccgcctgtatctgatcaggccctggcccaggcatacgcttcatcgtaatcagaaaaaacaaccacatccgcgtcaataaacaaattggaaacccatgcactccatacttgccactggctatccgtcactaccgcgacacgattaattttgctgccgtgttcacgcataaaccggatctcttcccaggcaacacctactgtgtaagacaccatatctcgccaatccagcagtaaattggcttccccattgaaatgaaatttgtagagtacctgatcttcaaattgcttgaagtcatccagagtaaattccccgataattgcgacaacgataagattgccggtctcttcaatattgatcattggtcataagctccgagtaatgaatgctaaatcatagataaatggtagttttgatgcaatcaggcttttcaaccgagttgtcggctatgggatatcagtcatcaagggtaacaatgtttgtccgttgcgctgatattcctcgaatgctcagtaacccacccacaacaatcaatcccattcctatccaggctgaaacgggtaaccggtcaccccacaagaacagatccatcagccctgcaaacaataccgtactataggaaagtgccccgacaataatgatattactcctccggtgcgcacgagaaattgccagttgtgccagcgttgccgttacaccaatacccagcgccaatatcaggctctgcagattcactgggctaaacgcagtaaatgccagccatataccagtagcaatcgtacacactagcgtaaaataaaaaacgatacgccagtctgattcaccctgttcatttaactgcctgacatttaaatgtgcgataccgccaaacagcccagaaccgacaccaatcagcgccatataccattgaccttcagctagggtagggcgaagtagtatgaccacaccaataaaacccactgttactgccacgatcaatacccagctaaattcctttttcaagaatattactgttaaaaaagcaagaaataagggccaagtattattcagagaaatagctgttgccagcggcaacttcaaaatgcaatagaaaaacagcagcaccccacccaacccagctaaacccctccaaaaatgggttttccaatgttttgttcgatgggtttgccataaaaacgcataacagcaaacgttgaaatcacccccaccagtgaacggtaaaataccagttcagcattggaaaaaaatgcagcagcaagttttaccagctcccccatgcaggcgaacatgaatcccgccaccagcatccataatgaggacattctggctgtaagatccagatttagggtagatgctgttctagttctcgccggaggaaatgatgaaaatgttccatccccgcttccattggcatctggtatggacctgtttcatttatcccctgctgatacaatgcacgccggccagccataatccgtttacagatttcatcatcttccctggcagtctcctgataggcagcctgctccctctccacaaattctcgctcaaacaggatgatttcttcagggtaataaaattcaaccacattcatgcactgctctattccggttggcaaaatggtactgacaacaagggtatcggggtaccattcaaccatgacattaggataataaagcagccaaatcgcaccatgtcgcggcacttgttgattattatgctgcaacacctgcgtatgccattcctgatatatctttgaacccgctcgattaaagtcagggtttacgccgacagtctggacgctgtaccagtcactaaattcccattcaagctggctggtatccacgaaatgacccagacccggatgaaaaggatcgacgtgataatcttccagataaacctcaataaaagttttccagttgcactggtagtgttcaatttgcacacgatccagtgcatactttgaaaaatccaatttatcacgaaccttcattccggcaagatcctgattcacatcacgcttgccagcgaaaatcagcccgttccagtgctgtaaggctgttttacccagatttaggcatggatttttgctgaaatgtggtgcgcccagcaatttaccatccattgcataagtccaacgatgaatcggacagactatattgcgggaactaccacgcccctccagaataattgcctggcgatggcgacagatattcgatagtagttcgatcccattttcattacgaaccagaaccttggcattattctgcgcagccagcacgtaatagtcacctgtttccggcaccatcagttcatgtccaacatagcccggtccctgatcaaataacagctgtttttccagctcgaatatccgtggatccagataccagtcaacagaaagctgtggatgcgcaacagcaatatcagaagtatgtacaaagccagacatatattttcagtatcaccccgcaatcagagaataaaccctcaatccaatcaaaaaagaacccgattgatagtaacagggtaccttagcagcgaatatgatctttttccacaaaatcaaaagatattattcaaactcggcaaaacactctgttacaggcatcacggcattgaataacaccataaatctatcggtcagagattttaaaccacgctgctttattcatagactataatcaaataacaatattggacttacactcatctgaactgttaaagcgataccgcattatgttcctttgtcgcggaacactattaacaacagcttaattgtcatgccacaaatgacttaactcgcaaaacctcaaatacaatgaaaacggataacaagcaaacaactcttcaattgctcatcacgagcatattcgtattaagtctagctgcttgtgacagccagcaagaaacagcaacagccaaaaaagcagctgtccttccccaggggcctaccacgggaatactggctgattcggcagtggaaggcgtatcctactctgcctcatcaggtgcatcaggtgttaccgatacaaccggcctttacaaatatacgcatggtgacagtattgaattcagtctcggcaagttgaatcttggcaaaattaccggaacggggcttactactccgattgaactggctgccggtgatcagaacaaactactgaatttgctgatcttattccagtcacttgatgctgacaataatctcgcaaacggtatctccatccccccggctgctgtagaggcactggacgcttcactcgatctgactgtggatccgggtattttcaccacatccccggcactggtttctgcccgggaagcggccagcatatccggcagcataaaaacagccgatgaagccaacgctcatttcttatcacaagcaatcaacctattgagcaattatctctgggtaaacgaggatgataacagcgtaagatttttccgtttttcaaatgatggtagcggagaatatctgaacggtgtgatcacaccggatgactcctgtgatatgaaccgcgcctgcggcagcaaactggttttcaccgctggaatagaatatggcaccacccaggcaaccgaatacgacgaacgtggctttaagcttgcaagcacacctgaaatagataccaacatccagtcaggactatcccatccacggcctagctggcgtatttataccaatgggaatgagctgattatctctgacattgtcatcgtacagcgtgcaagagaacagcctggcctgtttgatgaattgttccacatcacaaaaccgctcgaactgagttctgatgatgaagttgccgaaaccaccgttcaggagacccgttaccggaaaatggataactcgcagggcatcgttggcgcctgggcagtagacaaggatactgtcaagtcacctgtttttctatttttcccggataaccgctatatgttgattgatccaactggcagcgcagctcattcaactccttctgaatgcgcgaaaccaggcgtcgagcttgccacctattcctttgatgcaggcagcggcacgctcaaactatccagctttacttacaatacaactggttgtgccggtctgtcagaatatgttggcaaaccgattaccttcaaaatagataatacagatgcacaaagtgcagctctctccggggaaggattatcctctgttacattgcaccgcatctctcactgattgattttccaagaaactccgaaagaatatctgatcacgttattctttcggaaagttgattccggatatttccggcatgacagtcattcatgttgcgcttgatgtcccggttaaccggttgtttgactaccttgctccgaatgccgattcagccgatattggccggtgcgtacgcgttcctttcggcaaccggcaactctctggcattatcctgtccgtcagcaatttatcgtccgttccggagagaaaactaaaaactgccggcctgatcgatcaagcaatccctcccctgccccagtcgttactcgaactattcgagttttgcagtcactattatcaccacccgatcggacaggttgtcatgaatggcctgcctgctttgctgcgaaagcctaggcatacaaccagtaggctaccgaaacagatccaggaatggatactgactgatgcaggcagaattatcacgctttccgacattcccgtcagatccaaaaccaaacgtcagctgttttccctgctactggaaaacggaattatcacagctgacatttacaaagcaatgtcacctcattcccgcaagctgctgcatgaattcaaggatttggggtgggttgaacaacgcactgccttaccgggaaaatttgcattcagtacagcatccaccccagctccaaccacagaacaggcgcatgccatcgccgaaattctcgccagaataggtacgtttaccccctggttgcttcatggcatcactggcagtggcaaaacagaagtctatctgcaggtggctgcttctctgttggcccaacaaaagcagattctggttctggtaccggaaattaatcttactccgcaactggaagcaactttccgcaagcgatttcccaatacaccactggtcagcttgcacagcggattgaatagcagcgagcgtctgcaaggctggttgcaagcacaatgtggggaagccaacattattctgggtacacgcctggcaattttcactcccatgcccaggccgggcctgattattgtcgatgaagaacaggatcattctttcaagcaacaggatggattgcgctactctgcacgtgatctggcggtgtaccgtgcaagacaggccaacatacccatcgttcttggctcagccaccccttccctggaaagctatcaccaggcgcgtatcggccgctaccggttactgcagctgcacgcgcgagcaatcagtcaggcagtactgccagctattcattgtatagacatgcgtgtaacgcccgcacaggaaagattgtcggagcccatacttgatgcattacgccaatctcttgatcaaaaacagcaaagtctagtatttatcaatcgacgcggctattccccggtactactctgcaaatcctgtcgctggattgccacctgcaaacgctgctccagccgcctggttgtccatttgcgcaatcgacaactgcgctgccactattgcggtgatcagcagccgattacacccgcatgcccgcaatgcggagatccagatattatgccgtttggccacggcacacaacggattgaatcagcgttaatcaaacaattcccgaatgcgcgcattctacgtgttgatcgtgacagcatccgccacaaagccgcctggcaaaccatgcttgatacgattcaccagggaaaggtggatattctggttggcacccaattacttgcaaaaggacatgattttccaaaccttgccctggtgtgtgtgctcaacgccgattcatccctttacagcactgatttccgcgctgaagaacatcttttttcacaattgatgcaagtagcaggacgtgccggtcgcgcccatattcctggcaccgttctgatccaaactgaatttccgcagcatccgctgtacttggcattaatacgacaggattatgcggcatacgcgcaaacgcagctgaaagaacgcaaatcagccagttttccgccttttgtctatctggcagtattacgtgcagaagccccggtactcgcagaagccttggagtttttacaccagacggcggcaatcgccactattgctaaagaatacgcccatatccagcttttcgatcctgttcccgccaccatgactcggctcaaggggctggagcgtgcacagctgctgattcaggctgtttcacgcaagtgcctgcaaatatttctgagtgattggcaccagcgtatttctgcattaccagctcgcagcaagctgcgctggcatttggatgttgatccactgacactttaaaaacagcccccagcaccgggatcggttcgctcacagtgatttttcagagcactctaattgtattttctcaatccctggtatcgcgaaccaacaatatggggataggtgctatccgagcaatcccttcagccacactgccaagcaatagtcgactgaagcccgaatgaccatgcgtaccgatcacaatcagctctgcctgccagcgccttgcttcttccaccaaaatattggcaattcgttcgttatttgatggaatcaagcgcgtttcaaccgggataccggctgtctttactgttgtttcagcttcagcaagtattttttctccacaatcgtggattgttttctgcaattcttcgtaattaaagtaattctcatccaccagatagattgcatcttcataaacatgtacaagctccagacaagctcccatttgctttgccaatttaattgcctcctgcaaagccaggtttgaagtaaagctgccatcaattggaacaagaatcctctggtacatcaaatatctcctgcaaacattaacctgatcaatatatctctgccgcacattctcgctcatcacccatcttatcccgtattacatcagggaatattctagacgagacgagtcgggccagtcaggcactgcgcagatgagaatatctgatcgccactatagccagcatgggtaatataaaccctaaaattgtcactataatcagcagaacacccaattcactataatcagccggaaccaatatttcaccagtatccacttctctgacctcgcgcgtgaccgtaaaaatctggttgatatacttggttgtcagttgcgaagcagataaagccaggttggtaaatgaagccatgacagcaaaaaaggttgctttgagtttctcgggggctgaattcgcgatccacgccagcattggaatcatggcgatctgccccagcggtgattccagagctgtatcaattaccgcaataaaacgcgcatcgacgattccgcccgtatgtgctgcagtccatacatgcaagccgaagtacatcgaaatgatcggcagtgacaaaatagtacccgctacggttaatgcgccaatgacataagccattgatcgctcggccataaaccgacgaaaaataaacataccggcaagcgtcagcacagagccaatcaaagaaagtgtagccagaaactgctgatcaaaccccagttcatcaatcatccaccaagtcgagcccgcaccaggtgtgggaacggcccggaatacaaacaccagtaaggctgttcctaccagaacattgcgcgcctcactttccagctcggaagtcagtttccagatcaaaaacagcacaatcgccatcgacaagctaaaaacaatttcttcggcaccggaaatttgcacaagcccgactcccagggaaacaactgtaaaaaccaatccgccgcccagtatccaccaattgattgggggtgtttcgacatgagcaccggttaatacttcgatttctttgatatttagcccctgaacggaaaaatgttttatttcacgccattttaaccatccagccagccagattccgcacactgaaacaaaaggaattaccaacgcaagctggtatatcagcagataggcctcacccttgccagcttcggaaagagttgcaacatctttcatcagcacaacgtttgccactgccactagaataccaccaccaataatggcaacacgccccaacgtctgcatcgtaatgtgcatctgcttgcgcgcttccagatcaatcagttgtccatccgggttgacgtgtggcacagcctctacagtcatggcatcggccactacatcctgcaacacataacccaccggtgcaagcaacgcagccagcacataccactgcgccagcggcgcaacctcacgcatcgcctcagtatggccaagcaatccgatcatgatgaaaagactagtcgcgatcaatcctgcccccagatagaccagcaagctcttccagcgccacagcagatccaccagatgacccatcggcattttcaatgcccatggcaatgtcatccagaagccgagtgcagccaaaaattctgccgacaaccccagtctttccttcacgtagaaagtaccaacaattcctgtgaggcttgaaataccggccgccagataaaccatcaggggcggcaggtatgaaaggcgcatttccctgcccagagtcagcaaattgagatcaatccaccgaaacagtgcggcgggtaatcgtgtggcaaattcgatattcactcggtatgtagtcagcctggacgtttaccaatttgcacctgaatatccagctcttctccattacggagaatagttagcgttgctgctttacctgggggaagagatgccacaatattcagcatttcggaagcattgaaaacaggcttgccattcactgccgctaaaatatcccccggtttgattccggcatcatccgctggcccattcttaagtacgcccgcaatcagagctccatcagttttcttcagctttagggactccgccaactccggcgttatatcttgcatactcacaccaagccagccgcgcgtaacgctacctgtttcgataatctgctgcatgatttgtttagccgcatccaccgggatagcgaatccgatgccaagcgagccgccggaacgtgaatagatcgcggtattgatcccgatcaaattaccggaaatatcggtcaacgcaccaccggagttaccgggattgattgccgcatcggtctgaataaaattttcgaatgtgctgagccctacctgggaacgccccagtgcaccgataattcccatcgtcattgtttgccctacaccaaacggattaccgattgccagcacgatatcccccactctagctttttcagaatcgccgaaggcaatgctggggagcttgtccagatcaattttcagaaccgccaggtcactctcaggatccgagccaatcaagtttgcttcggcttttcttccatccattaacgccacctgaatctcgttagccgcttccaccacgtgatggttcgtgagaatatatccttccgggctgacgattactccggatcccaagctggaagtgcgctcagttctcggactaaaacgattgccaaaaaattgctgaaagacaggatcatccataaacggatgggagggcactcttacctccttgctggtaaatacattcaccacggaaggcatcgccacttccgctgctgtatgaaaactaccagtatcaagtgcttttccgccatcagccttgactgcttcacggatggtcgccagcttgccgcgcggcgtccacggcaataattccgggcgtaaggttgaaacaacaaaaaagatggcgaggagaacagtgatggtttgtgtgaaaagcagccagagtttttgcatggaaaatcctacatcccaaatgaacaaaaaaagtattatgcaccaaaatatactggaaaattacctgaatgatctgctggacgttcagcaattccgtgattattgtcccaacgggttacaggtggaagggcgagcttcgattcaaacgctcgtcagcggtgtaactgcttcccaagttttgatacaggcagcgctggatttgcatgcggatgccatcatcgtgcaccatggctatttttggcgcggagaagatacctgcctgcgcggcatcaagcgtcaccgtatcgccacgctcatcaagcatgacatcaatctttacgcttaccatctgcctctggatgcccatgctgatctgggcaacaataccttgctcggaaaaaagctgggaataaaggaagaaggccgtttcggcgaacagaatatcgctgcttacggttattttcagaaaccagccagccttgacgagctggatggtttactgagttcagtgcttggccggaaaccactaataatcggcaatccgcttaaatctatccggcgtattgcctggtgtaccggagcagctcaaggatattttgaggaagctatccggctgggcgtagatgcatttatcaccggtgaaatttctgaacagaacgtgcatacagccagagaatccggcacggctttcatctcagctgggcatcatgccaccgaacgctatggaattcaggcgcttggtgatcatatcgcacaaaaattcagtattgcacaccattttattgatgcagaaaaccctgtatgactaatccattagcaatgcagcagaacaaaaacaggcagccactctcaaatagcaaacaaggcatgatctattttttttcatccttgttatccagttgttccaatggtctattttttttacgggggagcgtccaccagacgagaaaaatgaacagactcaacgccaagattgcttcaagtgctaaaatccacatattcttccctaaaaaaatgtttttacaaaacagatactttaaccgaaatctgctaaaaacccaatttatcaccctgctgatcttaatcccactcggattaaccagctgcaaaactgaaactatttccacccaatcttccacatcccaaacacctgcaaaagtggctgccattcccgcagcgccacaatcagcaagccctactcaagataccagggacaaggaagataaaaagctacttaaagctgctagttggtcaatgctaccaggctggcaacatgaaagccttcttccggcgtggaatacctttatacaaagctgcagatctctcgaacgacgcccctcctggcaggatgtatgcacacaagctacaaccattcggcacagcagtgaacaagctgtccgaaattttcttgaaaatcactttgcaccttatcaggtgatcaatccggatggcaccaccactggcctggcaaccggttactatgaacctctgcttaaaggcagtcgcaaatattccagtcgcttccgctacccgatttattccactcccgacaacctgctggcagtcgagctcaaagacgcgctgcccgatgcaaatcaggtagcgctacgtggccgtctacagggacgcaaaattattccttactacacccgcgcggaaatcgagaacaaccgcagtctgctgaaaggaaaagaactgttgtgggtagaggatgaggtcgagctgttctttctccagatacaaggatccggccgcgtcgtgctggaaaatggtgaaaccgtaaaaatcggctacgcggatcacaacggttatccctaccgctctatcggaaaaatattgattgatcggggtgaactgcccgcctggcaggtatccatgcagtccatcaaacaatggggccgacaaaaccctgccaaattgaaatccttgttgcagcagaatgcgcgttatattttctttcgcgaactgccagccgatcttgccggaccgatcggtgcgctgggagtccctttaacggcgggcagaagtctggctattgatccggagagtgtcccactgggtgccccagtttatctttccaccacttggcccaatacagcacagccacttaatcgcctgatggttgcccaagatacaggcagtgctatcaagggcggggtgcgtgctgatttcttctggggacacagcccggaagctcaggcccaagcgggtaaaatgaagcagcaagcccagatgtgggtcctgcttcccaagcagtacagggaataaaggactcaaaaggtagccactcaggcagataaggttgtatcacttactcgcggcctgatccagccgcttttcgatttctgattgcgggataaaacccggcaccactgagccatctgcaaaaatcagggttggtgtaccagttactctgttctgacggcctgattccagcagtatctgcagcggtgcatcacaattcttaccagtaggaacgactgatttcagcataaaatcatcccatgctttgacccggtcttcagagcaccaaatggcttcggctgttgtcatggagccgttaagaacaggataaagcaaggtataaatagtgatatccgtcacattaaccagctccttctccagccttttacaataagggcaatttggatcggagtatacaatcagcgtacgttttccgttccctttgaccattttcagcgcatgttccagcggtaaagtgtcaattgcaatccgccgtgaatcccggatctgctgcatgcgctcactggtcaagcttgcccgcttcttagcatccacgatatgccccatgaaaaaatattcagccttctcgtccgtataaaaaatttccccgtcgatcacggcctcatacaaccccagataaggcgtctgcgtcaggctttctatcttgctccccgggaaatgagcctgaatcgcctctttcagatcagcctcattcgcctgagcaattccagtaaataacaatcccagcaggccgaatgaatataaaaacaaacgcatactatttctccagtataaaaatccagtaaccgtaaaaagctgaattcagctcagcgcatgacgcatcaatctgtttttcagaagtggaaagcgattggtaatcccgagccccagatttctgatgcgcataatggccgtatcctcgctgccaaacagtttctgcagcccatctgtcacccattgcatggcaagaatatcttccttgcgattacgttcataacagcgcagcaaagaaaactcaccacaatctcccagttcgtcaaactgcaaaagaacatcggccaattcacgggcatcgcgcaatcccagattaactccctggcccgccagtggatgaataccatgcgcagcatcaccaatcaaagccagcctcggtttgacgagtgatttggcttgtacaaagttcagcggaaatccacgttgcgacgtaaccagtcgcatcattcccagctcatgctctgccgcccgtccaacctgttcgcataacacctcgggagataaagtaagcaattcatcagccagcactgtattcgctgaccacaccatcgaaacccgttttcccggcaacggcagcagtgcaagaacgccatcacggcggaaccactgataggcaatgtgatgatgaggccgctccacctcaaaattggcgaccaccccagtttgataatagctatgacgatccaccgtaattcccgcttgttcacgcacgcgggaattgacaccatccgccccgaccagcagcgccgtctgcaaaaccgtgccatcagacaaggccagctcaacgtaggattcatgccaagtaagtgagtcatattgcgctggacaaaacagctgcacattttctgcctccgacaacgtctcccagacagcatgctgcagctggcgattctcgatgatgtaggcaagctccggcacaccactttcatacgcactgaaatcaatcctggctgcactgtcgtcaccatgcacccgcatttcatggacaggtgtcacccgtgccgcatccatccgctgccagaccccacaagcatgcaagaatgctacactgccgggactgatcgcatacacacgcccatcccagctgccatcagctggcaaaggtgctggcggtcgtgattcaatcaacgccaacctcagcccgctatccttcaaagcagccagcaggctggcacctaccagcccacccccaatcactacaatatcgaatttcattgtcggattatactaaggaacccccacccagatcattgttttcaagcgcgtggcagaaaacaaacccacaagatttttttaaaagacagaagaattttatatttttaatctcataactacactatctagctctcgaatcctctttccgtaagatatacgaacaaaaggggcgaatgatacaattaagcacttttcttactggagcgttagtctgccaaacagggagtaatatggctacaattgaatctattttgcgtgaaaatcggatatttccccctgccaatgaatttgtcaggcatgccaatattactgggatgaaaacctatgaagccctgcgccaggaagctgagcgcgattacgctggcttctgggcaaaactcgcaaaacagtacattacctggcacaaacctttcactcgtattcttgatgacaccaatccgcccttttacaaatggttcgacgatggtgaactgaatatctcgtggaactgtcttgatcggcacctgacaacacaggccaacaaaactgcaatcatttttgaatctgatgaaggcgaagtaatacgttgcagctaccgtgaattacaccagcgagtatgccgttttgccaacggattaaaagcgctcggcatccgtcaaggtgatcgcatcgtcatttacatgcccatgcggattgaagccgtggttgccatgcaggcatgtgcgcgtattggcgtaattcactcagtagtatttggcggcttctcggcgaaaagtgtatatgaacgtatcatcgatgccggtgcatctgctgtaatcactgcagatgaacaaactcgcggaggcaagcgccatgcactgaaagcaactgtagacgaagcattggcgatgggcgatacaacttcagtacatagtgttatcgtttttcggcataccggtactgatatcccctggcagccggaacgagaccgctggtggcacaacctcaccgccagccaatctgatgaatgcgagccgatatgggtcaatgccgaacaccctttgtttacactctacacctcgggatcaaccggaaaaccgaaaggggtacagcattcctcggccggctatctgcttggagcgatagtcagcatgcagtgggtattcgattatcattcggaagatatattctggtgtacagctgacgtgggctgggttaccggacatagctacgttacttacggaccgcttgccattggggcaacccaggtaattttcgagggaactccgacctatccccatgccgggcggttctgggaaatcatccagaaacacagggtcacaaccttttataccgcacccaccgctatccgctcactgatcaagctaggtcctgacttacctgagaaatatgatctctcttcattgcgtttgcttggatcggttggtgagccgattaacccggaagcatggatgtggtattacacagtcattggccagtcacgctgcccggttgtcgatacctggtggcagactgaaaccggcagtcacatgattgcccctattcctggcgcaataccagccaaaccaggttcttgtactcttccactacccggtatcgatgctgcagtagtggatgaaacggggctcccggcagaacagggaaaaggcggatttttggttatcaaacgtcccttcccctcaatgttgcgtaccttgtggaatgatcctgaacgtttcaggaatacctattttccggcagatattgccggcggccattattatcttgcgggggattcggctcatcgtgatcaagacggctacttctggatcatgggacgaattgatgacgttttaaatgtctccgggcaccgcctgggcaccatggaaatcgagtccgcactggtagcgcatcctctggttgcagaagcagctgttgtcgggaaaccgcacgaaatcaggggagaagtgattgtggcattcgttgtcctcaggggaaagttgcctgatgaccagcaggctgccgaaattgctgaaactttgcgcgaatgggtttccagcgaaattggcgcaattgctcgccccgaagaaatccgatttggtgaaaatctgcccaaaacgcgttctggtaagatcatgcggcgcctcctgcgctccctggcaagaggcgaaaccattactcaggatatttcaacactggaaaatccggtgattctcgaacaatttagtcagacgatataaccggaacctttcaacttatggaacaactcccagccatcatcgattatccggatggtatcagcgtcattgatgctcgctaccaccggccgggccgtgctgccatccatctaatcacggaaggaaacaaaaccgctctggtggatactggtacccgtttttcggttcccggcgttatggcagtgctggcacacaagcaaatcgctcctgaacagatcgactatatctttctcacccatatccaccttgatcatgctggtggtgctggtgaattcatgcagcagctgcccaatgccagactggtggtacacccgcgtggcgcatcgcatatggtcaatcctgtgaaactgattgctggtgtcatggccgtgtacggtgaatcagaattccggcgcatctacggtgaaatccagccgatttctgcagagcgcatcatcgaagcacctgacgatacgctaatcaaactgaacggccgcccattgcgattgctggatacacccggacatgcgcggcaccactattgcattcacgatgccggcagtgcatccatcttcactggtgacacctttggtgtgtcgtatcgcgaattcgatgccaacggactggaattcgtttttccgaccacttcaccagtgcagtttgaccctgaagccgcacatgcctccatcaaccgactcatggcgttgcgcccggaacaggcatttcttactcattatgggcgcatccgcaaccttccgcaccatgcatcacagatgcacgcactcatcgatgcctttgtcggcatcgtacaacaagccgcagaaactccagatcggcaacctttcattgtaaaagcattgcaggacttgctctgggaacgactaaccacccatgggtgcaccctcacccgggatgctgtcctctcgatattgcagaccgacatcagactcaatgcgcagggacttgaaatctggctggaacagaccctcagacaaccaggtcaggctgcaggctaaacacagcatctctggcaggctgtccgccgctgcaacctgcatcccccgataatctcctcgcaacaaagacaatgcgcataacagatgactcacccggagcaccctactgctgtgggccaaaatggttaacgataacttgtccaccggaaatcaccagatcgggatattccagccgcttcaactgctgctcaagattgccgcgaattgcgatcaaatcagccggggcgccaggttgtattgtccccagcaggggaatacccagatactgaccggcttttgccgtggctgcccgcaatgcatccggcagcttcatttttgccagatgcatcagatacatcaactcttgtacatcgattccccagggaatatcagggtgagcaatttccgctccgtacagcaattcaccaccaagttctgcccaaattgctgcattgtgcgcgatcccgtcacattttgagagggtatcgagcgtaccgatgatcgtaacattctgtgctctggcttgtttcagcaacggctcaggaattagatcacaaggcatgtgcgcccattcatcgactccggcattcaacgctacctgtacacccgatgactccgccacatgagccgataccttacgctgatgccggtgagcttcatcgacaatagccctgacaatgggctctgacaacatgggccatgccgactggccatgcgaagcggcatatgcgtgatgatgagagtcggcctgcacggtatgcgcagtatcatggtgtacgtgaccatgatgtggagaccagggcgcacctgcttccccgccgggttcaagtgcaatcttaatgaccactgcaccctcaccaatcagatggcgtacggcttcccgtgcttctgcttcgctggtaacaggaatcgccaaatccctggcgcccatcgtaatgatcgggtatccgtgcggcgcggtgataatctgtcctgaagtaagcacacgcaaactgccatctcccccataaggctggtgcacaggaccacccacatctcgcaccgtggtcaccccatgcctcaacacgatatctaccggcactttctgaaaggtcaagtgcgcgtgtaattcgataaaccctggtaataaggttgcatcacccagatcaatctcagttgatgcatcacccgccttgaatgaatgacgcagcccgattcttgcaatgcgcccatcttttaccagcaccgataaaccactgtgcatttcatttccgtcaaaaacccgcgcagcgtacagtagcaaagatgaaggaccggtttcctgtgcataaacctgcacagaaaaaaatatcgccatcgttaccgcaacctggaaacagcgaacatgctgcatgcgattagaaaaaacatcggtaaagttttgcatccttattttctatccttgattgataatgggtatttttcaacagtaagataaattaataatgcctgtccgtgccgcaagcgccgccatcagaaaatctctcatctcgacttaatcatctcctcccggtttagtctgatgtgataacacctccccccggacagaccggctgatccagcctaatacgctgcatgacaagcttaatctaagttgatttgtagtgatctaatttaaacagacacctcgataggtggataaaatccactttaagaggacatactaatgaaagcacgcaggaaatttaacacccaatttaaattggaagttgttcacatgatcaaggatcacaaccttagtgtgagcgaggtctccaaaacgatgggggtgggggaaacggcgattcgtcgttgggtcgcgcagtatcaggcagatctaaactaccctgctgtttgataaaagcagccacttccgattcaatcattgctaccagcaacttgcgcgcgccttcccgcaaaactacctgcagcgagtcattttgttctggatcgttcagttctaaaatagtatcatctgtcattatggtgtttcctttccagtagttgatctgccagatctttagcaacaggttacaccacttcctttttctttgtcatacaccagatttgatcatagttcccagctgaattaggaaaagcgtattatcatcaactggaaaggtcagtcagaattgactgactcaaactaccgagtacccggagcggctcagtttccacagtcgaatctatcctcgtagcttcgttgtagtcaacttacgggaggaatttcacctccaagagagcacccgtgccagcccacaaaacaaaaaggtcagaaatacttagaccctcgcatgagcaaaataagctcccactcactttcaataattccgtggaattaaagcagctctatctgcatcgttgggtaccaaatctgaaaattcctcttttctacgggatttggattgcactaggaatcatcgcctggaattcaagctattgggcatcgacctgggtatgctacttgggaatgggctacatacagatgggaattgtgacttttatgcacgactgtacacacagcactttgtttaaagttcgctggaagaatcaggcattcggaattttcgcaatgattccactcattatttcatttacttcctttaaggaagaccatcttattcatcataaacataatcgcacttcaaaagatccggatgcattcacgatgggaaaacgtggagtaggcgatttcatacttttctatgcttacgcaatcattggtgtgttcttgactgcaattcagtttacattaatttttccactaaagattttgcgtgggaagaaagcgttgatccattggagtgagatagcgcttcacatagttgtaatgtgggccgtatttgattgggcagcctcccaaagtattacaaatcaagtatttaatgtgtggttttggccacttattttttttggtttttttaacagcatgcgattcatcgctgaacattatggctgtccttgggatgctggaccattggtaggaactcggacgatcatcagtaatcaattgaattcatttttttggaataacatcaattatcacatcggacatcatgcccgccctggtgtaccttggtacaacttgcaaaaattacacgcattgctgcttcctgaaattgagcgagccggggcactgattgataaaagctatttagtaattttcattcatgcgctctggcagggtcccgagaccgcagccacaacagaatcccggaattcatcttcatccaagtcctttactagaaatattgattaacctggaatgttgaccaaaagaaagacctgatttgggagagtatccgcaagaacatctccgcccaacagtgcgctacgcgaacataactattctgcttgtgtgcaccatgactcaatctgaggcctcgcacagcgggatctgcagaatgcacctgaattagctgtgggaggtacactgaaatttagctcactgaaacactggcccaacaagaccttcaactcatcactcccctcaagaaaaacatgaaggccgtaccccgtaccgagttcgaaaaggctattctgaagtgtccgtaaaatcgggatagaaccccgttgaccgaattattaggctgcacgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccatccagctcgcttcagactcacgataaccatcagacaatgccagcagttccttacgccccgtttcgtcagaaccgataatcaccagaagacataaccggtcatccattcgcacagtgctgtagataccatcagcccagacataaacataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctaccctcagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctccaggctgcactctggctaccctcactcaaatgtagcagcgggaaaggcattccttgagaatcagttagagtatttttggtttacttgtttacatatccacatgaagcgaagtagttggcacactcctccggagtgaacagatccaacactttgccgatctgtgcccataaggcatccatggttcgtttggcggctttgcgtaataggactttgagtttggagaacattttctcgattggattcagatcaggcgaatatggcggtaagtagagcagcgtggcacctgccgcttcaatggctgcgcggacgcctggaaccttgtgacaagacaggttgtcggccaccacaatgtcacctggctgcagcgttgggcacagacaggtttgaatataggcgagaaacgtggccccgttcattgggccgtcgagcactaacggagcggtgatcgcatcgtgacgcagtcccgcaatgaaggtggtgctcttccagtggccgtggggcaccgaagccacacagcgctggccgcgcggcgcgcgaccccgctgtcgcgtcatgttggtggtcgttgccgtctcatccaggaagaccaggtgacggcaatcccaatgctgttgctcgcgggcccactcagttcgtgcctgacgtacgtctgtgcgcgattgctcgctggcgtgcagggttttttttaaaactcaacccccatttgttcagttgatgccatagcgccggcaccttgatctgaatgccttctgcagccaaccgttcactgagctcgacaagcgttagatccggcgtggcttctatccattgccgaatctgtgcttccttgtgcgcaatgcgggatcgccgataacctcccatcggcaaactatggcgctggccttcttctttccatcgcttgcgtacctgatacacccacatgcgactcacctcaaagcgccgggcaattgccgttggaccttcgccacgatctaacgcacccagaatgcgatcccgaagatcttgtgaataggcatgcataaccttccccatcagttgtaatagagaatagtctattacatgcatatatttaaatcaaaaatgctctagtgagcaaccagataacagacccttggataaataaaatgctgctgcacacgggttctgctcatttatatctcaagacctctgcataactctgataattttgttgtagtagcgaaggggatttccaaatgatactcttgtgcgcttttaacagaaaaatgaagttttattcattcttcaaaggagtttttcacccttatgctgcattggggcggactactccccttttgaatggctcatccacaaaaattttgttggcagcttttttcagattcatgcagatgcttttcagcacgacttgggcattgacttttatcgtgccgaaatagctggcgcgcccccattccaaatagacgtttggtcgtgccgagagtggtttgttcttgtatgcccagtgcataatcgcgcttttgattttgtattctttcagaaactgccgattggcgttagcttactgaacctttatccacatacactcgattcgcctcaatgtgcgcgccaacgatgattgtttcgaaatgtaccatttcgctctggttggcaggagcggtatgcaccccgcgcacgtagcaccaccatgtagctgctgcggtagccaaaatgcgattttttaccttttttgagccaggtcgcatccgcactctgttcttcgatataggtgattcccggctggctcccatcctcaaactgaacagtcttaccttcggcatccacctccagtgtgattgtgatgatctttttaggacccgccgctgactcaatgagtgtggcatcaatcaccgcacccgtcgtacccttgaccatcaaacgatcatcaaaccgtgtgattgaatctgttcattgatagaggccagaagaccatccagcctatcgttgaccaccaggcggttgcgaaaccaacacagagcggtttcatccggtatcgcatccgacaaactatgccactgaccaagcagaatcgccttcaacatcatcagcacgccaaatggtttctgccctccaccatttgatagctcgcgcttgtataaaccagtaagcatcggacgtaacgctccccagtcagtcaacgcgccaatcttcatcagcacgttgttttgtttcagacgttgcgccagtttcaggaatccaaaactcatctgcatcttctattcctctcaccttttacctttcgccattttagttgtttatttggctaacgtggggaggtggtgcaggagtctttctacttgtagttcaccttccaattttattttttgtgccacggcattgatgctttctgcataaactggccagataaaaataaaactgaatcgggaagttatttttaatctggcaggtgttatcagattatcattagtataatttccggaaatttgtagccatcacgaagtctctatctgcgatactgctaacaatttccagcatgtctgatgtttgttccggttgctacatacggttgttttattggataccgctctatgcaccatgcggtaactgatagccatatttaattctgctagtattcccggcagtgccatttacattgtttacctaaagatgaacagcgagaacctcctttttctcctgatactgttgccctttgccggaagcgctctggcagccctgttgccagccaatgcccgtaatacggaagcatggttatcaggatgcgtaacgatcgcctcatttgcaatcgttgcttacctctatccatctatttcaacgggagaaatactccgtaacgaaatcgaatggctgcccggatcggatctgaatttcacactcaggatggatggtttcgcctggatgttttcgattctaattaccggtattggttttctcgtggtgctctacgcacgctattacatgtctcccgaagatccggttccacgttttttctcctttctactggcttttgccggtgccatgcagggggtcgtcattgcgggaaatttgatcctgttggcgatcttctgggaactcaccagcattttttcatttctactgatcggttattggcatcacaatgcagcagcgcgtgatggcgcacgcatgtcactgatcatcaccggaaccggcgggctctgtctgcttgccgggctgattctcatcggttacatcactggcagttacgatctcgacaatgtactggcctctggcaacacaatccgggagcatgcgctctatgttcctgtgttggtactcatcctgctgggtgcactgaccaaaagtgcacagttcccatttcatttctggctacctaatgcaatggcagcaccaacaccagtatccgcctacctgcattcagcaaccatggtaaaagcgggcgtatttttgcttactcggttatggccggtattatccggcaccgatgaatggttttttatactggggctggctggtatgggttcgtttctgctcggcgcctacttcgctatcttccagcaagatctcaaagggttgcttgcctattcgaccatcagtcatctcggcctgattacggccttgctcagttttggcagcccgttggctgcggtggctgcaatttttcatatgatgaaccatgctattttcaaggcttctctgtttatggctgccggcatcattgatcatgaagcgggcacgcgtgatatgcgcaaactgaatgggcttttcagctacatgccgattacagctacgctcgctatggtggccagtgcagccatggcaggagtaccacttctcaatggttttttatcgaaggaaatgtttttttctgcaacactcgggcaacattccggctctgtactggatagcgtactcccctatgcagccacgattgccggtgccttttcggtcacctattccgtacgctttattcatactgtcttctttggtcccaaaccttcggagcttccccgggaacctcatgaacctccccactggatgcggcgaccaattgaatttctggtactcgcctgtctcattattggcataatccctagcatagccatcggcccttatctgcataccgctgtgacttcggtattgcgcgaatacacgccactctatagcctcgccgtgtggcacggtatcaacacgcctctgatcatgagcataacggcgcttgtcagtggcacactgctctaccgggctctacaaaattacctcgcccaaagcgaagatggcccgcctggcatacggcaattcaagggccagcgaatttttgagcgatcactggttgcactctcctggcgttgggcacgctggatggaggaaacattcggcacacaacgtttgcagccacaactgtttctggttattttcatcgcgttaattgcgggatgctggccattcctcgaaacagatcctgatttcagcctgatagcggttgccgggattgatcccgcttttgcaatactctggggaattggaatcgcttgtgcgctcggagccgcgtatcaggctaaatatcaccggctggctgcactgatcctgatggggggggcgggccttgccacctgtatcacttttgtctggttttccgcacctgatctggcggttactcaactgctggttgaaatcgttaccactgtgctgatcctgcttggcttacgctggctaccaaaaaggatggaacaaattgacaatgcgacaacactgattgcgcggacacgcagattgcgtgattttgtactcgccgccagctgtggaggaggaatgacactaattgcctataaaataacgaccaacgtcgaactgccggaaaccattgctggattctttctggaacgggcctattcagaaggcggcggcaacaatgttgtcaatgttattctggttgattttcgtggctttgatacatttggagaaattacggtactaggtattgtggcacttactgtttatgcgctgctgcggcgcttccgccctgcaccggacagtatcgaaattccggaacaacaacgtatgcaaaatgactttgatgatcgtcagcctgatcgcaaggttggtgagaccgtgtacgattacctgatggtacccaccgtgctcatgcaatggatgttcccgttcattatcctgctggctatctatttatttctgcgtggccatgatctaccgggaggtgggttcgccgctggcatcaccctagctatcggtctcctgctgcaatatctcgccagtggtacccgctgggtggaagatcgtttgcacatcctgccaatccgctggattggccttggcttgctgctggcggcattgactgggatgggatcctggttgtttggattcccctttctgacttctcattccacttatctggagataccactgatcggcaaaatacctattgctactgcattgttctttgatctgggtgttcttttgctggtggtcggcgcaaccgccctgatgttaatcgctattgcacaccagtcgatccgtagttaccgtgcgcgcgccattgaatctgccaaaaccggagaggacaactgatggagctaattctatcgcttggtatcggaatactggttggatcaggtgtctggctactgctgcgtccgcgcacttatcagatcattatcgggctaggattgctctcttatgccgtcaatctgttcattttcagcgccggtcggctggtaatgggcaggccacccgttacacagaccggtgtccgggttgatccggccaccttcgctgatccagtgccccaagcactgattttgacggcgattgtcattggctttgctacaacagcgctgtttctggttattctgctagcttcgcgcggcctgacaggtaccgatcatgtagatggcgaggaatcggaccgatgaaactgtctccagaacatcttgttatcgcacctattctgattccactcatcgctggtgcattacaactttttcttgatgatcgcggacgtaagctgaaggcttccctatccattctgtcaactgttgctctgctggcaatctcggttctgctgctacgttttactcacacggatgatgaagcaagtgggggtaaaattgctgtctatctgctcggtaactggccgcctccattcgctatcaatctggtactggatcgcttgtccgccatgatgctggccctgactgccacgcttgctctgcccactttaatattttcaatggggcgttggcacaaggctggagtgcattttcatacgttgttcctattactgttgatggggttgaatggtgcattcctgaccggggacttgttcaatctctttgtattttttgaagtcatgctggctgcatcctacggattagtattacatggatcgggcttgctccgggtaaaggcggggttacactacatcgccatcaacctcgtcgcttcactcctgttcctgatcggggtcgctctgatttatggtgttaccggcaccctcaacatggctgatctcgccatacgcatcccacagatcaatgaaacaaaccaaacgatgctggaatccggggcagccattctgagtgtggccttcctgattaaagcgggcatgtggccattgagtttctggttgcccgaaacctacgccgtagcgccggcaccatcagctgccatctttgccatcatgagtaaagttggtatttatgtgttgttacgcttggcactacttttttttggaagtgatcccggtttttcagaagggccaggagcacagatacttttgtatggtggtctagcaaccattggctttggcaccgtcggtgtcctcgcttcacagactctgggacgatttgctggtttctcagtgctgatctcatctggcacattgctagcaagcatgggtctggtacaagccgaggtgactgccggcgctctgttttatctcgtgagctccacgttggcaatcagcgcattattcatgctcatcgaactggttgaaagagggcaaaacctggcagctagcgtgctggccgttaccatggaagccttcggttatcaggatgaggaaatagagaatgaggaaattgtaggagtggccatccctcgaacgatagctgttctcggcacttgctttgcagcttgtgccattttgctagttggcctcccccctctttcgggtttcattgccaaattcgtcatcctctccgctatatttagccctgatatagcaagccagatagatattatcccggcaacgtcctggtggttcatggcactactgattctttccggattggctacactgattgccatgagtcgctctggcatccatgctttctgggcaccctcggtcgacaccacgctgccacgggtactgtttatcgaaatcataccggttgctgtgttgctatgtacaacgcttgtattgactatacaagcagggccggtaatgcgtttcatggaagcaacagcaatcagcctgcatgcacctcagccttatattgaaggtgtaatgaatgcgccaaccatgctgccaccgccaatggaggtagtagaatgagcagactattcccttatccactgcttgttgtttcgttggttatcacatggctgatgctggctggcttctccctcaatcagtttttactgggtttgataaccgcccttattgctgcgctggggttggcggcactgagcccagtaaaaccacgactcaggcgatgggatctactccccaagctatttgcaattgtgttttatgatattgtgcgttccaatattgctgtcgccggcattattctgcatggaggtaaacggatcgggaaatcaagtttcatggctattccgcttgatctgcgcgaccctaccggattggctatcctggctgtcattataacaagcacccccggcacagcctggatcgactacaactccacgcgcagcatcctgatactgcacatctttgatctggtcgataaaaccgcctggttaaatctgatcaaaaatcgctatgaatacctgttacgggagatatttgaatgagtgccactatactcttctgggccgccactatcgcacagatcgcgctggcaattgccatggtgctagcatcagttcgcatgatcagagggccgcgtgcccaggatcgcgtactgggattggatgcactctatagcaactcgatgttgctgctgctcgtttttagcatacgtactggaaatccactatattttgaaatttcactgattatcggaactctgggttttgtggcaacagtggcacttgctaaattcataatgcgcggagaggtaattgaatgaatcaagccagcgatttgcccctatgggccgcgttactcattgccatctttctgcttattggcgccggattaactctgattggttctttcgggctctatcgtttgcgcagcttctacgaccgtattcatgcgcccacactgggaacaagctgggggacagctggtattgttatcgcttcgattgtctatttcagtgtagtggaatcacggctcattctgcaccacctgctgatcggcgcatttgtaaccgtaactacgccggtaacgcttatattactgagccgcgccgcactgtatcgcgatcgtgcagaaaacggtcctgatattcccatcctggaaccacccaataatccatccgaagtatcaagcacggagaaagaatcagctgattctcacaataacactcacaccatagagaagtaattacgcaataccgctttccatcgatttgttacgggagttttgtgcgggttatttgcataggctgctcttggctctttttatagaatagaagcttcgttacgtcctctgactttggcagccactacccaattcaaaatccagatgtcgaataactacactattttctcaggacctgtaacggtggctgggataaggttgtacgtgttccaatcacgccaaatgctgtcacgctgattatactgaccagtacgccgattacccaaatccatgggctgggtgaataagtaatgtgcaatgcatatttgccaatcaggtaaccaagtacacttgcccctgctgccgcaaaaaaacctgccagcgccccgagtactgcaaattccactgcccacgcatgcgcaagctgctgctttcttgctccgagtgtgcgaaaaattgcggcttcataaattctttcatcctgagttgaagcaatcgcagcatacatcacagcaaaccccgctagcagagtaaatagaaatacaaattcgattgcgtgcgttacttgcccaatcatattctgtactcgttcaatcacacttgccacatcaataatcaggaaatttggaaaaatacgagtcagctcctgcatgatttggatcttatcagggggcaaataaaaactggtgacgtaacttgcagggtaattgtcgagcaatcccggacgaactacagcaaaaaaattcacctggaatgtatcccagtccaccttgcgcaaactcgtaattgtggccgagaaatccccgccccccgtataaaaactcagacgatctcccagtttgaggccaagtgtctcggcaaacccttcctccattgataactcgtgttcagaagggatcacttcctcgctccaccagtgtccagccacaatttcattatccggttgcaacgtatctgtccaggataaattgaattcacgattgattagctgctttgcccgtggatcaggataatcttcgagatttactgctcgatcattgatctctaacaaccgaccacgtaccatcggaaaaactttcggtcgtggaatagcatgttcatcgaaaaataccatcaacctctcctgctgatctggctgaacattaaccaagaaccgattgggtgcattctccggcagacgtgcttgccagtcctggagtagatcattgcgcgttagcgtcaatgtcagtaatgccattagccccagtcccagtgcagtagcttgtaccagactgggaatagcccgccttcgaatattggccagcccgtaactccacgggccagaacccggcgggcgggtcagcagaaacagtctgatcagtagccagccgaacaggccaaagaagataaccgccagcaggaagcccagcatgatcatgattcccagcttgaatgatccagccttccagatgaacaatatggacagtatgactatcccgaacccatagccagccagactgtgcatattggccagttccagatcacgccggatcacgcgcaatgcaggtacttgtcgcaaattcaggagtggcggtaaagcaaaacccagcaacaacaccataccagtcaacatcccctggatagcaggcaacgtactcggtaatggcaatgtaaccccgatcaactcctccaaccagtatgacaaaaactcctgggtaagcacggcaaatatgcatcccaacaggcttgcagccaaacccagcataatgaagtagtaagaatacaggcgtagcagatcagattcagtcgcacccagacaacgcatgaccgcacagccatccagatgacgttgaatgaaacggcgaatagccagagcaatagcagcagctgctactaccacgctggccagggctgccaagttgagaaatttgccagcgcgatcaagcgccgaacggatttctggacgcgcttcctgaatacttactatacgttcgcctggagacaacctgtctttgacccagtgcctgaattctcttacctgcgtctcatctcctgctactaaaagctgatagttaatccggctaccaggctggatcagctgggtggtagccagatctttctcattcatcagcaatctggggttcatgctaacaaaaccgacagaatgatccggctcactttctaccatggacatcactgtcatttcggcagcccctacctcaaccttgtcacccaaagtcacttttaatgcattgatcaccttctcatccacccaaactgttccaggtttagggattccctgggcaatcctgatggattgggcaatattttcttctgtcggtggattggccagcttcagttccccccgcagcggataaccgggtgcgactgccttgatacttgtcagaaggctattgtcaccaaaactgaccatactggggaatctgaccagatgagtagtccttaacccgatctgctttgcgtgctcagcataagagggtggtacaggagtatcggaagttaccaacagatctccgcccaataactgattactttccagcaccagtgctttttgcaccctatctgaaaaaaaactgacggttgctacactgctcaccgctataacgagtgcaagcgtaaggatatacaactctcccgctcgccagtcccgcagcagcatacgcaaagaaagcctgatcatgttcatttcagggtgacctcggacagataattcaaaacaagaatgactggaagccaggatggctgattcacatcagggcacttctaaaaagcagtctttcaggaaaatcgtggtgttgcatggtacccatcaatcaacagcccgaccggcgaccagttcgataacccgggagcaccgggcagagagatttttgtcatgtgtcaccagaacaagtgtggttccctgttctcgattaatctggaacatcagatcaataatctgggctccagttgccacatccagattaccagtcggctcatcggcaaacaacattttaggatgagtgacaaaagcccgtgcaatcgccacacgttgttgctcccctccagaaagctgtctgggataatggccaactctttcttccagccctacccgcaccagccagtcatgtgcgatatcacgggcattgtcagcacctgatagctccagtggcaacatgacattttcaagcgcaatcagtgacggcagcaactggaatgattgaaacatgaatcccagtagcctgccacgcaaactggcgcgttcatcctcgtccagcttgaaaatatcttctccatccagaaaaacagtaccatgggttggcacatccaaccctgccagcaaacccagcaaggtcgactttcccgagccggaagcgccaaccacagcaattgattctcccgcactgacttgcagattgatatcctgcagaataatcagccgctctccccctgtttcaacctctttagttaaattgctagcctgtatgataggctgatcattaccatttacaggaaccaattgttcaacaatcaactttctagccatgaaaaaactattgtttgtcatattatgtttattcggtacctttccattcaattcagcctggtcgggaacagacaccaaaatcatggtgctgggggacagcctgtccgcaggatatgggctgccaccgcaatccggatgggtaaatctgctggaacggcgattacaaagccaatccgctggttacaaggtgataaacgccagtatcagcggggaaatcaccttaggcgggcgcaaacggatagaacaggcacttaaaaacaataaaccggatatcgtcatcgttgcactgggagcaaatgacggtttgcaaggccgttcaatctcatccatttacgagaatctggaagcgattatcctgacctgcaaacagtacaacgccaccccactcttgatcagcatgcaattaccgcccaattatggcataagttatacgcaaaagtttcgtgatatctacccgcgcctggcaaagaatcagcaattacaactggctccattcctgatggaaggttttggcgatcaaaccggtttttttcaggcggacggcatacatcccactgcccaggcgcaggaaaaaatgcttgataatatctggcctgcactggtttccgtattgaagtcacaacaaacacaggcatccactgccagcaaaaatctgattgatggaactgatacaacaaccggattgctgcactaaatttgtatagatataacccccaatttcttaataaaaacattaagatatcttgaaatacggatccatatttctcaaaaatacccgtaactcatccggaaggggcgcttccaggcgcaaaagttcgccggttaccgggtgtatgcagacaaataccgaagcatgcagaaacatacgctttaataccagaccgcttccatcatccttctgtaattgcctgttcaacccgaaatcaccatatttatcatccccggcgatgggaaaaccgagatgcgccagatgcacccgaatctggtgggtgcgtccggttttaagttcggcatccagcagactgaaagcttcccaggttttttgtagagcaaatagcgtatgagcctgctgcactttgtcatgatcattcctgccggtagctattgccacacgccgctctccttctgcagtcaaatatttatacaaaggtaagcggacattttgtagcgaatttttccatttcccacgaaccagtgtcaggtaatgtttacggactgtcccttcgcggatctgtttatgcagctccagcaaagtttgccgtttccgggcaagcagcagcacacctgacgtttcacgatcaaggcggtgtaccagttccagaaatttccagtccgggcgctgtttgcgcaactgctcgatcacaccatagctgatgccactgcctccatgaactgcggttccggccggtttattgatcaccagcagataatcgtcctgatacagagtatcaaattgttctgcccggtaaggcgcctgccgggatattggctttgccagcttgagaacgggtggaatgcgcaccttgtcattcagcagcagacgatagcttgcatcaatgcgcttgctgttaacacgcacctgcccgctgcgcagcaattgataaatatgacgtctgggtatatccttgagagctttgatgagaaaattgtcaatacgttggccttcggctgtttcatcaacctgtttaacaaccgcatgttccgatataatgcccggcataattttctctttaccgggcgccccgcttttacctatacttttcaaactcaaattcctgtaaatctgttttttcaccatgaagcgattgcgtggtctattaagaagtcatatacccggagtttcgttttcatacgctggatgaatccagtttccggctggttaatgtcgctcaccatatttaaaagtagcgatggtaattaatttacgcgctcgacatatacatagattcaagttcctgatcccatacccaaccatacaaggtatgttctctgccggccctgtgtctcactcatttttgacccggccagccggggatcaaaatgccgagtgacagttatcgattgatctatttcaacaggatatcgaaaccattatctgtaccatgtccaacactctggccacagacaaatctgtgcaaaaataccaggatgccacactgacagtgaacgaaaggtttacccgtacaccgagcgcgggagacactaaatgaaacgcatgttattcaacgcgacccagcccgaagagctgcgtgtcgctattgtagatgggcagaagctcattgatattgatattgaaaccctgggcaaggaacaacgcaaaagcaatatttataaagctgctgttacccgccttgaaccaagccttgaagcggcttttgttgattatggcgccgggcgccatggttttttaccctataaggagatcgcccccacctgttttgacaaaaataccgaacgatccagtcaccgtatcggtgaactactgcgcgaaggccaggagctgattgtacaggttgacaaggatgaacgcggaaataaaggtgctgcgctcaccacctatatctcactggctggtcgttaccttgttctgatgcccaacaacccgcaaggggggggtatttcacgccgtgtcagtgcggaagaacgggcagaactgcgtgaagtaatcaaccatcttcaggtacccgatggcatgagtatcattgcgcgtaccgctggtattgggcgcaacgaagaggaattgcagtgggatctgaactatctggtgcaactctggcgtgcaatcgagggagcagccagtagtgagcgtggtgtctttctgatttatcaggaaagcagtctcgtaattcgcgccattcgtgattatttccatgcggaaatcggcgaaattctgattgataaccctgaaatatatgagcaggcataccagttcatggccaatgtcatgccggcaaacgttgaccggctaaagctctaccaggacgatattcctctgttttctcgttttcagattgagcaccagattgaaacagcctattctcgtcaggtcacactgccttccggtggctcgattgtgattgatcataccgaggcactggtttcaattgatgtcaactcggcgcgcgccatacgtggctctgatatagaaaacactgcactcaacaccaatctggaggctactgacgaaatcgcccggcaattgcgtttgcgcgacctgggaggcttggtggtcgttgattttatcgatatggaagtcacccgcaatcagcgggaagtggaaaccaacctgctgaaggcattgcgcctggatcgtgcacgcgttcagatcggcaaaatttcccgttttggattgctggaattatcccgtcagcgtctgcggccttctctcggggaaggtaactacatcccctgccctcgctgtcatggtaccggccatatccggggaacagattcatctgcgctgcacatactcagaattatccaagaagaagccatgaaggagcagactagcatgctgcaggtgcagttgccggttgatgtcgccacattcctgctgaatgaaaaacgatcagaaatataccggcttgaagcacgcctgaaagttggcatcatcctgatccccaatatctacatggagacacccaactacacgattaaccggctgcgtcatgaggatgtcaaatcaacagaattgccgccaagctacggaatggtggagaaaaccactgaagaaatcacactgccatctacttcacaagaactcaaggcaatccggccaaaagctgccgtaactggtatcaagcccgaacaacccgcaccagtcccagaagaaaaaccccgggaacaactttcattcctggacaaatttttcagtctgttcagaccggcaagcagcagtcgggtagagcctgaacagacagcagaggagtcccaagctagacctccccgtagcgaacgaggccgaaacaggcgcgatcgaggtcgcaacaagcgtacaaaaaacaatattccggggacaacagcaagcgagacattacaggaggcaggcaatctgccgtcacttgaacaatcaactggacatcccgttgaaagcacgagcaatgatgatcaccatcataaagccagccggcaagggcaagatcagttacaagaatcgggagcggaaagtaatctgcctgatgcaacgacaaccggagaaggcacaacgtctgcaggggattctgtcagtgaaagaaaaacagataggagaggccgttcacgccgtcgtcgtggaggtctgcatcgtgatcgggaagagcggacagatgcaaataaaaccactgaacagggagaggtagcccagattacaagcagtgaaaataatgagccagttgtaccttctgctgatggcaaggaagatagggagctttcattccagccccccacagaaccgactcagcatattacgccgatagcatcagtcgacgatattacagcggagcaggaagtggcctctgccaaggtaatcgagccaataaataccgatgctgaatcaaatactggatcacaggctgcttcggaatcccgtcagccaatcgaactacctgatctcacccaaagtggactggtcatgatagaaacagctccggataaaatagccgaagtaccagaggaagccttggcaccagtcaaaaggccgcgtatcagacccagctacttagcggaaccggatacaacaagttctgaacctctggtacaaatagaaaccagagattgatacgcaacagctaaatggcacttctaaaataagtgtgtctatgatgacgaacgcgccgactgtaatagttagcgtgtccgtcattgtgcggcccataagactgatgggtccactgtagggcgccgttgccgctacaattttccccttggatgatggcgggcatgcaattgcctgagtcgttcacgtgcaacatgcgtataaatttgtgtagtagaaatatcgctgtgacctaacaacagctggaccactcgcaaatcagcaccatgattcagtaaatgggtagcaaatgcatgacgcaacgtatgtggcgacagttgttttacaatccctgcctgtcgcgcatggcgcttgatcagataccagaacgcctggcgagtcatggcatctccccgggttgtaacaaacaacatattgctgtgcttaccagccagcagtatcggacgcgcttctcgcagatataaatccagccagtacagtgcctcatctcccaaaggaatcaggcgttccttgttgcctttacccaaaatacgcaccacccccatatcctggcggacttgagaaatggccaaactaaccagctcggaaacacgcaaccctgcagcataaagtatctccagcatggcacgatctcgcaatccgagtggttgcttgatatccgagactgccaatagcgcttctacttcagattcaaccaggctcacggggagatgacgggaaacttttgggctatctatatttacagcaggatcgataagaatctttccctggcgcagcagataccggtaaaaccgtctgatacaggctaatgccctgctggcagtgcttgctttcgccccttgcgcaatcctgtcggacagaaatgccaataaatcagcctgcgttacgtcattcaataacccatttgtctgttcccgccgactgagccattcaaccagctgcatcagatcagcccgataactggctagtgtattacgggacaaaccatcttccagccacaagacatccgtaaactcatccagcatccggatattggcttcaaaggtattcatcaattacaaggtgttttattgacaggaaacccatagttatgggtacgagcaagttcggttaattgataattcctatcaataatggcagagcaggaattttcaaactattccacaaatccgatcagcgattgaggataatttccagtacaaacttgctaccaatataggatagaacaagcgcaacaaatccagccagcatccagcggatggcagtacgtccacgccatccgtacagatgtctaccagcgagcagggctgcgaatattccccaggaaatgaaaccaaataatgacttgtgcgtaaacggtaccgatttgccaaacagctcctctgaaaacacgataccgctaagcaaagtgagactaagtagaataaacccgatccataccaggcggaaaagcattttatccatcaccagcagcggtggcaactgtacaaagagcgaggacacaacagaatgatgcaggcgacgctcaagaagcgtcataagagctgcatgcagggcagcaatcgtgaacagactgtaagcgagcattgctgtcagcaaatgcgccttgaaagccgtcatcccggcatgtgctagcggatggacggagggcagtaacagcggaatcagaacagcgatcgccgctatggcagaaatcggcgcgatgagattttgtaatccctgcagcgaggataaaaaacctgatacccaataaatcaaggcagtcagccatacaatagctgaaatggcattgccgacaccaaagctcagcatatcatccataaataccgaacggtaaagcaccacgccatgcattaccagaggaatgagcatcataaactgctgtaacttcacattcggaaccgttcctgcagcattcgcctgcaacactggcgcaactgtacgcaaggtttgccagaaataccatccggcaatcccgtaaagcaatgaagtactgagataagttagaatactgggcattggcaatctatctgaacaattggtggaaaacaaccagtctacccttcgtccggataaagctgaagtgctgtttgacagtttccatgaagtttagcatagggaacaactctcaccagcggataccgtttcaacaggagcctacatgtttgacaatttaaccgaacgactttccggcgtcatcaaaactctgcgtggtgaagcacgcctgaccgaaagcaatattcaggaagccctgcgtgaggtgcgcatagccctgattgaggccgatgtcgccctgcctgcaattaaagtatttattgaacaggtcaaacaacgcgccattggtcacgaagtactgggtaaactctctcccgggcaggctttcatcggcgttgtccatgaagagctgatggccatcatgggtggagacaaagcggatatcaatctgaatgttgctccacctgccgtcattttaatggcaggcctacagggtgccggcaagaccaccagcagcggcaagctggcaaagtggctgatggaacagaaaaaaaagaaagtgctgctggtatcctgtgacatttaccgcccagccgcaattgaacaactggcacttctggccgagcaaactggagctgatttttttccggtaaaaaccggccagcaaccagccgaaatcagtactgctgctctagacttcgcacgcaagcatcatcatgatgtagtaatcgttgataccgctgggcgactgggtatcgacgaagccatgatgcaagaaatcagccagctggaacaattgctgaatccggttgagacactgtttgttgtcgatgccatgcagggacaggatgcagtcaatactgcccgggcttttgcggaagtgttgccactgaccggggtgattcttaccaaacttgatggtgacgcacgcggaggggcggcgctgtccgtccggcacatcactggcaagccgattaaatttgccggtgttgctgaaaaacttaccggattggagccgttttatcctgatcgcatggcctcgcgtatcctgggcatgggggatgtgctcggattaatcgaggaagcacaacgcaccactgatcagcaagaagcagaacgcctgatgaaaaaaatgaaatcaggcaaaggcttcgatctgaatgatttccagcagcaatttcagcaaatgaaaaaaatggggggcatgagtgccatgctggataaattgccgcaccaactcagtcaagccgcccagaacatgaatgtggatgagaaagttatcaatcgtaccgaaggcattatcaactccatgacgcctcaggaacgagccaaaccggaaatcatcaaagcctcccgcaaacgccgtattgctgcaggttccggtgcttctgtacaggaagtcaatcgtttacttacgcagtttgagcaggcacgcaagatgatgaaaatgatgaataagggaggaatggcaaaaatgatgagagcagtcaagggaatgctccccggtatgcggtagaactgcgtgttcagtcccggatgattgtatagataaaacttgttatccgctgttcatggcgcgagctgtcatgagagcgctgatttcctcaaaccatccgagagagccatgaaatgataatagttttgcataagaatgctcgtactacaccagcgatacgggcagaaattaccgcaagcgttgactttgctgtggtgctgtataccaaatcagcatagcgggtttatgcttcgttacgctggtggcgcagacgcaagtgaaattgttgttcggattggataagccagctgtgacgaaacaaagaaataatacttaatggcaataaaagaagcagatttacattttttacggcgctgcattgcactggcggaagaagcgcttgaggccggcgatgagccgtttggttctgtgctggtttccggtgaaggtgtcgtactcctggaagcccgtaatcaggtaagtagcggagaccagacacgtcatccggaatttgaaattagccgctgggcagcgacacatatgacgccggaagaaagaaacaaagcgacagtctacacttctagcgaacattgtccgatgtgttccgccgcgcatggctgggttggattggggcggattgtgtatgccagctcagcccgacagttatcagattggttggcagcgcttggcgcaccactgcctcccgtcagcctgtttccaattcaggaaattgtaccgggtctgatcgtcgaagggcctgtaacagagcttgctgagcagatgcatgcgctgcatattcgccgctttcatcgcacacatcgtccctcggaatagcaaaaacagtgtgtgccgtttatggattgctggatacagcaagccaaaatgggaattggtcttgcgtcggcagttgtttcacgacttccagtgtttgtgtatctatcactacgacctggctggggttcgtgacgccgacataaatcagacgtccgtcatggctggcacgcatgccatgtgacccctgtccgacatcaatccgtctgacaactttgaacgttatagcatcaatgacatcgaccatagggtcagccgttgcaccggtaaaaacatactggctggcagtcacggcatctataccggcatgcccccggccaacaggaattaccgccagtattttttgcgtcaagagatcaacagcggcgacttgaccagtgaaatcacgaatccaaagtgtcttcccgtcgtccgatagatcaagattatgcggctgatcaatgccaggtagcgaaaattcatctgttttttccaaggttcgcatatcgagtacagcaatgctgccactgccttgcagggtgacatacgcccgtgtgccatcgggcgtgaaacgtacgttgtgaggtgctttgccaacaggaatgaccttacccactttttgcgtggcaagctcaatgacagtgaccgttccatctccggctccgacagccaagccctgttggttatccggactaatcgccactccctgtgcaattggaccaacgtcaaaagttgacaggagtttgccactggttgtatccagcagataaacattggatgaacctgcttcgctgaccagcaggtggcggccatcagaactgacagcgtggtaatgggcgccaggcacgctccaggtggttcctgtctgtaggttttccaccacaccatctgtctgcaaggtgacgtaaaccggagtgggaaatagtgaatgaggctcaaccgcatcggccgtattgatcatcaaggcggcaaaaaccaaccctgttacgcaacggaaaacaatccaatacagttgccgcaaggaaaaaataaaaggaattattaaagtgatcatgtgattctcctgaatgtaaatatactttatgttactgcgttacaaatatattagataatgtagtcacaagatatctgcccagagggcggacatctaatttgtacggcggcaaggaaagaagaggtattttgggtgtgtctgtagcaacgctactttttgagatgaaggaaagtattttcggcgaaatacctcagcttatacagcacttgatcataatgcctttgcgtcctccggttcttctttggaggaataacaacctccactccccgtttttccgcctgttcaataatggcattactgtcatgccacgatctgccaacagatgatctgcatccatcccttcgatcaagcggccaacttgcgggcaatcagcagtggtaccttgtgtaacaaggattctgagcggcataccatgcgcatccacggccagatgtatcttggtgttgagccccctttcgcccgattcatctcctgattatcccctctggccccgctggcatgtgggtgaaccttgccgtgactggtatctatcatcagccatgcataatccggatcatccatcaggatttccagcaatttttcccagatacgcttgtcacgccagcgaataaaacggcgatgggtattgcccccccccgtgtagtccagcggtaaatcccgccatggggctcctgttcgcataatccataaaacagcattgataaaccggcgattatctgtagctatccctccccatactccttctctacctggtaaatgctcctcaagtagcgaccatgccttatctgaaatatcatgcctacgatgggctggcgtcatatgaaatccttttaaaaaataaaaggatttcatatctttagcctcatgactacactatccagtaccagaaaaacttaacttaaactaacttaattaacaacataataaataaaataattattatcagaggaacgataacagccttccaatccgaagaagtcgctttagggctgttcttcatcatttccagcgctttaggaaataaaattattaagaacattattaacgctaacgcagagccaatttgcatccaatccatacccaaacctctgttccttccacttattccactctaaaaacaaagccccggcttgaccggggctttgtttagctaaagtagctgacaactaatcatcattacccataatccctaaaatttgcatcaagctgataaagatattgaaaatggtcatatataacccgattgttgctaacacataattagtttcgccaccatgaataatacgactcgtgtcatataaaatgaaaccactcatgatgagaataactacagttgatatcgctaatgacattgcaggtatttgtaagaaaatatttgccagagcagcaagtaaaactaacaaaaaacctaccatcaaaaacccacccaggaaactaaaatcttttcgtgtgaaaagagcataggcagataatcctataaatatcgtgcccgtgcccgctagtgacaatgtaatgatatcgccaccattaggcagagaagcatacatggttaacatgggacctaatccaaatcccaataaacctgtaatcagaaaaacaattccgattcctgctacagattgggcaaaacgaggtaatacaaacattgcaatcagcatggcacctatcacagaaattaaatatgtcatcggtggcatatttaagaacattgaaagcccagcagttagaccgctgaacaatagcgttaacgataacagcatgtaagtgttacgcaataccttgttagtcgttaaagcagatgatgcactatgagcaactgttgaatagcttcgattcattttaatgatctccaaatataagtatacaaattactgctgtttttgttatagcaggctatattgacccaggtgccttatttatagttcatcctgtaagtataactcagtagcgtttagttttttaaattggtgatttctctcttgtaaaatttattaacaaaatccagatgaaagaaacgagtttgacctggtcaagcaaaaccggacaacccggttaagcagagcctgtaaagctttttgtgtaaacaccttgcgctgtttggttgccttgcggatgacgctgttgagcgactcgatggcattgatcgtatagatcaccttacgaatctcaggcggataatcaaacagggcaatcaggttgggccagtgggtgttccacgattttctgatttgcgggtactgcttgtcccactactcggcaaaacgctccagagcaagctgcgctgccccttcggtgggcgcgctcctggcaaacctccttcagagcggtcgtaacggccttgtaatccttccaggatacgtatttcagtgagttgcgcaccacatgctgcacaatgcacagttgaacgcgtgtctgcgggtattcagcagcgatagcatcggggaaacccttgagtccgtccacgcaggcaatcaggatatcttgcagcccgcgattctgccactcagtcacagcatccagtacgcgctctgtcactttggagaccagggtaggcgacacatcagcgtcgtacatttccctgaacgcatcaacgatgtcgcgcgtgctcatgcccttggcgtaaagcgccagaatctggtcatccatctgcattagacgcgtctggcccttgcgcacgatctgtggctcaaaagtaccagcccggtcacggggcacctcaataccaaccttgccatgagcgcccttcagttgcttggatgatgtgccgttgcggcggttatctgaaccacgcccggcaggatcatgcctggcataacccaagatgctcgtccagctcggctccaaggactgcttcaacggtcattttaactagctgctgggcaggctacccagatctgcttcagatttgatattttttgccaagcggccaatatggacttgcaactggttcaggccgagttaattcatttgtcagtagtcatggaaaatttcttcacaggggatgaaggctcggacgcttacacaatagattttacagtctcagctcgttattctaacgagacataaacacttttgacttctgtgtagttatcaagggcataagatcccaattcacggccgattccagattgtttaaacccgccaaacggagttgcgacgtcaaaaacctggtaacaattcacccacaccgttcccgctttaagcttctttgcaaacttatgtgcctttgtaacatcttgtgtccaaacgccagcagccaaaccgaacggtgtattgtttgcccttgcaatcaggtcgtcttcgctatcatatggaatcgcagctaaaactggtccaaatatttcttcttgcgcaattgtcatttcatcactgacatctgcaaagattgtaggggcaacgaagtagccattttcttgcgacttgcctccaccggtcaaaagttttgcaccctcacttacaccgacgtcaatatagttcattacgcgctcttgttgcgacgtagagatgagtgggcccatcatagtatcctcattaattcctggcccttgtttaattttttctgcgtagtcaaccatgtccgcaacgacattatcgtaattcttgctaggaatgaatacacgtgaaccagcagtacagttctgtccttggttaaacatgacaccatttagtgcgccagggattgccttagaaagatctgcgtccgataacaggatgtttggtgatttgccgccaagttctatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtgacggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactatagttcaagcgtaacccgttttaacgtttgtgcagctcttgccataatcatctttcctgtctgggaagaaccggtgaaaccaactttatcaactagcggatgatcgatcagtggctctcctgctgttttaccaaagcccggaataatattaatcacccctggtgggaaaccagcttcttcaattaattctgctaaatacaaaactgaaaggggtgtttgctccgctggtttcaaaaccattgtgcatccagtagccagtgctggacttattttatacatagccatcaagagaggtaagttccaaggtatgatttgcccgataacacccactggctcatgaagaacatagttaagataggggccggttaccgggacagtttgtccaacaattttggttggccatcctgcgtagtagcgcatattcttaaacgacagaggaatatccactactcttgactcgcgaattggtttgccgctatccaatgtttcgataatcgctagttcttcttgatgggcttccatgagatctgcaagcttgtacattagatgccctctttcagccgcactaattctggaccaagggccatcatcaaatgctttacgagcagcctttactgccgcatctatatcttcggcttttgcctcatatacattcgctaatacttttcctgttgccggatcataaacttcatacgtttcccccgatttactttctacaaactcaccattgatataaagtcgtttagtctcgcgcaggaatttttctactttcttgtttaaaccgagctattgtcaaatctggtgtatagagaatcaagcggctacctgttttcgatctccattttgtttaacgccgttaacgaatttgacgccctgcacaacatccgctaacaatttatagccccttagtcggaaccatttcttctgtgccacttccatcagtttgaacgccattgtcaaagtagtcatccggcttccacagtttttggttttggctgttctcagccggacagttgcaaagactgattcgactggattagttgttctaatgtgttgccagttttctgcaggataatcatagaaagccagcatggagtctttatcctttgccagacactccatcgcttttggatatttaggactaaaacgttcaatacagttatcaaatgctttataagccttttcccgtgtttccgcctgccagatattgtgcagcgcttccttgaccttgggttgcatggccttgggcagcttttccattacattggcgattttatgcacccagcaacgctgttgatccgtatccggccagcactgggtaacagccttccagaaccccagcgcaccgtcaccgacagctaatttgggagcacctttgaggccacgttgtttcaaatccgtcaatacttccgtccagctcgcttcagactcacgataaccatcagacaatgccagcagttccttacgccccgtttcgtcagaaccgataatcaccagaagacataaccggtcatccattcgcacagtgctgtagataccatcagcccagacataagcataccgtttgccactcagatcgcggcgagtccagttttgataatcctgttcccagtcctgcttcaagcggctgatcgttgcaggcgataatccaggtgcatctgctcccaacaggtgttttaaggtctctgtgaaatctcctgttgaaacccctctcagatacaaccaaggcagaaattcttcaatgcttcgtgttcgtttcaagtagggagggatcaggctgctgttaaatttgatgccagaaccgctgcgatcacgtactttcggcactttgacttcaatatcaccaagcccggtttgaatcgagcgccccggtagataaccatttctgacaactgccgttctacccccagcggttttcaaaccgccatgatgatggataaagctggttacttccgcttcaatcgctgccgacaacatcttgcgtgcgccttctcgcagcacttcctgtaacggatcattttgttctggtttattcagattaaaaactttactatccgtcatgcggtgtttcccttgttttgttggttgatctgccagatcctcaacaacaggttacaccgcttccttctcccttgtcatacaccagaaataatcatagctcgtttaaaccttctgttacttggctcatgaatttcctccttaataatctatttaattgattagataattcataaaaactagtgttgaatcttgatctggtcaagtaattacggacaccaccataggctctttttctgccatttttcgttcaaatatggtgagtagcagatagcccaatattcaatgcaggcgttcggtgttgtaggtatgggtgatgtcaatttttgcttcggtatggtttggcgtattctcgctgccagacacgttccatcttgagattcagaaagaatcgttccgctacagcgttgccccagcaatttctcttgcggctcatgctgcaaacaaatacatgtctggccaatcatgcttgatactgcgccggcatattggccaccccgatcagaatggacgaatcagccctggtgctggcacccactctcttgcgcgaagacagctccagaacaatagccagatagcgacagcctgaaccagttcggatgtaggtgatatcacctgcccaggcgatatttggcgcatcaaactacgcacccgacggtgaaccaatagaaaaccctcttgctgccattgctgtaaccgatcgacggctaccataactttggtgactggttgtaaatgctgctttcaaatggatgctggctttgcaacaagccggtttggcacagccgtgccgcgtcataatagcccgagcgacttacctccaggaggcgacaactacagacaacagggatcgccttcttttgcaactgtttgacgagctggtagctcatttcagttgccggttttcctgctcaagctggcgaataagttgttgctcggcagtgagcggattgcctatgccagaattctcactttgttctgattcatattgagtcaccctgcgacggatggcgctctggccgatgctcatgctttcactgacgtggaatatactcagcccctgttccttaatcatatgtacgatttctagtttgaagctggtatcaaattgcctgcattgctttttcatgtaaaactcatcggatagtggattttccacctatcgaggtgtccggacaaattagaccaccacacacaatacgagaagcattcggaacaagcgatggagagtagctttctcgtgctccatcatttagctactgcctatgtgctggtcgagaagttaaaagcacatacttaccagatgaatcttcttgtttccatgacagctttgcacagcgataaagatattacaaattcttcagcgattaaatttttcaggaggtgcaattttgttatttaacaccccacccaacaatgtaaaactaactttttcgtggctcgtccttggcctaatgtccagtgtcacctttgttggtatgttgtcggagctaatgccctcgggcattttacctcagatggccgaaggtcttgatgtgtccgaatctcagatcggatttttggtcggtgtttatgcgttagcttccgcgctttgtgccattcccctgatcagtgccacgctgaccgttaactgaaagaagttgctgctgatactcctgatcgggtttgcgatctctaatattatcatcgctatttcttcgtcatattatgtgcttattgcctcacgcattcttggtggcatttgcgcaggtattatgtggccaatgattgcggcttatggtacccgcttggtccctgaaaatgtggagggaaaagctattaccgttattatggcaggcaatacacttggcgttagtcttggtcttccttttatgacgacgatcggcattgcatttggttggcgcaccgaatttctagttgtgggtttacttgtcgcaattattggtatcctttcgtattttgtattaccctcagtcgagggggaaaagcttaacagaagcaactcgcccttagccgtgctaaagttgccttccatgttgattgttttgctcctgacgtttctgtcagttgtcgcccactatggcatctatacttacatcacactgctcgtagaattaattgattttatcggcggcattggacttgcgctattaatctttggtgtaggttccgtcatatctgtcgttgtgacagcaaaatatattgatgcatatttacgtcccctgattgtatttatgttagccattggtggccttgcaatggctcttttacttgtgtttggcggcgttaccggggtttcgcatattgcatttttcctctggggtctcgccttcggaccggtggtgacgatgtatcaaactgctgtgacaaaacaggtcaaggaagctgtcgctgtagcgacatccgtgcagtccagtgtctttaacttttcaataatgatcgcaacctggatcggtgggctactgctaacccatttccctgaaaccggtatcacagccattgtttacgtatcgctaatagcttttatcttagcgactactatcgcgttctttgctaaacgcacactccgttcttcctaagaatctgttttaatagcattattttcaaactccaaaggaaaataacatgaagaaatttatcaatcgcgcatctatggacagcacgatgaaacaagtgagatttcagtcgatacaggggtgatcaagcagatcggaaaaaacctgcccaaggccgacgaggagattgatcttcagggtcgactcgtaatcccgccctatgtggatgcccatttgcatttggattatgtatacactggcaaaaacgatggggccatgaactcaagcggcacactgtttgaaggtattgcacgctggcatgatgtgaaaaaaactcaaaccttcgaagcggccaaggaacgcgcgttgaaaggtattaatgaagaggtctccaagggtgtccagtttatccgcacgcatattgacgtagatgaccccaagctgacaggtttgaaagctatgctggaaatacgcgagcaactcaaagacagtattaccatccagattgtagcttttccgcaagaaggaatgtacgcctataagggcggcgaagaaatggttgaagaagcgttgaaaatgggcgcagactgcgtcggggccatcccgcatttcgaatgggcgcgcgagatcggcgaaaagtccatccaccgaaccgtagagttggccgttaaatataacaaactgatcgatgtccactgcgatgaaaccgatgatgttatgagccgttttgttgagctgctcaacgcactggctatgtctgaaggcatcggttcccgcacagcggccagccatacttgctcttttggctccgcagataatgcttatgcttttcgtatgatgggattattccaaaagtcagggctgaatttcatctctttaccaaccgaaaatgcttatctgcaaggccgacaagatacttacccaaagcgtcgtggtctcacccgcgtgaaagaattatgggagagcggtatcaatgtctgttttggtcaggattccatcaatgatccgtggtacccagtgggcaatggaaatatgatgaatatcctggataacggtattcatctggcacagacaatgtcgttcgatgaattagatcgatgcctcaatctaattacatccaacggtgccaaaacgctgaatgttgaagatcagtatggcatcgaggtgggtaaaccggctaactttatcgtcttgaatgcaaaatcgccatttgaggccgtacgccaacgggctgacgtattggcatctatccgcaacggcgaatatctatttaagcgtcctgaacctcgctacgaggttgaattcgatgcctttgaaaagattagctaaataaatacttgacagaaaatctaacttggcattaagaaataataagttgcggattttttctggaagggagattttctgaatttagtcgatgtgaaagaggaagaaaatgagctaaattcaaaaaatcttcgtcgtcacttgctggcataaaaataccattacgaaaaaacctcgcatcttggcactcctgagtgtttgaaattacttgaccaaccactagggtctattcctgtttaatctcaatattgatttaaagaagcaagctcgtgtcgttgtagctctcaccggtaatacgagcttgcaatgccccaattactgatcaatgctgagttctggtcgaagccactgaccattttgcttcacaataacctctacaacaagcaagatttgcgtacgactgtcgaaggcatgctgtaccgcatgcgcactggttgttcctggagagatttacccaaggcattcgggagctggaacaaggtttataaacgattcaccgcctgatctgccagtggaaaatggctcaaggtatttcaggctctggtggacacggagtgggttttcatcgatggtagcgatatcaaggctcaccagtgtgggtgcagctcaatccattgttgcagacaaagactatgacaatcaggccatacgtgatcaaatcgaacaacaaggtgccaagacagtcattccagagaagtggaactccaaaacaggtaatgcagatccggcccgaggactgtaccgataccgacacctggtagaaaatattttctgcacaattgaatcagttctgggcggtggcctcgcgctttggtaaactcaaaaaactacgaaagcctcgtggctatggcctgtgcctttctgtggttacccatgtgatgggaacagaccctaaataaggagtcgcatatgcgtaccgataccccccctcaacacgagcatcatgaccatcaacatgatgatcactgttcccatgccgtattcacagacactacagcacacgaagataactcagaaaaaccatttacggaccctgtgtgtggaatggaggtgtcacaaaccaatccacaaaaaaccgtggagtataagggcaaggattacttcttttgtagcacccagtgcatggaaaaattcaaggccactcccgaaacctatttaggtccactcgaaattcatactgcagcagagcttccagcggcaggagcgatatatacctgccccatgcatccggaaatacaacaggatcatccggggagctgtccgaagtgtggcatggcgctcgaacccttgatgcccagccttgaagacgacaaccccgagctaaaagactttacgcgcagattctggtggacgctgccctttactatcatcgtcgcggtgcttgcgatgttcggtcaccagctagggtggttcaacatggttacgcaaacatgggtagagctggtgttatcgctcccggtggtattgtgggcagggcagccgttctttgtacggggctggcaatcggttgtcaaccgcagccccaatatgtggacgctgattggtctcggtacggcggctgcatttgtctatagtactgtggcaacgctagcgccaggaattttccctgaaaccttcatgtccatggggcgaatcgccgtttattttgaagcagcggtagtgattatttcgttgacgcttctgggtcagatccttgagctacaggctcgatcacaaacgtcagcagcaatcaaatcgctactcggtttggcgccgaagacggcgcggcgcattaacccggacggcacagaggaagatgtgccattaacccacgttcatgagggcgaccgtttacgggtgcgtcccggcgaaaaagtaccggtcgatggtatagtcgaagagggcagcagttctctggatgagtccatgctgacgggcgaatcacttcccgtgagcaaacgcgccggtgacaaggtgattggcgcgacaatgaacacctctggcgctctggtcattcgcgcagagaaggtgggttctgccactgtgctgtcgcaaattgtgcagctcgttgcgcaggcacaacgttcacgtgcgccaatgcaacgcatggctgatctcgttgccggctattttgtggtggctgtagtggttattgccgtggccacgctgattatttggggtttgttcggccctcagccaagctgggtgtatggcttgatcaatgctgtctccgtgctgattatcgcttgtccatgcgcactgggactcgccacgccaatgtccgttatggtagcaaccggacggggcgcgacacaaggcgtgctgtttcgcgacgcagctgccattgagaacttccgcaagatcgataccttgattgtcgacaaaaccggcacgttaacagaaggtcggccgactttcgagcaggctgtacccgccagtcatacgacagccgatgaagtgttgcgactcgctgcgagcttggaccagggcagcgagcatccgcttgcacatgccattgtgaatgctgctcgcgagaaggatcttgcactcagtaccgctaatgattttgaatcaagtagcggcattggcgttcgaggtcaagtcgaaggaaaacaccttgtattgggcaatactgcgctgatgcagcaagaaaacgttgatgtcacagcaatggccggtacggcccagtccttgcgcgaaaagggggcaagcgtcatgtatttggcaacagacggtcaactggcaggcttactggccgtctcagatccgattaaacagagcacaccggaggctgtgcaagacctcaaagatgccggaattcgtatcatcatggcaacaggagacggcgtggctacggccaaaaccgttgcgcagcaattagggattgatgaggtgcatggcgaggtcaaaccagctgacaagcttgacctggtgacaaaacttcagtctgaaggtcgggttgttgctatggctggcgatggtattaacgatgctccggcactagcaaaagccaacgtgggcattgcgatgggcactgggacggatgtagccatgaacagtgcgcaggtaacactggtcaaaggagatttgcgcggcatctcgattgcacgtcacctatccgagcaaacagttgccaatatgaagcagaacctaggcttcgcgtttatctacaatgctctgggcgtgccgttggcagctggagtgctgtacccgtttgtcggccttttactctcccccatgtttgccgcattggcgatgagcttgagctctgcttcagtagtctttaacgcgcttcgtctccgtaattcagattagaagctgccgtaaaaagccaaacggggcttggtgacagtttaaaagtacgccgtaacctttaccgcgcctgcctttcttgttgaagctaaacgggttgttgctctctaattcgagcatgtttacgtacagttttaagatcactcttcatcttctcggcaatgattttatgctgaaattcagattttttcagcagagcttttgctccattaaaatctgacggtccatggatccataatccctataattatgttcccgatagtttggccgattttactcctggcgcacctatgaacgaggattaccgctccaataatcgaccttacctgtttagtcccacggtgtgctggaatgggccaaagataaaacgatctggctcatttttccagattttgcagatgtaatcatcgtctgtgatcgggtggaactgtatctaagctggatcgagcagatgcgtcccgcgctgttcgaggattatgagacacccgaggcagagtacgccaccgttgcaacctctgcgacactgggggcttgagatgagcggaatcgctgggttcgttgggcgagagaccccggcggccttgcgcattagggtagtcgaggacatggtgagaaccgatgccatgcaacggcgcgggccagacagccaaggcacggtggtcgcggatgaacgggtcatactgggcaatactcgtctgcgcgtgaccgatatgcgcaattctgaggcagacatgccaatgcagagtgccgacggcatgctgaccctgacgttcaacggcgaaatctacaatcatctcgatctgcggcgcttgtgtccggactatcacttccgtaccaaatcggataccgagagcctgctcgccatctaccaacgtcatggcctggacatgctaagcatgctcgagggcatgtttgccttctgtctgcacgatcggtcggccagacgaacgctgctggctgtggatccaacgggacaaaagccactgtactacacgcttggggccggggacgaactgtattttgcctcggatattgagaccattttgcgtgttcctcatctcaacttcagctgggaccgagaaggtttggcccaggccgcgggcatcatgttcgtatttggcccccatactcatatccgcgagatcaagaagcttgaggctggatgttgcctggtcgtcgaacagggtgaacgcccgcgtcatcggcgctatcacaagatcgtcatcggtgatgaattgcaacaggatgtcaccgcaatcaccgaacgtgttcgggacgcagtggctgcaggctgcacacgctgtttcgatctggaggttccgtatgcctatttattaagcggcggcattgattcatccagcgtggtagcccgagctaggagccaaggcttggaactgcacacctatgctatcggttttcccgaatctgggttaaggacaggtgccatcatgcataacgagttcagctactctcggctagtggccgaggccttcgacacggagcaccgagaaatcgaggtgacgagccagatctattgcgaggccatggatcgctggtggtcgctgtgctgcgaaccgaacggtgcgcccgaagcggtctgtctgttcctgctgctcgagcaaatcgccggcgacggtcatcgcgtggcgttttgtggcagcgggccggacgaggtattcgatggttacagtcatgggcacaggctgaaaaccaccccctcgaggctggtggcgggtgcctatttcgattatttcaatgcggtggggggcatcgacctcgggcaactgatgctcgaggtcgatgtccgcgccgccttcatctccgccgtgcagccctatctcgatctgtacgcgcatgatacgcaggacagccaacagctcacctgcctgctcgattatcacggcgagtgcgtggtctccgaatatcgtcagatagacatggccagcatggcgcacagcattgaagtcagaatcccactagccgaccagcaggtcattcaaagtgcgttttcctttctaccgaggctcaagcactatgaggattcggaaaaatggatcttcaagcaggcgatgtcgccctggctccctagcacaatctcgagccgaaagaagatcggctttccagtgccgcagatggtatatgcatcgcccgagtttgagacgcggatggaaagttcgctagagccggatagcggccttgataagcttgggctgtttgacatggcctatctccgacgagcttggcgcgagcgggggagccgcggctatgacatcttctaccgcttgcacggtatggatgtcatcgctcgccgccattcgtcttacctaagtcccaaagacccgccggcataacagtgataaataccgctcaattcagcataaatggaagcacccagaaaagctggctcgatctgatgtctacgttacccctatgcggattacggcaccgacggctggtcgaggctgagcctctggcgatccaactttaccagaggcggccgcctaggctggctattccgtgtccagcatagcggccaaggccacgcggcgcgaatggatcggcttagcagtgatcgccctgccatgtctgctgtactccatggatctgacgatcatgaccttggcactaccgaccatcagtgcagcgctgcacgccactaacgcacagatgctatggatggtggatatctatggcttcatggttgccggcttcctgatcaccatgggtactatcggcgaccgcatcgggcgacggcgactgttgctgattggtgcagcggcttttggcatcgtctcgatcctcgctgcactagtcaaaagtgccggcgccttgattcttcttcgcgccttgctcggagtggccggcgcaacgttggcgccggccactctctcactgattcgcaacatgtttcacaacaagaacgaacggacgacagctatcggcatctgggtggctagcttctcggccggagcagtgatcggccccttgctgggcgggatactgattacgcattttcattggagctcggtatttctcatctccgtacctgcaatgttgctgttgttggcactgggtccctggctgctgcctgaatatcgcgatccggccccgggccgtgtcgacctgtgtagcgtactgttatcactaggcgccatattagctgttgtgtacggtatgaaagagggggcaggacaaggcctgagttggtcgcctgttttgtcgctggtcgttggtgtggcgctggccggagtatttctgcatcgtcagacgcgactggcctatcccatggtggatctgcagctgttcagcagacctggcttttccgcagccatgctcagctacgcattcggcttctttgtgttgttcggactctcaatccttctgacccagtatctgcaactagtgcttgatctttcgccattcaaggccgcctgctggcttgcgccctggggaggcgccttcatgattggctccgccacggcgccgcgcatcgcacgctactggcatccccgccgcatcaccacctgtggcctgctgctgtcggcattgggatttgccctgttgacgcaagtgggtggttcgtctgacaaggaagtaattatcaccgggacagtgatgctggcgctggggctgacaccgctgttcaccttcagcgtcgagctgatcatcgcccaagcccctacggagcgggcgggagctgcggcagccttgtccgagacaggatccgaactcagtggtgcgctgggcatcgccctgttgggcagcctcgcgagcctgatctaccgcatggagttttctcctgagtcattatcgggcgtgccggaagacgctctcgcatacgcaaatgattccctgagcgcagcggtcgccatcgctgacaaattactggaacccgcaaggatcgagttgcttaccgtctcacggcacgcatttaccgccagcatgcaattcattgccgcaacgtcgatgctgatcgtgctggcggcggcgctgatttcctgccgcacatcttgagtcgcggcagacgagcttagcacaatcacattctgactgtcaccggcaatgtaaaaatgccccctaacggcaattaaaaattgaccccctgaattaagctggtcactttttctacgaggtggctgctattgttaacacaggagatggcaatgaccattagggtattaaagaagcagggaaagaggattaaagcaattgttcgggaaaccggtatatcacgcaatacggttaaaaaatatctcgatgaccaagagatgccgcgttacagcaaacgcagtagccgtgccagcaaactcgacccgtttaaagcctatattcagcagcgtatccaggccgcacatcctgactggattcctgcggcggtcatgtatcaggagaactggcatagggttatcagggcaagatacggatgttgagcagttatatggcttgtttgaaaccacgagcaaagccagatccggtggtacgttttgaaaccgcacctggccagcaaatgcaggtggacttcaccacgatccatcgcgggcgagaaacactcaaagccttttgaatcgtcccgggtttcgtggaggctgtttggttaaagccaagccaccggaatggcttccttggcgaattgcctatagtagtttacctcagcttctgcgggagggatgtaaccgattgtttccagcagccactggttgttgaaccaggctacccattccagcgttgccagctccacggcctccctggttttccagggggcgcgcttgtgaatcaattctgttttgtacagcccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggcatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacatccacaactggttcggacgatctgccttgaattgccggttaacccgatccagtggacacggcagcgccttgtccggaactgtggtgcgcacaatcttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccactgtatttgcggcagcagttcatcatcacgcaggacgcgggcattgcgcaaagccggattacgctgctgcgcggaatatcgccgataccctgatgggacgacctgtaaaaccttgcagatcggctcgaccccatgggcgtcgcggtgctggtcgatgaacgatctcaggatttgagtttgcggtcgagctccgcctgagcgaaaaaagcgctggccagcttcagaatctcattcgccttgcgcaattcctttacttcgcgttccagggctttgatgcggtcgcgctcttcgctggtcacaccgtctcgcaagccggtatcagtctcgtgtttgcgcacccattcaagcaatgtgggggctgaacagccgatcttcggcgcaatggattcaatcgtcgaccacagcgagggatactcactgcggtgttcctgcaccagacggactgcgcgcactcttacttcgggggaatatttatttgatttgttcatggctccatcttctcagatagtggagcctcctcaaaacccggggcggttcagtattagcccgactaaaactctggctaaacttgccaaccatattaccgaggatgcagacagaaaaacccggtttgtatagcatttacttgatcctcctgctcttgcatttcttgcgccagataacgacacccgtcatggttagcattgcggtcaatattcccgtgatgcatatcagtacacgtccatatatacctaatatctgtccactatgtatcgggaattgccaagcaagaaaacgatccgccctggtaccactatcataccctcggcgccctgtcaatgtaccggcgttaccgtcaatgaacacctgctccgttttgatcgcaaacacttcgcttcccctccccttctgatcaaaagccacgcgatatacattcagggcaggcatatacctcacaaacgacaattccagattatcatttccagccggcaaccactgatgcgccaccaataccgcatctgaaaaacccaatactggatcaacacctgattgcaacgtcccgggcagcgttttacgtggatcaggtgtcaaatccccgaacaatcctacaattggcctaaatacctccgcattcaggttgaaatacgtgccgctcattgccatcatgaagagcacaggccacaaccacaggccacttgctcggtgcagatcaaaattgaatctgacctgaccagcctgtctcttgatgctccatgatggtttccagcgcgacaaccagtttctgcaagaattgttcttttcctttgatctcaatggcggagggagtgtcagataaaaaccaacgagacaatccagcatccagataagggcaataccacctagcaaccaaacaccccagtgccccggcaggtaaagattagtatgcaacctatacaccatgggaataacatgtgctcgatccatgacaaacgcgccgcgcaccctcgcccccagtgcctcaccactaaacggattcaaaaatagctcccgcatcgtaccctgttccgttttcaggtcaaccctgatactttctccatggtcgcgcttgatccgaatcgtaataagctcagcatcaggatcaaattgttgtgcatgtccggctagtgcatccagcgacaatacaggcgcactctgttcggacacatgaaacaattccggatttaaccaggcatccagttcgcgctcaaaggcaatcacactgccggtcaatcccaatacaatcagaaaaacggcaatgaccagcccgacataacgatgcaaccttacccagaatgatctggatcgcacacctgaacgaacagtagatgtcatggcaatcagaaatccaccgttgccgacaacatcaacgtgcgcctatctcccaatgtcaaaccactggctgctgcagatgaccagtattgtttatcgaatgcattcagaatattggcacggatcgtcacaggagttgcaatatgccttatcgcatatctcgcgcccagatcaaaccgcacccatgagggaattttctgggtattcgcagcatccagatattgcgcactcgtgtagatggagcgcgctgtcagtgtcaacccgggaataactctgatatcccattcaccacccagattagcagctaccttgggtacgcctggcgcagtgtttccatcattgagaccccctgctgtcttggtcaattctccatcaagatacattacccctccctggatacggacaccggaaaatggctcaccaaacacattcatttccaccccttgattctgttgcttaccatccacagcaaaaatgagggttgcgggattggtgaatccgctgggctgcctgattttgaacaggctgaccgtcgtcatcagcttgccgaaatccatcttgatacctgcttccacctgcttggttctggacggtggaaaaatatcattgatattgacagccccggcggcgggcgttggcccttgggtaagtgcttcgatatagttgccatacagcgagactttcttccacggtttgaccagcagccccaccgcaggtgttacagcatctttattataatgttttgtcctggcaccggtgactggactatagccattcacctccacctgctgtatgcgggctcccaaagtcaactgtatctgttcatccagtatggatagggtatcggtcagcgcaatactcgacagatgcgttttattcacaattggtaaatgatgagacaagccgcccgtaactggctcaggatgttcaactggattaaaaatattggattggatactgtcaaaactctgccgcgcattcccatattccaatcggaaatcactcatacccaaattgatcgcatgcatgatagcaccagtttcaaacatggcatgcaggccagcttctgccgacagcgcattttccttatacaaatactggaagggtcgcgtcatgaaatccccaccggcattctttacactcactgtagcccgcataaaatcgtagtctccccgcctcgcaccaatggctgcataggcattgaaaaccggagagatatcgtattccactctaaatacgccataaatatcttgaacattcgcatcagtccacgatggcgtcataccagaatcaacacgtctagctgacggaggcttcactccactaaccaccccgacccgctccaatggggcctctacacggcgatcctgataggcaacatctgcgaacaaacgtaacgcttctccacggaaatccagtgccagagtatggatgttacgccgtatggattgatgtctgaatggggtatcaccattctgataaacactgttaagccggatacctagacgattgtccttgccaaaacgccgcccaatatccacatgaccgccaaattgactatcggagagataagaaccggtaagctggattactggcctgtcaactgctcgcttaggcacgacattgattgttccgccaaccccaccgcttggcgccataccatttagtaaagcattcggtcctttaatgatttccacacgctctgtcgcttccaccggtatggaataagtcggcacaatgccatacaatccaccaaatgccacctcactattgagcaccgtaaagccacggatactgaattgctcaaagcgcccggaagacggattgacggatctgacagaagcatcattcaacatcacatccgccactgtgcgtgcttgctgatctttgatcgtttgtgccgtataactcgttatgctgaagggggtttccatcaaatctttgttacccagtaatcctacgcgcgcccctcgtgcctgctgtcctcccgtatacatactaggcaattcatctggtcccctcctggtacttccctgcacctcgatcacgggcaactccgtcactgctcctgccttttcactctcatcctctatagccaatccctccatcggcatagtacctagcaaggcaccgaccatgacgctgactccatacattttattgttcgacatattataatttttgatagtgttgaaaaataatgaaataaatggggggtacgccagcctaagctggcaaatagatatgctggggatgagcatggcgcagaaaatcatggtgggatatatgccaggcatatgcccctgcatgcgaaaatagaacaatatctcccactcgaatttcacccaccatttcatcgaaagccaataaatccttaggggtacacaattgccccacaatattgaccttcccacgcctcaaaccaggtctggaatatggtttcttccaggccgagataggaataactttgaatggatgactatgattttgggcataaggtgtacgaaaatgatgcgtacctcctttcactacgacatatgtcccattccctgatgttttgatgtcgatcacctctgccacatatacgccgcagaaagcagaaacataccgacccatctcaaaccgaatttttggaatgtttttagcggctccaattggcagattgttcaagccatgcgaaaaatgacaccagtcaaactgctgatcgatgtctttgtaattaacaccaatcccacctcctacattaatgtggtctataacaagattgaattcctctttccatttcactgcctgttcgatataggcagatagcaggcacaaatgttgggcagcatctaattgatgtgaaagcaagtgaaaatggaacccctggaaatacagacaatcactgttatccttcaccattctcaggcaatctgacaaatgctccacactgatgccaaattgagtcggtttcccccccatcatgagagaagttgctcgtaaatcttcaaaatgaggattcacccgcaacaagatttccgctggctgttgatagtgtcttgcaatgtgcaacaatctttctaattcaaaccgactctcgatatgcacagtcacattgttcaagatggccaattcgagttctgtatctagcttcccaggcccgctgaatatcaaaggcacatctggaaaattctgccgcacccattgaatctcccccccagaagaggcttcaaaaccatctacatgttctgccaacgcagataatataggcaggtcagaattagccttgatcgcataaaagaaattcactctgtccggtaagctactcttgatatttctcgcatgagatgcaagtgccccaagatcatacaaataggcgcataacgatttatccggatgagccaaatcatggatgaccgatatgaatttttcagcatcaaacatcatgacaacctccccatcgggttaatcagaggcatatatccggccaatttgtcagcctgcatcctgaatcggttgctcagattcgccttgctcgggaatgcatggccattgatcaacccatcaattctcccttctgaaagcgctgttccgtaacgggattgataatgcttcaaatgatgctttacctcttgccacagtaagcgttccagatgcacatcacccagactgatctgatggattgcctcacaaaaattattgacgaataggcaataacaaatccgattccagccttgttcagaggaataccaaagactttcgtgggttcgcgcactgactccggaaagcttatcctccgggtatgattccagaatcagcttgacaccttcaaaatccctcagatagacatgagtgggtctgttatcagaaagtccgatcactacattctgcaaatgcggctcaaaaactatgccatgcgcaaaatagcattcgaggatcggatacatgactttctgtacataagcagaaaaccaccggatacgagtactttccgaattctgcccctcagcctcgctcagggcggaaatgatgtcgcgtaaataagcgcatccaagtgtatgattcccaaacagcgcacctgccaataagggcgtaactccgttatccagatgtcgcttatcgaagttcttacgcaatatcactccgaacccctctgtaacctccctactcgtattctcatctggctctttcaagtcgacagacaagaatgcgggttctgccaaaatagacacgcctgggaatttttcagaaatggactccatgacccctgccatgattttattgatctgtaacgcactctccagctcataaactgcattcttgcgaatgcagttggtcaatctgacgtgtaatgagaatttgtagaaataggggttttccggttgatacagagtacgtattgatgatgtaggataaaaatgttttccggctgagccaatatttttcaacttcccttgactgatcgccgaccggacaagaggattgtccaataaccatttggcttgccatgggtgacaaggaaccagaatataaggaagatttggcctgatttcggaaggtgccatttgagcaatgatttccgcacaatcagattctatggtcgttttctgataaacaaaattttcatggacagcaaaataatgcaaaggaaatccctgaccgaactcgggagaatatttcctgagatcattttggctgaagccttgtctgctttttggtgcaggatggaaaggatgaccgtagatcaaggattgctcagaacagagatatgcttccagaggattctctggcaatgtatctcttcgatcatcttcaagaatctcggcagtaacactgacgctatcttcaatctgatccagcaattcttcattaaaactttcattatgcttgatcgccagatcatgaataatcaggtgcgccagacctttccaatcttggtgcatccatgattcccccgttttcttggaatatatcgaagaaagatatataaaattagccgtatcagaatatctttcgaccgccacaatgattcgagcctttattctcgacatggatatttccagcacctgcttacccgccagagccagcctgattgaaaccggccaactgccaatatctctaagattacatattcgggttgccttctctggcattccaacttccctgcaataacaattcaatagcgtttctgcacaacgctgccctgcgattacataagaagcggatacttgcggtaatttatatgcaggcactgccataaagcctccttaaaatgattgttgagtctcagatcgtgaacagattgagaagaaaaatactaaggcacagatcatcaaagcgctcgataccagaaatggtgctttgatacctgcaatacctaccagaaaatcacctgtaatcgcccctgctgccatggcgcaccggccagtcaactcgaaacgaaagaatgttttggtagcacctaggatttgcgtcacactgaccagatatagattgattcctgtaaaagagataaaagtgcccatcccgatgccagcttggcaaataatcaccatcatccattgctggcattgccattgccctatcagtccgagcatcaccagcatgaatccagtgcataacagagtcacatttcttagtttcctgataggctgcaataaaggaacgctgcataaatacgcaatactaggtattgagaacacagtccccaaaagcgaatctggtatgaccttcacttctgtctgcaaatacgtaatgaaatggggtgcataaagtgatgctgaaaataaaatcagcacctgcgcaatatatggcttccatagctgatatccatttccacttcgcatcagatcctttcctgttgctttcttttgagaattttctgattcgctcggtagtgataatgtcagcagaaaagcagtaatcagcagcaaaagggccaagagcagataaacctgtaatggcctgctgaaataaagaatgacacctcccagtagtgaaggcccaagcactgcagcaaccctggtaattagctgcaacgctctgattcccgtcacaagctcatcttgattgagtcgacacgccaaatagctgctggaagtagcaaatgtcggtgccacgaaaccttgcagaatcagtccgcacaaaaacatggcaggactatcagccactgacattcctgacatgatgactgccaatgcgatatgactcgcaataagggctttcctttccccgattcttgtagtcagcaccatacgcaacgggtaaccaaggaatgctgcaagcactggcgctgcatagcatatccccagatatgacaggccatccgggaaactgcctgtcagaatcgtggataagaatggcggaatgctgaatgcagcaaacatggccgagaaatggcctgcggtcaccagttttaggaaatacccgttacgtcgcatagcattccttgctttcatgacaaatcaattgtcaggctggaatcagaagctacgtttcaggggattcatcacatgctgataagcattttcgctagtatcagcaaatattttctttctggaaaactggctcaatctgatttgagtctgaaataaatccagcgcgttgtatcgcttatccaactcagggaatttgtcctggtaatcttcaatgacacgagaggccattttccagaactcggattcatcaagcccttgatgcatatgcaggaaacgggcaatttcagccagatggacaaaaaatatcgcatcatgcagataccaaactaactcctgcggagtggcatccagtacggatctttcaccgggagtcaaccgatatttcggagcatccagcaacatggggcaggatgctggcttctgaagataatcacgcgcaaatctgattcctcccggcagatccctaactgccaccctgacaggcaatccatcccggaagaacagaatagtattttgcgcatgcgcctcaaacccgataccgtgtgcatacagcaaatgtatgaatggcttgagcaaaacatcgagcaacttttctgtccatgcctgcaatccatatgcagcaatccagtcatccgatacggacttgttctgagaatctagaaaacacagtgccgtagcaggtatggcaaattcttccggctggagatacgtatggatgctttcccgccatatcgtaccgattaacccgaattttcttctttctactatttcaggcagatgagatttgtcatcataaataccagccacctctttgataaaattgaacctcaattcatccttcagatagagatcgctttgcagtatggaagcaagccattgggaaattattgcgctattggcaacgttatgcggggaaagcagacgatcagcagatgtattaatgattgataatgcaatcttgactgtatgggcactcttcctggtctgattggagagagatcttagggattgttgtggactgtacttatctgtatgacttcccaggaatattacatctccattggcaatatcatctacatattcaaatacaatcttttccttccattgccacggatgtactggtagataaatataatcttctactcgcttgccagcattgatgatgattcgggcaaattcatccagatatgtttgctgcaattcatctgcaatcaacttgtcaatgttcaatccatcaagtgtatagatttttgctcgatctctacggatcgccaaccatgtcaaattaatcagactaccaaaatcattggtgtattcctgattctcctccagattgaatcccattctggatttgtagcaagggtgatatagatgcccattgaataccgccgtttcataagcatcaaaaacagaatctgatgtattcaaatccgcaatcttcagatttgaattaaatcttaatgcttccgcattttttgcaactgtattgttcaattcagagataaaaaaactgtatttattctcttccccatcaatttctggtgcgatctctccaaggaataaggcaatcgatagcgcctcacccctcgattgttctgatattctgatgactggatcttgtaacctgattctgccgtaactgacagtcctcactcccttggttaaataactgacagattttccattggcatctatcgctttaatggcgtactcggaacaacctatcgaaagcaacctctccgaatattcaagaatgttctcgaacagcatggattcaagaagctgtcgcaaagtccggcgatgcgcagcaagataattggggtttggtgcctgaagcagaatttcccgatcatccatccttagttaactccttttttatttttataatttatatgataataatcatataaatgataactatttctattatcatattcaagtattaactattaccaacacgacaagctgacagcaaaaactactaccacttaccttgttccctagggcctgctcccatttcacattggtaaccacagaaaggcacaagccatagccacgaggctttcttagtttttttgagtttaccaaagcgcgaggccaccgcccggaactgtctcaaccgtgcgaaaacattttttaccaggtatcggaatcagtacagccctcggtccagatctgcattacttgttttggagttccgcttccctggaatgactgccttggcaccttgttgttcgatttgatcacgtatggcctgactgtcatagcctttgtctgcaatgatggattgagccgcgcccgcactggtgagccttgatatagctagcattgatgaaaatccactccatgtccagctcaaccaccagagcctgaaataccttaagccattttccgctggcagatcaggcggtgaatcgtttataaaccttgctccagcttccgaatgccttggataaatctctccaggaacaaccggtacgcatgcgattacagtatgccttcgacagttatatgcaaatcttgcttgctgtagaggttattgtgaagcaaaatgggcagcagcttcgaccatagctcagcattgagcagtaatcggggcattacaagctcgtattgctggtgagagctacaacgatacgagcttgctcctttaaatcaatagcttgagatcaaacaggaacagaccctagctgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacacctagcaatactcaacaagaccattgtgaaaatgacagtatctaaaccatcttaatttacgttaaaggctgcaggtacggcgttggcgtcactgcaattatcggccctacaccatcggatttcgctcaatcgcaaggctgctctttatctctgagcatctttcgactgaagcgccaaaacacggccaagttctttgatttttttagctgcctgaaccagaatgtagtcatttctcgatcgattattgccatgtttaacaacctaaccagctttcagtacattcagagctcgtgtaaaccgtgtaatagatggtttattcttctacactctcgctttgctgttatcactggctgggtttactgcctgattttttcagggcgcaagggataattaacttgcattttcctgaactcataccgctcgacaattatgctcgaccagctggaccggttgttaaccggctggatgattggtaccagtcgcttctaaaaaaactaatagaccgagattcagaagtaaccgttacagaagatcagctttcaaaagatagtatcgagaacattcaagtgtttactactgagcctgaatgtgacttcattttccaggtcctggacaaggcttacctggaatggatgaacagtacttccgctaacgaccgcttgcgattgctggtgttcccaccatgtgatcattccaaccgagtaacaagctgggctgaaggtaatcgcctggacgtgcttgctgccccagatcgttctgaattgctatccggagatttggtaaaagttacgatacctgcgggctctggtccgctggtcatcccaaagcttgaagactggtttattcgtcaccatcgcggcttaagatatattcgcgccctgttggctgctttgcaggatacttcacggcgctgcctcgtatcttgtaacagttggtgctggatatatttgaaaaaagccgttaacgccgatttggtattgcctgtgccagattcgctggcgcccatgaatgctgagattcttggcaagtggctgctcgaattgatgtccgaagagctccagcaacctgctactttctgtgatcataacaatggcaaagaaatactacgctgtgaagaagatggcataatttccgataaattcatgcaacagcttgctaatgatagtgggggcataccctggatagcctggcaactttggtgtcgaagcttgcggacagaagcagaacgtgatgatcaatcagataatgccgaggaaccgaaaaagcagcaggcctccggcgacaaaggaatagttttctgggtaatcaaaaaccagccaccacggttgcctcgtgggtatgaacgcgcggcctgtttgttattgcaagccttgctgattcatggctcgttgcccgaacagatgctctcagcggtattgccccccgccacaggagaatccagcctgattgtcgccctgattcgctctggcttcgttgaacgtcatggcgatgaaatacgctgtctggcaacagcatacccggttatctggacatcgctggccaactctggcatgacgatggcgcgcttctgaccaatttcaagaattcagcgagctaaatatgcctgattcaagcatgaaaaatgttaaagcatcccagttaatcaatgatattggtgatatcagctttacccaaattctggtcatcgttgtttctgtgtggttgttgacttttctctcccacaagctactttctatcctggcaaaacacgggcccagtaggttaaggctgtactttcttgccgccataccctttattcgcttgtgcttgctcgctgccgcagtgtcgatgataattcctatcatcttcaatatcacattgcagaatttcctggttattgcaggtgccatcagtgttgcaataggttttgcgtttaaagacctggccagcagtttgattgcgggtgtggttgccatatcagagcgtacctatcgtcccggtgactgggtgaagattgaggatgattacggcgaggttcaacaggttggtttacgagccatcacgctgcgcacacctgaggataacatcgttaccatcgcgcacgatagaatctggaataataacatcagcaactccaacgatgggcaacaaaccttgatgtgtgtagctgatttttatcttgatgccgaccataatgcagccgccatacgtactgtgctacacgatattgcattgaccagtgccttcctggactatacgaaacctgtattggtcatacttgcggaggtaccgtggggctcgcactacaagctcaaagcctaccccttcgatatgcgtgaccagttcgagttcatcagtgatatgactgtgcgtggcaagcttggcattcgagaagcaggtgccagggaagtccaggcacctgtaatgattcaggcacctgaacagaggtagttcggaaaatctggccatactactgccgctcgataattggttttaaactatttataaggcgatctgctaaattaaacacgacactcaaatttggcaatgtatctttactttctagtgtattttggatgtcaaaatactcaaaacctttacggttataccaattatttgctttctcaatttctgcctgctcttcatcggtaataccttcaactgcgcctattccaagctctattgatttttttagaattttttgaagatcgtgaccaaatttacatttaacttttttaattgacacacttttaaatagcaaatacgactttaacgacaactctaccgagcgacaaatcaagtagtattttacaggtaaaaacggcttgtctattttaaaactcttataagcattcagaaagtcttcagcatatacgataaaccctatcggccccattgtaatacgcgctggctttgctgaaattatgatattcgccatcgttttccttgatccctgacgccggttattactagtgtttagcttaaatccactttcttcaatatttttcaccgcaaagtacacactttccggatgaatcatgattactatatgccacatagatccatcagacgagctttgttgacgttcattgccaaccaggagaaattatgaggctttttcggttctgatcagattttgtatggataataaatatatagcttctttcggccctgtcggcatttttgattctggaataggagggttgtcagttgcccgaaaaattagagagttactgccaagtgaagacatggtatacgttgcagattcgctgcatgctccctacggagagaaatcagacaattacatattccaacgaatgggcgcagtcacagaatttctactggctcgcaaagccaaggctgttgtcgtagcatgtaatacggcaacgacagcagctatttccaggctcagagcctgttacccaattccaattgtcggcgtcgagccggggatcaagcctgcctcactttccacacacactggggtaattggcgtattggcaactcccagaacacttcaaacaaattcattcacagcgctggcagaacgttttgcaagaaacgtgagaatcgaaattcagccttgtcctgatctggtaaccaaaatagaggcactcaattttaacagcgatcagaccattgccttactgaagcagtatatctctccactgcttgataaaggagccgacaccatcgtgctcgggtgtacacattacaatcatttgtctgaattgatctccgaggtagccggggaaaatatttcaatcatcaaaactgatgcagctgtagcgaaagaagtcgctcgcaggctttcttctgggggattgcttgccggcggagatcatgcaggaagcgaggaattttggaccagcggacctcttgccgcttaccatcaacagattgagctgctgtggggaaaaagcggtaaatgttatcgctggctttgatgttagcgcatcgtttcggatctcgtagataatcccatacctatctagaaataaggtgcaagtgaatctatactgacccggtgcctgtaaacagggagcatatatgatgatcagacgaacacttatcccactggatggttccgaactggcagaacaggttatccatcatctgctgcgtttcattacgccggatcagaccgagctgctgctgatgacagcattgtcatccacttcccgctctctggatgaagttgaagatacgcccggcttgccagcatcaaagcagactgttgtatcgaaagaggacaaggcacgcaaacagttatacgacattacacaaaaactcaatcagattggcttcagcgtaatggatcgacttttgtcgggaatgccggccgagagcatactacgcttggcagaggaaacctttgtcgatctgattgccatgtcaacacatggaagaaccggactgggacgggcattattgggtagcgtggcggacgaagtcgtgtgcagcgcacgcccacccgtgtttttggcacctgctgcaatagcggtaaaatccagctctgtacctcgtactattctcctaccccttgatggcacgcctctggcagaagcagccattcccatcgcccgtcaatttgcacagaatacgggagcaaccatctctctgatccgtgttgtcaggccaaatcatcccggatacgaacaaccagatgagcaggtatctgccggagaacaatctgtcgctcatcaggcgatcagttatctggagcgaatacagctgcagttacaactggcgaatgtattttctcgttaccaggttgcatcgggtgatccgattgaagccattatccgtaccatgcacatggaagactccgatctggttgtgatgagtacacacgggcgttcaggtgttgaacgcataatccatggcagtgttacacgccaaattattggaaatacaacctgtccgctgctattggtacgtggcgtagtacccgttgaggtttatgagtcggacgatgacaaagtatcagcagcctccttttgctgatcaagctgtgccaacaacaccagggctctgcctgatcagaaaagcgcacgaatcgcttcttcgattcgctctacagtaacaatttcaatccctttgataacttgtttagactgatttgccttgggaataacagcctgagtaaatcccagtttggctgcttctttaattcgctcctgcccgcgttgtaccggtcgtacttcccccgctagaccaacttctccaaacacaacagttttctccggcaagatccggtttttcagggatgaaacaatcgccagcatcacggccagatcagcgcctggttcagtaattttgaccccacccaccgcattgataaaaatatcctgatcaaaacaaggaataccggcatggcgatgcagcaccgccagcaacattgccagacgattctgttccagcccgacgctcaatcgacgcggggttgatccatgcgcctcatccaccagagcctgaatctccaccagcaaagggcgcgttccctcctgtgtcaccatcacacaaatacccggcacacgtacaccatgatgcgaaagaaacaaggcagaaggattattcacctcccgcaatcccttctcggtcatggcaaagacacccagttcgttcactgccccaaaacgattcttgaaagctcgaattaaacgaaaagcggagtgtgtatctccttcaaaataaagcactgtatcaaccatatgctccagaacacgcggcccagccagcgccccctctttggtcacatgtcctaccagcacaacacaagtaccactggttttggcgaatcgcgtcaagcgagcggcacattcccgtacttgggcaaccgaacctggggccgattgcaacgactcggaataaatcgtctgaatcgaatcgatgattgcgacttgagggcgatgctcaactaacgttgactgaatggcttccaatcgaatttcggtcaacaaatcaactttggtggcatccagagtcagacgctttgcccgtagcgcgacctgttgcatggactcttcaccactgacgtatagcactcggtgatgcgcagacatccgggatagcgcctgcaacagtagtgtcgacttacctataccgggatcacctcctaataaaacaaccccaccctgtaccagacctccacctaatacccggtcaaactcggacagcccggtcagaaaacgaggcatatcctctgcctcgacctcactcagactcagcacatgtccttgcgcggaatccggaatgaaatgcggaagatttttctcccgcacagtttcagtcaatgaattccattcacgacaatgcggacactggccctgccatttcaatacctgaccaccacaggcactgcaaatataaagagtcttgagtttcgtcatgaataaactacgtgattgggatttcctgatgcagaacaatattccagctttacacccgactcggatatttcatcagggaacgcagcatatgtatgtaatatcaggtactcagcagcatccctattaaaaagccgaaaaactgataaaatagctgcctcaaaagatacagagttccggagaggtaccgaagtggccataacggcgctgactcgaaatcagatggtcaggatttcctggcacgtgggttcgaatcccaccctctccgccaccagttaccaacaatggatttgtccaccctcagcattcggtaatgctgacactgacagccaggccacccaatgaagtttccttgtatttgtgtgacatctccagacccgtctgcttcatcgcgttaatgcagttgtcgagtgatataaaatgctcgcccgtaccgcggcaagcaagtgcagcagcggtatgggccttgattgcgccaaaaccattacgttcaatacagggcacctgaactagcccgccaaccggatcgcaagtcatacccaaatggtgttccaatgcaatttcagccgcattctcgatttgctcagtggtccctccccgcaccgcggaaagaccagctgcagccattgctgctgccgaacccacttctccctgacagcctacttccgccccagaaatagagctacgatgcttgatcaacccaccaattgcggcagcagtcagtagaaaatcccgtacttgctgcagagtcccaccttcatgcttaagcagatagtaaataactgccggaataaccccggcagcgccattggtaggcgctgtcacaaccatgtgacccgcagcattctcttcattcaccgccatggcataggcgcataaccagtcattcagcgtacctttttccggatttgtttccagttgcttgaatagatcttttgcacgccggcgtatccccaggatacctgggaggcggccttctgccgttagtccctgttcaacacaatgacacatagcctgccagatactgtccagtccctgatcaagatcttgttccgacatcctggttaattcattggcgcgtttcatttccgcaatggataagccactttgccgcgacatctcaagcatactgtctgctgaatcaaacgggtatggataagtaccagcaaattcaattttaagcggagcatccagctggctaatttctgcaagcgtacagataaatccacccccgatggaaaagaatgtttctgacagaactttctttccctcctcatccagaagataaaaaatcattccgttaggatgttgcggtaacggatcagatttatcaaagacaatgtcattctccggattgaaatcaatgtgtctgccgctggcaagctgcacagtattggtcgcccagagctttgcagtcagcgcattgacatcctgcccggcgagggatgcagggctatagccatgcaatcccaaagttacagccctatctgttgcgtgccctcttccagtaaatgcgagtgagcccttgagtacgcaataaacacgatggttgcgattatccggagtttgtaaaatcagctggtcaatatcatcacgaaaaacatttgctgccgccattggccccatcgtgtgcgaactggaggggccaataccgattttaaacagatcaagaacgcttataaacataggataattttttgattggtattaagaagaaaattgccccgacagtttgttgtaattgccaagattgtattatagtggattgagcagatccgcttcacagacttcacagacttcacagacagatcgaattattttgcagaaatatcacagagataataattgacctgtataaacaggctatggtctaattctgtagttttagggcgacaaaggcggttaactcagcggtagagtgccaccttcacacggtggaagtcattggttcaattccaataccgcctaccatatttctttctgtatgttcgcctgcattaatccggtaagccggaaagaagatgcttgccaaagcttataattgacagcatagcaaaaggcctgtttgcttatttatataacggtgacagcttgagcagacttttcaagtctccacagatacactcactcttaaccaatcctactcctgactcatgctcaatccggcaaggttctccattttgcgatcgtttcttgcatgcctgattctcttccaatccgttctttgtcaagccgacctggtggaaacaatagagcgagtcaagccggcaattgtcggggtaggctctttccacaaattacgttcaccccctgttaattttcttggaacgggttttgtaatcgaagatgggctgcatgtcatcaccaatgttcatgtaatttctgatctgtctactgataagaacaaaaactcattaatcatcataactggcaaaggtgataagccagaactgagaaatgccactatagttgctctggacaaggaacatgatctggctctactgcgtttcgagggagctgctttacctgtaatgaaactagggaattccagcaaaataagagaagggaaattactggcattcactggcttcccgatcggaatggtgcttggtttctacccggtgacccatcgagctactatctcttcaattaccccggtcatgctccctgcacaaaatgccagacagcttgatgcagcaaaaattcgccagttgcaaagatcagcctacaaggtatttcagctagatggtacagcctaccccggtaacagtggcagtccactctacgacccagacacgggtgaagtttatggcgtggtaaatatggtctttgtgaaaggtaaaaaggaatctatactgagcgatccaagcggaatcagttatgccattcctggtaattacatcattgatttgcttaaaacaaggcagccaagtaacttctaattaatttatgctagtagaatagtttgtctttaacgacactcgctgttttttatctggccagtcgcttatacatcaatttagcaaggaggtattttgattcaagtagccaatcattatatttccagattctcgatactgcttgccagcattgaaactatcgcactgctcggagttttttttgcaggagcggccatccggtttctgcagtgggatggcacaatgtccgagctgctaatctcccaactacccggggcaattacctttactttcgttattatcgccagcatggccgcactgggcatgtaccagatggaaggtcgacaggatttcgagggtattctgctcaggttgctgccatcctttgcattgggcttcggttttatcaccctgattttttacctgtttccggatctttattttggccgcggtttactggctatcgtaatgctgttggccttgctgctaatactgttcatccggctgttttttttcagatggcaaggtctggataatttacgttatcgggcgctggtactgggtgttggtgctaattgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacagctaatgccggagaactgtttgacctggctggtaaaagtcctaatctatccaacttcaggatcgtgggattcgttccgctggataaagaaagccggcatgtaccggttgagatgattatcccgaggacaggctcgctgatctcgctgaccaatcagcataatattagcgaaatcattgtttcggtccaggaaagacgaggaggtacctaccctattcaggaattactggagtgcagaataaatggcataaaggtaacggatctggttggcttttatgaaagggagtgcggccatctgcaaatggactcactttatcccagctggctggtgttcggcagtggttttaaacaagggtcattgagaacactgatcaaacgcctattcgatatcactgccagcctgttgttgctgattgttacgttgccaatcatattactggctgctttgctgattctgattgaagatggtcgacctgtattctatcgtcaggaaagagtggggcatgccggaaaaccctatatggttttcaaattccgcagcatgttcaacgatgcggaaaaaggtgggaaaccgagatgggccacgactgatgatcctcgcgtaacgcgagtggggaaaattatccgtaagttgaggatcgacgaattaccacaaatcattaatgtactcaaaggtgaaatgagttttgtcgggccacggcctgaacgtcctcacttcgtcgatatactcagcgcacaaattccatactataacctgcggcatagcatcaaacctggcattaccggctgggcacaagttcgttatccttatggtgcctccgtagaagatgctattgaaaaacttcaatatgacctgtattacgtcaagaaccatagcctgtttcttgatttcatcatcctgatcaacaccgtaggcgtcgtactgctgagcaaaggcagtcggtgagcatcggtaatcacgatggcagctacattttttctccgtactgactgtcatgacaaccctaagttacgctgcggcagcgctcgcttttttctttttattcatgctgctgataaccagttggcgaggccgtctttatggtttgctgctggcaatcgcctgcatcatatcctcaatatgggcggcagcaatcgcgggattatcctattgggattattcagatcctctgctgcctcaaatactggaaatattacgaaatgctgccctgactacatttctgattaccttgctggggcctttccagtccggtaaaacaaataaaacttttcccagaatcaggccggttgttactgccatcgctctgttctacctggtttgtctcgtacaaacaatcactttcagtcacgctaccactaccagtgctgattcagatcaactcggctcctccttcgagtttcttacatgggtaacaatggccatcattggtatgattctggtggagcaatattaccggaacacaccccacgagcaacgctgggggattaaattcatttgcctgggtatcggggggttatttgtttatgatttttatttgtacagcgatgcattattattcagaaaaataagccctgatatctgggctgctcgggggtgggtcaatacacttatcgttcccctgattgcactttcggcagcacgcaaccctaaatggacagttggcattgccgtttccagacgcatcctgttttactccacagcactatttggtgccgcgatttacctgctgttaatggctgcggccggttattacctccgattctcgggcgggacctggggtgcagtatttcagctgactttcctgtttggtgcaattgttctactgatcactgtactattttccgggacgacacgttcctggctcaaagtgttcatcagcaagcattttttcagctataactatgattatcgtgaagaatggctgcgctttacgcgcaccctgtctgaagaagaaacggaattgaagattcgtgtgattaaatcactcgcgcagctggttgaaagcccagccggagcggtgtggttcaaatcagaacaaaatcatgcctatcaactgattgcacgctggaatattccatatattgatacatctgtcgaaattaacagtcatttttgccggtttatgcaggaaagttcctgggtaattgatttatatcagcatgattccgggcctcagcaatacgcagccatgatactacctgactggctgcccactattcccaaggcacgctgggtggtaccactgatattgcatggagagctgctgggatttgtggtgctgaccgaacccagaagtacggtcaaatttgattgggaagtcagggatttattgaaagtagcaggaagccaggcagcaagttatctagcgcagtacgaagcaactcaggcgctctctacggcacgacagtttgaatcattcaatcgcatgtctacgtttatcgtgcacgacatcaaaaatctgattgcccagctttcgttgttgctgaccaatgcggtaaagcataaggacaacccggaatttcagcaggatatgctggacactgtagcgttatctatcaacaaaatgaaacgtttacttgaaaaactcagcgacggaggcatgcatgaagaaaaaaactccttgttatctctagatgaattactgcaacaaatcattgaaagcaaatccttctgtgaaccgaggccagtacttaatatcatcgatccaaatctaaatatacaagccgatccatcacgcctggagcgtgtgcttggtcatctggtacaaaatgcaatcgaggccactcccaaagacggatatgttgaggtacaactcgggcgacaatccggatgggcagtaatcaagattaaagacagtggacatggcatgaacgaacaatttatccgcgacaaattatttactcctttcgagtcgaccaaaacagccggcatgggcattggtgtgttcgagagtagggaatatgtcgaacaaattggtggaaaattgcatgtatccagtgaagtatcaaaaggaactgttttctcggtcatgctaccgatagcaaaatccatgcaatctcccgctacaccgttataaaaatatcttgaaaagagcgctgtcacgaacagccagcgcacctgttattccttcgttacatggttcttctctgaaacacaattatgctccgttattttgaacgcctgatcaccccctttccatccgaccagcttaccgaaccacccgccacactctatcggttctgccgtcactacatgcaaggctcaggaatctacttcctgctgctggcaatcgccacattttttgtggccgttggcgaagccatgctgtttggtgtactgggaacgattgtggactggttggccgagaatgacccacaggcatttttacaacaggaaaggctggctctgctgggactttcgcttttcatcctgatactgatgccgattattgttttctttcactcggtgattttgtaccagtctctgatgggaaattttcccatggtcgttcgctggctgtcccatcgctatctgcttgatcaaagttacgctttcttccaaaatgaattcagcggacgtatcgcaaccaaggtcatgcaaacagctttggctgtgcgcgagacaatcatcaaaaccctggatgttttgctgtttgttactgtctatcttgcaacggcattactgctgattgcacatgcggatattcgcctctgcataccgctgattatctggctggcagtgtatttatgcatcctgcgtcacttcatccccaaactaaaaagcatctcaaaagttcaggcagatgcccgctcaaacatgaccggacgcattgtggacagctatgccaatatcctcacgctcaagctcttttctcacaccctgcgggaatctgactacgctcgggatggcatgcaggaatttctggatactgtgcatccacaaatgcgcctggtgacctggttgaatacctgcgtatggatcaataacatgctgtccgtctttgcaatcggcgcattgggaatcgcgctgtggctcgacggcagcatcagcactggcgcgatagccattgcactgagtcttgccatccgtctgaccgggatgtctcactggatcatgctggaagttggagaattatttgagaacatcggcatcgtgcaagatggaataaatatgctagctaaaccacatgcagtgacggatgctcccggtgccgtgccactatccgttactcacggtgcgatcgactataaccaggttgaattttcctaccacaacaacatcaagaatgaagatcaccgaatttttgaggcacttgatcttcatatcagtcccggcgaaaaagtcggtcttgtcggtccttccggggccggaaaatcgaccctgatcagcctgctgctgcgtttttatgatatccagcagggcagtattcagatcgatcggcaggatatcaagaccgtgacacaggaaagcctgcgcgccagcatcgccattgttacgcaagacacttcgttgctacaccgctctattcgtgaaaatattctgtttggcagacccgatgcaaccgaagaagaaatacgactggccgcacagcaagcgcatgcacacggatttatccaagatctggtcgatattcacggccgcagagggtatgacgccatggtgggtgagcgtggggtcaatctgtcaggtgggcaacgtcagcgtatcgctattgcccgagtgctgctcaaagatgcgccgattctgattctggatgaggcaacttctgcgctggattccgatatagaagccgacattcagcaaagcctgcaggagttgatgcaaaataaaaccgtgattgccattgctcatcgcctctccaccattgccgcaatggaccggctgatcgtactggataacggacgcatcgtcgaacaaggtcgccacaccgagctgctggcactcaatgggctttatgcccggctctggaatcaccaatctggcggttttctaggccactctaaacaggatgaagtactctagctggttatattgtaacggcccttcagagtgaaacttactgctgcgtcactggaggaggatcaaatcggcgatacagcacgggtaataccaccagagtcagtaacgtggaagtaatcaacccgccgatcaccacaatggccagcggccgctgcacctctgaacctgggccggttgcaaacaggaacggaaccagcccaagcatcgctacggtagctgtcatcagcaccggacgaaaacgctgctcacatcctctgatgacagcatccttgacactaacgccctcatcgcgcaacttccggatataggaaatcagcaccaccccgttcagcaccgctattccccacaacgcgataaaaccaactgaagctggcaccgacaaatactcaccggtaacaaacagaccgaatacgccacctatcgacgcaaatggcagtaccagaataatcaaggctgctagtttgatagaattgaacagcatgaacaacaaaaagaaaatagcagcaatcgttacaggaacgataatcgaaagtgtattcatcgcacgctccatattctcaaactgcccgccccactcgaaaaaatagccgtccggcagttttacttccttggcaatccgctcctgtacctctgccacaaaaccgcctaagtcacggccttcaacgtttgaaccgactactacgcggcgcttggcattttcacgtgaaacttgcgccggaccatcaacaacactgatattggcaacggtatacaaaggtacggttactccatccggtgcgcgtagcaacagattacggatactttcaatactgtcccggaaatgttgtggaaaacgcaccacaatagcaaaacgtcgctcaccctcgtacagcgtacttacttcacggccacctacagcagtctcgatcagttcatgcacatcagcgacattgatgccgttacgcgcaatggcgttacgatcaatatcaatagtcagcgattgctggccagaaaggcgttcaatccggatatcctgtgctccggggacagtgcgcaagatgcgggcgatctgttctgacagcccgcgtaatttatccaggttatccccaaaaattttcacggcaatttcagagcgtacaccagtcaccatttcatccactctttccgcaatcggttgcgacagaacaatattgacaccaggcagcacttccagcaatttgcgaatatcatcatctacttcgtcctgggttcgcccggaattgggatccagcgtcaccatcggatcagattcattctgcccggccggatcagcaggtgattcacctcgacccaacttggatactacacttttcacccctggcacctgcgagatagccttcattgcttccatttccatttcaattgcttcagacagagaaatagaagccacccggttgatctgcggtgttaatgcaccttcctgcagggtaggaataaacgatttccccagaaatggaaacaacataaaagacagcaatagcagtcccagtgcggtgataactgtcaacctccctctcttaagagcagtgttaagcagggatcggtaggctcttttcaatccggcaatgatccaggtatcatgttcagccgtcccacccttcagaacataggcacaaagtaccggggacaaagtcagtgaaacgatcagagaaatcgccagggcaatcgcaatcgtaaaagccaacgggctaaacaattttccttccataccctgcagcgtcatcagtggcaggaaaaccagaataataatacagatcccgaaaattaccggggtccctacttcggccacagcctcaccaatagcatgcgtgcgcgactcacgcgcgccatcgctatggcccagtcgatgaaagacgttttccaccacgactacggtcgaatcaaccatcaatccgatcgcaattgcaagcccacccagcgacatcagattggcggaaataccctgatggttcatcaccatgaatgtcagcaaaggcgtaactaccagcgttgccactacgatcaaactggagcgcacatctcccagaaagatgaacagcacgataataaccagaaaaatgccttccattagcactttgctgactgtccataaagcagcatcaactaagtcagtccgatcataatatggaacaatctgcaatccatccggcaacagattttgctcattgatctcggctacttttgccttgactcgtcctacgatctccttggcattcccccctcttatcatcaacacgatgccagaagcagattccgtatatccacccttgataatagcccctgctctcacctccgtgcccagttttacttccgcaacatcacgcacgaacacaggtacgccacgctcctcggacaacacaatattgccaatatcctgcagtgtacggatcagtccaacgcccttgacgaggtactgttcactgcctgtcggcaaaatcccgccactggcattggcattgttctctgcaatggctttttctacctgctccaatgtcaagtcatagtgacgcagcttattgggattcgtcagcacatggtattgcttgacatatccgccttgagaattgatttccgccactccgggaattgaacgcaacattggccggacaatccaatcctgcacaatgcgtcgcttagtcagttcttccacggacagcgctcgttccccatcatcgggatgatctatcgtatattgatatacctcgcccaatcctgtagaaaccggacccaaacgcggcgtaattccagccggcattttactggccacttccagcagccgctccattaccagttgccgagcaaaataaacatcagttgcatcggtaaataccagtgtaatgatagataagccgctcttgttcaaagaacgcatttcctccagtccgggcatcccggtcatagcaatttccaatggaatagtcaccaggcgctctatttcctccggactgcggccgactgcctcggttgcaatctgcacttgaacattagtgacatccgggaaagcatccactgacaaacgctgtgctgcatgcagaccaaatcccatcagaatcagtgcaaccacgacgattatcaaacgctgcgccagcatggcgcgtaccaaagaaataatcatcgttattccagatccttgcgtttacgctcgttattcagatggaaggctcccttcacaataatcagctgatctggtgttaatccctccagaacaggcctcatctgattcactggttcatccagcttcacctgggttaatgtaaaaccaccatcttcccgggcgacaaatacgtgatcttcattatgctcacgcaccactgcgccttccgggataacgagacgttcacgcgcatgctcatcaatatgcactgtagccagcatatccggctttagtttacgctcaggattatccacctcagtacggacagtcactgtcctcgtcaacggattaacaatatcggatacgaaaatgatagtcccgtcaaaatttgcgtcacccagtgccggcacacgaacttccacatgctgtccctgctcaacaaaatgcgcagcgtattccggaacatcccctaccacccacagttcagataaatcagctacggtaaacaattgatctgatggctgcactacttgtccaactgctacattacgtgtgataactgtgccactgcgcggagcagtaatcacaacagatggaagaatctgcccgtgccgggtcagatcttgtattgcctgattatttactcccagtaaaagtaattgatccttggctgcactcagttcagcgttcgaaacctgcgattccgattcccggcgctgcagctcggcggcactaataacatcctcagcgaacagctgtctggcacgtatggctgcacgctctgccagaacggccaatgaattagcacgaagataagctaattgcgcctgcactaattccggacttgtaattcgggccaatttggcaccagctgcgacactatctcctaaatgcgcataaacttcgacgattcttccggtaaaactggctcccacctgaacaagtttcgtctcatttaccttaatttgaccgggaacatgcagcttttcggagatatcagcaaggaatggtttaccggtttcaactcgctgacgcaaatccggcctgagaaaaattgtatgggaatcagccaatcccgctttaacatgtttttctggggaatcctgctcttctttgctgctgcaacccgaaatagaaagcactacgaatgcaaaaacaactgcaatagtttgtatctggaaactcattggggaaaattactcctgtggataatgcgcccgcagccgatctatctctgctgctgctgcctgcaattcgaactgggcctgcaataattccgagcgcgcattacgtagcacccgttgagtatccagtacctcgataaaatctctttctcccaaccggaaagcagcttccgccacgcgcagcgcagctttcgcctccttaacgatgccgccttcgaacatctccaccctgcgccgggcaatctccatggcctgccaggcagactccagcaaccggccgatctcgtagcgacgataatcgagcgtttcgcgtaccctagctgcatctgaaactgccgcatcaacttcaccacgtcgctgataaaataatgggatgcgaacgctcagtccggcagtattcgatgtaaattgcctatcctgataattgctgtacagaatatccacggatgggagcacagaagcgcgctcctgatcaatacgtaaacgtgcgcgatcctgttctgcttccagccgttgaatttccgggtttgtagcgggtaattccgtacgtaacatctccagtgaaggcagttccactgggtcgctgagtgaagcgatcacatcaaactcagcaggcagcgtaccggctgtcagctgcagcagcgcgattcgcgcccgctccgtgttcagcaatgctgcctcttttctactcgccgctgtcattacctcggtatcggcccgaattagctcaaaccgggcaatttcacctgattcaacactcagtttgatacggcgttgaatttcccccatcaaattaaaaatatctgattccatttctgccaggccacgccgtaacaaaaattcgtagatatgcacccggagttgtgccgctagatctgctcgggcctgttccagatttgcgcgactggcttcaacgccggattctgccgccccaatgcgggcacgtcgcacccatggattttccagtggttggctgacggttacctgccgctgcatggaagatggtccggtatcgatttccggcaatcgcggactatcaggtccggccatgaaggttatttccgggttgggaaatgccgatgcactggttactcccgcctgtgcaatatcaacctgtgaacgcgctgcttgcaacaggccattggcctgcaaccccatgcgctgaatatctgcaacagtatagccgccacctgctgccagaaccgagcaattcagcataaataaagtcaggccacacagaacccacgagaaaataatattacacatacgaaaaatgataattattcatactccaacagcagtacccgcataaagttatcaatcatacgattgcacataaatttaaatattttaattaagttttctgcgagtgattattacagacagaactgtaatcatcacaagaaacatgaccaaggtgtagctatccaatgatgtcgagaagtgcaacactgcgagtgcgcgattttgctaccactccaaagtgctgattcagtgaacgggtagcagtgaaataggtatcatggcacgtcgcgaaggaaacaatcattcactatcttatagaaatgacgttttgttccgagaaatacagtacgtattcatgcagtatttaatcagaagtaccttggtctgatttctgtctttttatctggcgttttttccaccaccatcctgctatcaacaacgtaagggctatataccagatgccgtaggtgcgcatccatacttgcggattttttttcacgaacagccggatttcagccagatcagcaatctgtggatgctcatgagtcgtttcagttgtctgcagatatagcttgagcgacagttcgtaacgtccttccttttctggcgtgatgatccacgaccaatgcgtctcatcccgaccggaaaaaagctgagcctgcggctccggtgggttaatagaaaactcatcgccggttatcccagcatgcatttctggaaaaactttaccgtgaatatcttgcaattcagttccgggaagcgatttttcaacaatatcattgatacgcagcgccaattctttggtatccaatcgcagtgtgatttcaaaaggtttaaattgctttacctcatgcggcaaggtaattatcgagctatctgcaggtagtttcatcattacaagcggagggaaatgcttctctccaaaccaggcatgtgcaagaaagttcattacaaacggaatcaataaaacggctgcaatcagagccggcagaaccacattaaaaggggcatctttcttgtacatcatatcctcccaaaactgaacggttcctgaacaacccatcctttaccggacagcatcgcaatccaatgggatagagagtagactctgtgagaaataaaattgactcttctgctatgacgcataatattccttgtttcgttgctcatcgaggatatcccgcattgtatccggaaaattccctgcccggaattcaggcagcaatccaggcgggtacccgttatgttgaagttgatattcaactaagctgccaacttactccatacctttgtcatgacgatcatctcagacggttaaccgggcacaacgcttatttgaccgagttgagggatgatgaaatcgacatactgacgattccttacccaagctccacaaaatatgctcccattcctcgcctggcaaaattctgtcaatatctggcacagtacccgcaagttactgcgtttattgaaatcaaatctgaaagtattgcccggtttggtttaaacaagacgatagctgcaattcttccgattattgacccggtgcgagaacaatgcgtcctgatttccttcgactgggaagcgatagcgctgatcaaaacacatcagatatacagaattggctggattattgatggctggtcagacaagcagtcaaccatggccacacggctggagccagattatctgtttagcagcatccgttatctgcctaaaaatctggatcagctctggtctggatcatggcaatgggtaatttacacagtggatgattacgacacggcgcttgactatgcaaaggctggcattacactgattgaaaccgatactattggtactttacttgcatcttgaactagggccatgtctgcaaccaatcattacgacctcataattgttggcggaggaattcaaggtgttgctgttgcacaggcggcggctgcacgtggctacagcgtactggtgctagaaaaagctgctttagcagcgggcacttcgagccgttcaagtaaattgattcatggcggtctgcgttatctggaaagtggccaactcagcttggtgcgtgaaagtctaaaggaacgcgcagagttgctgcgccttgctccttcactggtcagattgcaacccttttatcttcctatttaccaccagacatcgcgtgactcactaactattcgtgcaggactcagcctttatgctctactggcgggatttggcaagggggccggcttttgctccataccacggagaaaatggggagagctggacggtctctctacacgcggactcaaacatgtcttccagtactgggatgcccagactgatgatcaagcgcttactcaggcaatgatgcattctgcttcatcactgggcgcagagttacgctgcccagcggaattcactcacgccaggattttcggagacacttgtgaaattgaatttttggaaaacaatcagccttatcagtgtacggcaagtgtgctcatcaatgctgccggcccctggatcaaccaggtggcagaacgcatctcaccatccccaccaacatacccggtagagctggtacaaggcactcacctggtgctgaacggacggttgaatatgggctgttattaccttgaatcgccacaggatcagagagttatttttgccttgccatggaaagaacatattttgttgggtacaactgagacggtattcaaaggagaacctgagaaggcatctcctctgataacagaagaggtctatctgcttggctgttttcgttattattttccggatcactacatcacaatccgagagcgctttgtcggcctacgtgtattaccggagtctgggagcctcccttttaatcgttcacgtgaaatacatctgcaatgtgatcatccgaaataccctcgggttgtgggaatctacggagggaaactgacagtctgtcgtgcaacggcccggaaagttttacacaccctgcgtctttctctacctgtccggatacccagagcagatatctcgcaattatcgcttgagctcccttgagttcaattacaacacggattttccaaaatctatttttttgtagccttctcggttttttttgtacgccgggcgatttcttttttgacttcttccagaaaattgctgttatttttatgctgttgttttactttgtaccacattaaacagacaacacctcccagcaggataggtactaagcttactggttcaaagccatcaaacattaaaaacacgattcctgttgaaacaccaaatacaccaagcaaccctactgcatatcctttacgtccgttccagatcgattgagcatgcttggcacaccatgcatcgacctcatcccgggctgatatcagttcctcatcagtcatttctttgaaattcattagtaacctcccgataaattagaaacaatttcatcaatcttctggctcagataaaatgactttagcgtcggtttatccgcatattatttcttttattctgctaaagaatctttacccggtttcaacccattcagctgttcaattagcgctcgtctttcattctctgtttcctgatagcgcgtgtagagttcattcagctcatccgtataacggcgtatcctttcggtacgtttcttgcgctgtatggccgaatcctcatactttggcgcttcgccactgataatcatgtcacttccagtctgagcgacctgatcgtcctgcgcgatctcgtggcgtcgcaattcctgaagcatttgaaactgctgaaataaaatctgctgttcctgttgctgctgcgcaacagcagcttccatctcaagaatctgtttctcattgtccgctgctgcaaatacagacatggagatcagcagcaaaccaaaaaacagcagtttcatgctatttgctcccagaaaatccagatcaatatttcgcaaatcagatatgaatggtccgtttagccacgcctaatgcagcttcatgcagtgattcggaaagtgatggatgagcatgtacgatacgtgccagatcctcgctgctggcagaaaaccccatggcaaccacagcttcggcaattatttcagatacataaggacccaccatatgtacgccgaggatacgatcgctttcagcatccgccagaactttaacaaaccctgttgtttcccccagtgcgcgagcacgtccgttagccatgaacggaaactgccctactttgtagataacaccttctgccttcagcgcctgttcggtttttcccacccaagcaatctccggtgcggtataaatcacccatggcatcattccgagatcaatatgcgcggttgaatcagatgctccttgctggttcgacgctatccgctccgcaacagcaactccttcttcagaagccttatgcgccagcattggccctcttacaacatctccaattgcatatacattttgcaaactggtttggcaaaatttatccacaccaatatatccgcgctcatccagctgtaatcctgtttctttagctcccaaactagcggtattgggaacacgccccacagccacgatgagtttgtccacctccaggctctgtacgttcttgtcacgatcggtatactcgatttttacattatccttgcctgcttgagttgatttaatctcaaccccggtatgaatgacaagtccggtttcacgcgtcaatgccttgtatgcttccttggcgacttgctcatctgctgctgacagaaaatcagcttgggcttccagtattgttacttctgctcccagcctgcgccagacacttccaagttccaagccaatcactcccgcaccgataatggcaagttttccaggagtttgttgcaaagccagagcacctgcattatcaagtacattaaccccgtcaactggcgctattgtcagagaacgaggaacagagcctgtcgcaatgatgatatgcctggtgcgtactgactgctccttctcgtcagtttttactcttatttcccagctatcatcgtcgttatcgcgcttttgcagtacgccacgaccatgcaagacagttactttatttttcttgaacagcatgccaatcccgccagtaaaagctttgacgatcttgtccttgcgggcaatcatggctggaacatctatcgataatccatccagcttaatgccgtgttccgcaaatttatgtcccgctcgcgcaaaattctcggaagactcaagcagtgctttggaaggaatacagcccacgttaagacaggtaccccccaagcttggtctgccctgctcattcttccagtcatcaatacatactgtgtttagcccgagctgcgcacagcggatagctgctacatagccgccaggccctgcgccgataactgctacatcgaatatattattcatatcaattaagtgacaaaaattgctcgttgagaaatccggtctaaattaccccggaacgctaaaaatgcaattctcacacggatacactgatattagccagactgattctgctgatctcttcagtcgcccgaatgaatcgctccatttcatgcaactgcgccatcgaatgaactgtttgctgcccacgcatatgtcccagcctggctgtatcgacagcagaaaattcccattgcagggatgtcaacaattcgtctgctgaattgggatcgttacatatcaataccatgttacaccctgcctgcaaggcttgctctgcccgacgagtgatgctgccataatttctggcagcctgcatacacaggtcatcactgaaaatgcaacccctaaatcccagctcgttccgcaaaatatcctgcaaccacttgctggaaaaacctgccgggtttggatcaatggctggataaataacatgcgcagccatgatgccggaaagccctgtatcaatcatccggcggaaagggatcagatctttcttttcaatatccgtgtaattgcgagaatcaatagcagtttcaacatgggtatccgcctggatcgcaccatgaccagggaaatgtttacctactgccaccattcccaccgactgcaaaccgctcatcaaggcatgagccagttcagcaacaacttgtggctcacgataaaaagcacgatcaccaatcacgctactctgctcataatcaagatcgagcacaggtgtaaaactcacatcaaccccacaagccttgagctctgcagccagtacataaccaatctgccgagccagatgaagcgacaaatctggattcctgtcctggatttctcccagcgtacgcattggcggcaaacgcgtaaaaccgtcacggaaacgctgtaccctgccaccttcctgatctacagcaatcaatagaggcggagagcgcaatgcatgaatggatgcggttaattcggatagctgtgctggtgattcataatttcgtgcaaacagaataacgccaccaacaagcggatgactcaattgaacacgatccgtttcagttaacgttgtgcccgctatgtcgagcatcagcgggccaagaaacatatttatttttccagcaccacaaaggcacttgccagtgtcaattcatcactaatggaaagatgatgactaacaataccgcgctgccctatccaatcgatcagttcctgatgaaattcaaaataaggtttcccctgcgtatcatgctgaacggcaatattcccgaacataacaggggtgcgcaaacctgtgcccacagccttggaaaaagcctccttggctgcaaaacgctttgccagaaacacttccggccgagtctgcctcacatattctgaccactcagaatctgccagcacgcgtctggcaaatctttctccgtaacgctccagcgaccccgcaatacgggcaggatcaaccagatcggtaccaatcccgtatatcatgcacgcgcctcttgcattaacgttttcatttcccgtacagcttgagcaaaaccaataaacagtgcccgggcgacaatagcatggccgatattcaattcggttatctccgggataaatgcaattggcgtggtgttctggtaatgcaagctgtgtccagcattcacctgtaatccccggctaaatgcataggccgccatactgcggattgtttccagctcagcctgttgtgcctcagatgttgcagcatctgcataatggccggtatgtagctcaatcactggcgcgcccaccctgattgctgcatcaatctgatcagctcgtgcatcaacaaacagagaaacacgaattccagcttctgtgaggcgcttgcacgcggcacttacctgatcgaagtgccggatcacatccagtcccccttcagtggtcaactcttcacgacgctccggcaccaggcagatatcatgtggtttgattctgcaggcaaaagagatcatctcttctgttacagcgctttccaggttcattcgggttttaagtcgttctcgcagaattatcacatcctcttcttggatatgacgccgatcttcacgcaaatgtagcgtaatcgcatccgctccagattcctcggcaaccagagctgccttgatcggactgggataatccgtacctcgtgcctgccgtagcgttgcgacatgatcaatattgacacccagagctatcatgattattcagttctcccagtcgttttaaattgctttttttaatcttttacaaatcagctgatctacaaacccggttgggggtatgtgccagatagtctgccacgacaatttttattcctattcataccccatactcttcagtgcaatagcgtcatctgcccagccggattttaccttgacccatatctccagatagactttgccatcaaacagcacctccatatccttacgtgcctgtgtagccatatccttcagtttttttccctgcttacctataatgatagctttctgattttctctttccaccagaatacaggcatggatacgtcgcaaattgccttccacagcgaactgctcgatgatcacactaaccgagtagggtacctcctcaccaatttgccgaaaaactttttcgcgcagtaattctgctgccagaaatcgttcactgcgatctgtaatttcgtcttccgtaaacaccggaggattttcgggcaaatagtgacgaataacttcagtcagatctgataattgtctgttttgcaatgcacttaccgggacaatatctgcaaaatcgaataaatcagccattttttgcatgaacgggagcaattgcagtttatccggtaacaaatcaattttgtttatcaccagaattacaggaagattcctgggcaattgctcaagaacctgctcatcttcccgaccaaaccgtccagcctcaagcacgaacaagatgacatccacatcctgcatactttgcagaacaacccggttcattacctgattgagctggctacgatggcgcatctggaaaccgggcgtatctacaaaaataaattgtgattgtacatccgtcaatatcccgtgaatccgatgacgggtggtttgcgcttttctggaagtaatgctgatcttttgtttaatcagatgattcaacaaggttgatttaccaacattgggtcgccccacaatagatatgtagcctgctttgtaaccagatgcgctcatagtaaagttctgcctagataaagagaactcaggttgatcaaaggaattgtatagagttacgatggatacgaggttgcttaatgtcttactacggcaagtttataagctcggcgtgcagcttcctgttcggctcgacgacgactggttccttcaccacttgtgcgaatagcaaattcaggaatgacgcattccacatgaaaaacctgtgcatgtgcatcaccacgtgtcaatagcgtactgtactcaggcaagtctactttccgactttgtagatattcttgtaacaaagtcttgggatctttaccaaaaagatcaggatccagctgatttaacaaaggatcatagagtgccacaatcacctgatcaactttttcaaatccactttcaaggtagattgccccgataatggcttccattgcatttgccagaatagatgggcgctgatgcccgccactcttgcgctcgccatcaccaagtaaaatcaattcgccaatacccagagcagatgcaagttgatgcaaggcgtcttggttgacgaaatttgcacgtaatcttgtcagatctccttctggcaatagcaggaaacgtttgaacagcagcgttgataccgcacagttcagcacactatcccctagaaactcaagacgttcattattcggaaaaccgaggctgcgatgggtcagcgcctcctgaagcaaatcaggttgtttgaaggtataacccagtttttgggaaaaaacagtgtaatcctgctttttcaatttttttgcatgtttactctttatgccttgcgaagtaaatttggatctggtcattgatcactggctgcatcgaaatcgatcagtagcgaaaggtttgcaaataaaggctttttaactgcgtaactaatgttcaagattagttgctcgtcctgctttctgatgacaatatcactcccgcttacggattttatatcatctacagcagcacgtttatcaaaagctatacgtatttcacgaacactcgcatcccgcagtttggaatcactggcaattgtcactagtgctcgcttgacagcagcgaattcaatgaaagaggggatcaatctcatccccagaatggccgccagtacaattgccactgaccatgtcagtagcccgggcagacttatcccttgctgccctctgtttgtcgaggaatataatgatgaatacataaatttctcctgcggcatactaaagattcaaatcattacttgattagcatacctattctgctcagatcattaaaattccaccagatcaggaaagctttaccaacaatatgatcttctggcacaaagccccaatagcggctatcactgctgccatcacgattatcacctaaagtaaaataattaccttctgggattttgcatgagaagcctgtttggtcaaaagtacaattttcccggttgggaaaatgatggacagcggatagctgtatatcgggcatctcctgattaatcaaaacattatactcgttaccatccatgctctccttaaaccgctgtgtataaatatatgctaacccggattcaatatacttgtagtcgccagctggttccaattgaatgggaacattattgatacttagatgtttgtttcggtaagtgaccgtatccccaggtataccaatcacccgcttgatgtagtcaatagatggatcttctggaaagcggaataccatgacttcgcctcgtttgggctcattcatattgataattttcaggtttgctacaggcaatctgatcccgtaggtgtacttgttgaccaatataaaatcccccaccagtaaggtcggtatcatggaaccggaaggtattttaaaaggctctaccagaaacgatctcaaacaaaatacaaccaaaataatggggaaaaaacttttagggtactcaatccaccatggctcgacattatcaggagtacgctggtgtcgcagtattaaataatcaagcagccaaattccacctgtaaccaccaataaagcaagcaacaccaaaggaaaattcatagtatcccggtacttatctgatctaaagatatactgataaacatattaaacacgtcatttatcggtattgtttacttaccatccacctgaaggatagcaagaaacgctgcttgtggaatttcaacattaccgacccgtttcatacgctttttccccgctttctgcttttccagcagcttgcgttttcgcgtaatatccccaccgtagcacttcgccagtacatttttacgtaatgccttgacattttcacgcgccacaatatgggcacctattgctgcctgtaccgcaatatcaaacatttgtcgcggaataagttcacgcattttttgtgccagctcccgtccacgttgttgactgctggcacggtgtacaatcagggacaaggcatctacccgttcattattgatcagtatgtcgagcttaaccagatcagccactctgaattccttaaattcgtaatcaagcgaagcataaccacggctcacagatttcaatttatcaaagaaatccattaccacctcatttagaggcagctcataaacaagcatgacctgcctgcccatatattgcatattttcctgaactccgcgtttaccggtacacaatgttatcaccgcgcctacatattcctcgggaaccaggatagttgcagtaataacaggctccctgatttcttctatgctggacagttctggtagtctggaaggattttcgatctccacaatcttgccatcatgcaggataacctgataaaccactgtcggcgcagtggtaataagatccatatcatattcccgctccagtcgttcctgaacaatatccagatgcaataaaccgagaaatccgcaacgaaagccgaaacccagtgcctgagaagtttccggctcaaagtgtaaagaagcatcgttcaaccgcagcttctccaatgctgcacgcaatgcgtcatattgattggattcgaccggatacagtccagcaaaaacctgtggttttatttccttgaatccatccagaggctcactggcaggatgatcaaccagcgttaccgtatctcccactttggcagactttaaatccttaattccagaaattatgaaaccaacctctccggcactcagagattcacggttaaccgccttcggctgaaaaacacccacttcctcacacaaataatttgccttattggacattagcaggagcttgctacctggtttcaatatgccatccatcactcgaaccagcatcacaacgcccacataactgtcaaaccaggaatctattattagcgccctgagcggcgcatcgatctccccttccggaggtggaatccgggccacgatcatttccaggacttcacttatcccttcaccagttttagcactaatgtgtagagcactcctggcttcaattccgataatgtcttctatttcagcaatcactctatcaggatcagcagcaggtaaatcgatcttgtttagcaccggaataacttcgacgccttgttcaattgcggtataacagtttgcaacagtctgcgcttcgacaccttgagaagcatcgacaaccagcagagcaccttcacaagcagatagtgagcgggatacttcgtaggaaaagtcaacgtgtcctggcgtatcgatcaaattcagcaaataatttacaccatccttggcctggtaatacaaggcagcggtctgtgcctttatcgtaatgccgcgttcgcgttccagatccatcgaatcgagtacctgagcttccatttcccgatcagaaagacctccgcaaaactgaataatgcgatcagcaagcgtggatttgccatgatcaatatgtgcaataatagaaaaattacgaatgtgctgtatcaaaaaaaatcaccgattggcaggagaattgacgaaagccatggataaaagaagcgattgtatacaaatcagcagaaggaagatagatttcccggagcagccagaacagataaagcgattccgtatacttgacaatcatgaagacaacgcgagaactcgctaaataaatcagatgagtagtaatttactcagctcccgcattatctctatgctggaacaataacaagaagaaatgagaacggatcttttgtagagaagataatttaatctgctcgagcaaatcaaatcagcaaaaagttagaattcaggcaaggtaagcgttaaacgcctctaaatcaagaaaatagtgacatagctcttttttttcttttacagcaaacagaaccggaacacgctcattatataatcgggtcaaattctcatctttatcaatattgatcactacaaactcaaatcgaaattccttttgcagatcaccgagggaagcaatcatatcctcgcagagatgacagccttctctcccatatacaattaattttctgagctctgcccgattattcatctatttttatggtaatgaaagtcgcaacatcccctcttcttattagcagcgcaatattccgacctttgggagcatcattcagcaacttattgaactgtctgatggattttatatcttgattattaaatcccaagataatatctccgggacgaatacccgagctactggctattccgtcataaacttcatcaaccagcaagccattctctataccaagctgatttttctggttagtagaaagctcccttagaacaagaccaagccgactggttgcatctcctgatttgctttgtttttgattaacaatattgccatctgcaggcatttctcctactgaaatagtcatttttttgaccgaaccactacgccatatttcaacaggcaccttggagccaggtttcgtgttcccaacaatgcgtggcaaatcacttgaagcctcgatatctttaccatcaaatttcagaataacgtctcttatctttatgccagctttgtcagccggcccgcctttttctactgaaaccactagtgcaccgcgtgacttgtccagactgaaagactcggccaactcgtctgtcatttcctgtatcatgacaccaatctttccgcgtgagatcttgccataggtcttgagttgatcggcaatatccatcgcgacatcaatcggaatggcaaaagaaagacccataaacccacccgttctgctgtaaatctgggagttgatacccacaacctcacccttcatattaaacagcggtccacctgaattacccggattaatcgccacatcagtttgtataaaaggaacatagttttcctgggcaagcgaacgtccttttgcactcacaattcccgctgtaaccgtgttctcgaagccaaagggagcgccaatggcaactacccattctccaaccttgagttgctcagggctaccttgggtcactaccggtagatcatttgcatctattttaagcaatgcaatatctgttttttgatcagctccaattacttttgcgctgaattcacgcttatctgtcaatcggacggtaatttcattggccgcctcaaccacatgtgcattggtcaggatatacccatctttactgataataaaacctgaaccaagtgaacgagattcatattttctcgggcctgagaaaggttggatatgtctgcgaaaaaattcatagaaaggagaatcttccggaatattaggaatttctggcaaaaactgaccaacccctacttgctgagtctgaactgtactgatattgacaaccgcctgtccgtgcttttctaccagatcagtaaagtccggcaaatcttttgcctgcaatgaaacaggcagcataaatgcggaccaacacaggaaaattataaatgctatcttctgccatgtatttttaatcgtagccacgatcaatattaatcctgcgtttgggtaggggttactttgagagatcatgatgataaatatataatcataattaagaattattggcgcttacagaagtaagtccacattaccgtagccaaaatatcgtcatatcaattccccacaagctctttctgtttataacaatgacagaacacggcacctgcattattacaacaatatacttcatgaactcatgattcacgttactcggcaggcgcgagaggctctgtccggattggtccaacagctggagataccccgacagacggataacgggcagcactctcgtatgttactcctctgtagatcagaggataattattgtttgtagaaatagaaggaaatgaatacgagggagtgggctgaaaagtaaccaacgagcgctgctcgttggcaggcgtagccttgtcatttattttctcagtcacataaacttctttaagtgctgtttcatgctgctctatagactgaaatatcaaccatccggctgacaacactgtaatcgaagcagcaaccgaaaatcccagtagcttttgtttacgattctggtgagttttgtgtgaataaggcaccaataacagccgttcatcaattagtttatttctgatcttttctgaaagatctatactaataacggattggtgtaatgaatccctaattatatgataaacctcccagtcagaaaacagactactgtcactttttacaacattaatgatcgtaactgcatccgtatcctcaagctcaccatccattaattcagatactttctttctcacatttcacctcttattaccatcttttactcttgtcagtgcctaacaaaggacgcagtttgtcagccaccgcctcacgtgccctgaatattctggaccgcactgtaccaattggacaattcataatatcggcaatctcttcgtagcttaatccctcaatttccctgagagttatcgcagttcgtaattcttcgggtaaagcttctagtgcctgattcacagtttgggcaacctgttttcccataagttcactttcaggcgtattcacctcccgaagctgatcagctccttcaaaattttccgcatcttcagcatcaaatccagtaatggttacgggctgtttacggccttgtgctaccagaaaattcttggctgtattaactccaattcgatacaaccaggtataaaaggcactatcaccgcgaaacgaagctaatgcccgataggccttaataaaggtttcctgggcaatatcttccacttcagccggatctcgaataaaccgagataacaagcgcgcgagccgtccctgatatttaataaccagcagatcaaaagcacgtttatcgccctgctgtacccgttctaccaactgttgatcgatttcacgatcactcatttttcttggctgccgggataagaaaaatgcaaatcaactctatttatcaatttgtaaccttctgttccggttttatttttgactttcaataaatttttgaagttattatatagctgaggttatttcttctttggcctgatccaaaataatcatttggcataaattcaaccatatttactataaaagctgaattagtcttatgaatctgcaatatcagtcagctcgggtttaatacgttccacttttaacagatgcaaacgacgactatccgctctcataacggtaaaactgaaatctcctatgacaattgattctccgctctcaggaagcctgccaaattttccaataacaagaccgccaatcgtatcaaagtctttatcactgaatgatgcgcccaaagtttcattaaaacttgatatttcagcaattgccttgacacgataatggccgtctgtatccgcaacaatatatgcgtcatcctcgtcaaaatcatattcgtcctcaatatctccaacaatctgctccaacacatcctcaatcgtaacaagcccagccacaccgccatattcatcgacgacaatagcaatatggttacgattactgcgaaaatccttgagaagaatattaagcctcttagattctggtatatatatcaccgggcgcagtatatcctgtatgttgaatgcttctctgcttgagtaatagcgtaataaatcctttgccagtaaaacaccaataacctggtctttgctcccatccgtaacaggaaatcgtgaatgggcagtctcaatcacaaatggaataacctcctcaggtttttcgttaatatcaatcgtatccatttgcgaacgaggaaccataacgtcacgaacttgcatttccgaaacttgcatcaccccttcgatcatagccagtgcatccgcatcaagcaggttacgctcataagcagagtgcagtaaagcaatcaactgctcacgatcttccggtttgcgcgaaagtaatgtactgatatgctcaagccaaccagctttgggggaggtctcgttcatgaaatgtatagcatcgggaataaaaaagatttgtctggtccgtttatatcatttcactgctgaatgacataagggtcaggataattgagcctggtgataatctttgtttcgagggattccataacaacggcatcttcgtcgctgatatgatcatatccttgcaaatgtaaaacgccatggacaataagatgcgcatagtgtgctaccagatctttattttgctgttctgcctccctggaaattacaggagcgcacagcacgatatcaccgagaagtggaacatcatcactatacacaaacgtcaatacgttagttgcagagtccttgccacgaaacttgcgattaagcacttcaccttcctgcataccaacgatacgaataacaatttcagccggcttatttaacgcagccccgacccatttacgaaacagttgcctgcccggaatattagttttatctgccgcaaactgcaccgtcaatttaaacgtcttctcacaaccagaaaatttattggggttctttatcagaggcatatttttcgtaggcatccactatacgttgaaccagtggatgccgaactacatcgtcagttttaaaatgtgtaaacgctattccacttactctttttaatacttgcccagcttcaaccaaaccactcttctgatgcttcggcaaatctatttgcgttatatctcccgtaactaccgctttggagccaaaaccgatacgcgtcaaaaacattttcatctgttcaggagttgtgttttgcgcctcgtccaaaataatgaatgattgattgagagtgcggccacgcatgaaagctagtggtgcaatttcaatagtgcttttttcgaaatatctattgactttctcaaaccccatcaagtcatacaaagcgtcataaagcggccgtaaatagggatccaccttctgcaccatatctcctggcaaaaaccccaatctttcccctgcctctacggctgggcgcaccagaataattcggccaaccagctcgcgctccaatgcatctaccgcacaggcaacagcaagataggtcttccccgtgcccgctggcccaatgccaaaagtaacatcgtgctccctgatttgataaagataatccgtctgtcgaacagtacgaccttgaatattgccgcgacgagttatgagttgcaaaggtgtcgagtcgagcttttccgcatccctgtctgaattcatagtagatggagaggcaatatttctgatttcaactaatcctaactgtatctgctcaataccgagatgattatccgattcttcatagaattttttcaatgctcggactgcaagattagtttgactgataggaccatgaagtacgaagtgggcacctctacgtgagatgactacatcaaaggcagattcaatctgcttgagattttcatctaataccccgcaaaggttgatcaggcgttcattatttgtggatgaaaacgtcaattcaacagattcaggtttcgattctactgaaaacgtcatcgcagcgttcaaactctaattacaatcaagttgagcaacaagccggccgtaacaagattgttcatcgcatatcagaaatttcaccgcgtaacgtatgcgatgaaactgctgttatcttgatatcaacaaagcttcccaccaaaccagcgtgtccagcaaaattgactacccgattattatccgttcttccacaaaattcatttggatctttttttgatgggccctctaccaaaacacgctggatagtatcaaccatactctgactgatcatttgtgcattaagctgtattttttcctgcaactgatgcagtctggccagctttatccgatagggcgtgtcatccggtaaatctgaggcaggtgttccaggacgcggactataaataaaactaaaagattcatcaaatttcacatcatcaatcagtttcatcgtctcttcaaaatcagtatccgtttctcccggaaatccgacaataaaatctgatgatattgatatatttggacgaatcgtacgcaacttacggatgatggatttatactcaattatagtataacctcgtttcatcgcagccagaatcctgtctgatccggattgtatgggcaagtgcacatgaccaaccagcttcggtaatcgttgatacgtttcaatcaatcgggctgtaaattctctcggatgggaagttgtataccggatacgcaccaagcccggaatttcatggatataatccagtagcgtagcaaaatctatatctccttctccgcttgtcttatcgtaataagcattcacattttgtccgagcagagtaacttccttgaccccttgaatcacaagcccagccacttcggtcagaacatcatccaatggcctggaaacctcctctccccgggtataaggaacaacacaaaagctacagtatttactgcatccttccataattgatacaaaagcagttgctcctgttgtacgagcaggtggcaaacgatcaaatttttctatttctggaaaggtaatgtcaacctgtgactgtcctgtatgcctgcgagcatcaatcaactcgggtaatctgtgtaatgtttgcgggccaaataccaaatctacaaatggagcacgcctgactatctctgaaccttcctggctggccacacatccaccaacaccaatcaacaaatcaggcttgctatttttaagatgccgcacgcgccccagatcatgaaaaactttttcctgcgccttttcacgaactgagcaagtattaaatagaattaaatcagcttcttcaggtacttcagtcagctccatatttttttctgataaaagaatatcagccattttggctgaatcgtattcattcatctgacagccaaatgttttgatataaagcttactactcattatattccttaccatcaacctaaaaaaacacccactgcaagcaacgaaatattaattactgtggtactcagcccaccgatgatcttaatcagcctaaccccaaggggttgaaaattgagcccgcagagattaacaaatcaacaaacctgtatatctttatttaacagaaaaccaaagcaactaaagcaatactgcaagccacatctcgtatcctgatcctgatcctgattcagttccagggagaatgtgacttgcagctctatacacctcaatctaatgtaaactagccaatcaaaatttactcatcatcactatcgtcatcatggttgctggaggaagcggagtcgctgtcgtcagctgtttcagtttcttcaacttccacctcgacttcttcatcctcctcctcgtcatcaacgtcaacgtcatcgtcatcgtcaccgtcaccctcttctggctttaataccagcttgcctgcagcaagacttgcattcaaatctgtcatcggcgcttcttcatgcaccagattctgatgacagtctatgcaggttgctccttccgtttccattttcttatgttccgcctgggcgctttctcccggaggagctggttttacatgacaggtacggcaggtgatgctgtcccatttcttgaggttcatccgggcatcatgcgccatttccaatcttctttcgttgaacttctccagggtggagtagtcattgaccatctccaaccaaagttctctggcaccatcaaccacgtgagttgctactgccaggtggaaattttctatcccttgtggaatatgacagtctttacaagtcggattaacccccaatgcaccatagtgggtggattcttttaattcactctgtgggtatgacatggaatgacagctggtacaaaactcttcggtcgataacgcagcttccccaccaaaaaccacagccaccaatgctattcccagcagagctcctgtcagtaaagtaccaattgatcctttttgcagtctagtcatctctattttccttttttggcagttttagcgttggcctggaattcgtcatggaacttgaatttaggctctccgtcaaatacgccatccagtttgtaatgctcgtgcatggctttgacgtcttttaccatctcgtcaaacttgaaggtgtatttcggatccacttccggtgtatacggggtatagggaggttttgctcctttccagggtgacccttcatagttcagatggcaggcgctgcaacgttcttcaaaattaaagtcttgccccttgcttgccagggtcttgcgcggcgcttttttgcccgatttctcaaatgcttgcccagccttgcggtgatctccccggtatttacgtccaggcccgtggcaggattcacagcctacgccagtcagcatgggtttgggggagtctatcgtgtagccgcctttctggccaaatccatccacgtggcaacctacgcagtctttgtcctgggtgtagtccttggtaggatccagtttggctttttgtttggcttccactttgacattgggcttgagcgattccatcgccttggcgtgggcagtatgtttccacgactgggcttgtggtttgtgacaggaactgcactttttccgaccttcaaacggagcatccgctgccagactctgcccacttgtcagggtgaacagggctgcagcaaccagtccgcaggctattattattttcatgatctctcctcttttcttagatgtttgaacacagattatgattcttttgtcttgccgaccatcattgtacctgatcagtcagatgggttgaatccgtcgttttatcatgatccggagtgggttgcagattgtgctgggtttgtgccgccggggccttttctgccagttgatagacccagtatcctccttgctggtagatcaatcgcggggaggcaagctccagcggagaaggttggctggtaaatggcagcagcctggccagcagggtgtggtaactggcttcatctgtcagaaagaaggcgcgaatcagttcgtccgataacgattgcacagtgtaggcgtagtagccgtgattgctcatctcggtcttgacatgactgatcatgccatgcaggttaccggtcaggcggtagggtttgtaggcaatgccaaatttgtcagggtatagcagacctagtttgtacaggtcgctgatatgcacgatcaggtaagcatcgcgtgtaccggccagttgtcgcaaatcagccaggccactggccagcggattgagcaggctttgcgtaaaacgcagaaacagctcgcgttcctgtggatcggccgcagcgccagtttgttcgttttcatacgcgcggatcgcttgcgcatgcgcttgccattccggcggaacaatcagaggttcgtgcagtgtgctgtgaaacagtacgtctcgtccggtcaacagggccagttggcgtgaggtatcccaccagctgagcagtagtgcatctcgcggggcgtatttgtctattgccgttgcaagcgcactgagttcagcagctttctgatccagcgccagcagaggttctctggtttcgttcttccagttgagtaatacctgcggttgatttgcacgctgaccaaaccaggcttgtgctatcggttgatccgttccttccagatgaatgtcgtactggttgatggtcagatccggccaggcttccagttccagatcaggatagtcgtccaccttgccggtggcagccagctggtaacgatagggagcctcatccggtgtcagcagcagccaagcatacccgcccagcaaaaccaaacctcccgtcaccagtaaaatccccagtggcgggaggagtcggtcaaaccagcgcgactgtgcgcgccggtttggtgtcaacgaagcagtcaagcttgcgtttgcttacgtttacgccagccaatcagagcaatcgctcccgccagcaacatgccacctcccagtcctcccagcgagatcttttctcccgctcccttgaggtcaagcaggctggtttttttaccttccagtttgttaacacgcgcttgcagagctgtcatttcctgcatcttggtgtattcatcctggatttcaacataggcacggttcatcgggccccaaccttcggtatatgtccagccacctggattaacgtgtgccagtcctacgtgcattttggccaggttgttttctgccatttccagcactttcagttcaagtgaggccgggttgttacccttggaccagaacagttgggtgaagataccaaaacccggtttctctggcgccggtggattcggacgattggttttttgaccagtcagggtgccgtcttcatacattttgtgaacaatggcattggcttcctggtatttagccaacccttccagggtacctttgtccatgagatccaggtaggagcgggcaaaccgttccgagtgacattgggtacaggtcacaacccaggaatccagacgagcttctgaccagtcgctggtgatgttttctgcaatccccggaacaaacgggtagtttgcccagcgggtcttacgggtgatgttatgggtatattccccttcgtattccatgtggcaggctgcacaggtcggtgcggtctgacctcctttggagaaggcgtctttcagacgaacattccagttccagttctcccggttcatttcagccagtttgccgtgcttggacataatgtaggcttcatagttattatgatccacgccgctgtgacaggtggcacaggcttccggtttgcgggattctgccgccgaaaattcatggcgggtatggcagttgtcgcatttgttctggttggtgtggcacatggtgcaaccttctgccacttcacgttgcggcatggctgcccaaacggtggtttcaatgttggctgtgtagtccagtgcgtgggatggacgtccgtcaggccactggccattcggccagatcatggtgtcacgctcggattcacgctcggcaaattctctcaggtgacaggttccgcaaacgtcagctgtaggcatgcgtacgtctttggtgtgatctgctttctttttggcgttgatgtcaacgtgacagtcaatacagcctacttccttgagcgcttccttctctccaagtttgcccatggagcgcaggttgttctcaacttcttccagcttgccttttttgtaaaaaagcggatcttccggcttgaggttgcgtattttgtccaggttggcgtgggtgctgcgtttccatgctcttacccaaaccggcgtttcatcagagtggcattcaacgcagtctttgcgctcagcaatttctttcggggaaaccggtggtttgtaaaaggtgctcgggtccatgtagatactaagcgctatcggttcccagtagtctcccatcgtgcccttgccagcaccatgtgcaggatccttgtaacgcttcaccagcgcatcataggtctctttcggcgtggctttgctgcgatccagcttcaatgcttcatacgtctcatccggtaccgtcgatatatccgcctgtaccggcccaatcaacaacaggcccgcacacagcagcatccccttcaaatactcccctaatctcatctctctcctccgtaatctacctgtcggtatttccaatgtacaaacaataaccagctaccccaatccctctcaggtaaccagccaaaatcacttctatacatcacagcgccccaagactactttctcatcagagacaagtcaagattttaaaacatggagctaaaagttttgaaagcctctgatcttatcgaccataataaatattattaacagcatccatcactcggcaatttcgttctccgtcaagtcagcatccagatagacagtactttccgataatctttgttttttccgaatattatgaaaggacaagcctgtccctgctggtattaatctgcctacaattacattttccttcaaacctcgcaaatcatcttttttacccatgatagacgcttcggtcaagacacgagttgtttcctggaaagaagcagcagaaataaacgagtcagtagaaagagatgccttggttatccccagtaacacatattcataggtcgcaggcatcttgttttcagtaatgagtttttcgttctcggtaagaacctcagcacgctcgacctgctctccaagaataaaagctgagtcacctgcatttgttatctggacacggcgcaacatctgcctaacaattacttcgatatgcttatcgttgatgcttacaccttgtaggcgatagacatcttgaacctcatcgctaatatatttcgccaatgcctcaacaccctgcagtcgcaatatatcatgaggatcgataggcccatcaacgattacctcacccttatttaccacttgaccatcatgcgcagtcacatgcttatctttaggaatcagatattcatgtgcaataccatccagatcagtgataacaagacgctgtttccctttggtatctttcccaaaagctactgtgccggtagcttcagcaaggaagccagcatctttgggcactctcgcttcaaacaactcagccactctaggcagccccccggtaatatcgcgagtcttggatgtctcctggggaatacgagccagaacctcaccaataccaacctgctgtccatctcgcaccgttataatagaaccaacgtggaatgtaatgctgacaggttgatcagtccctgggatattgatttcctgatcattttcatccaaaaacttaacaagcggccgtaatcctttggattgcgcaatatttcgccgcttggggtctataactaccagagtggccatcccggttatttcatcaatttgtctgacaactgttacgccttcttcaacgttctcaaaccgtatcttgccggcatattccgttatgataggacgtttatgaggctcccatgagcctaggatttgccctgccttgattgtttcgccatcttgcacatgcaacgtcgcaccataaggaattttatgccgttcacgttcacgaccgttctcatcctggatcaggatttcgccactacgagaaattataattagttcattctgtgcattctttacatagcgaatatgatgagaataacggacaactccgtttgatttgctctcagcctgattggcaacaacagctcttgaagccgcaccaccaatatgaaaagtccgcatagttagctgcgtacccggttcaccaatagactgagctgcaatcactcccacggcttctccaacattaactggcgttccacgccccaggtcacgcccatagcatttcgcacaaagtccatatcgagtttcacaagtgagtggcgtccttacctttacttcatcaacactacaggcttcaatttcatcggctgtatcttcatccagcaatgtaccttccgagcaaataacttcaccggtttctggatttataacatcagtcgccgctactcgccctaagattcgcccacgcaaggattcaacaacgttaccaccctctactaaagccttcattacgacaccaccatccgtaccacagtcattttctatgataaccagatcctgagtcacatcaaccagcctacgtgtgagatatcctgagttagcagttttaagtgctgtatctgccagccccttcctggcaccgtgtgtcgaaataaaatactgcaggatattaagtccctcacggaaattggctgtaatcggggtttcgataatagagccatcaggttttgccataagaccacgcatgcctgaaagttgacggatctgcgcggcagaacctcgggctcctgaatcagccatcatgtaaattgaattgaatgattcctgcgtaactgcctgcccatttttatctgtcctgatttcacccgtctctcgatttttgaccggttcgacactaagctgatccatcattgctttagccacctgatcacctgcacgagcccagatatcaaccaccttgttataacgctctccttgagtaactaagccggaaatatattgatttgctatttcatgtatttcttgctcagctgcctgaataataccggtcttctgtgatggcgtaacaagatcatccaggcatatggaaattccgcctcgagtcgcataggaaaagcctgaatacataagtttatcagcaaatataacggtctcccgcaaaccacacaaacggaagctagcatttataagcttggaaatttcctttttcttaagcgttttgttgactagggcgaaaggaagtcctgctggcaagatttcagatatgagcgctctgccaacggtagtttcaaaacgtgtaatcgttccaatcggatcttcaccatgtccacaagattttttcttttccttgattcttacggtgattctggcattcagctccaacgctttgttctcataagcacgcgttatttccgaaacatctgaaaaaaccattccctccccttgcgccccaactttctcgcgcgtcatataataaagacctagcacgatatcctgggaaggaactatgattggatcgccattagctggggagagaacgttattagttgataacatcagcgtacggcattccatctgggcttcaagcgacaaaggaacatgcaccgccatctgatcaccgtcaaagtccgcattaaaagcagcacatacaagcggatgcaactgaattgcctttccttcaatcagaacaggttcaaaagcctggataccgagtcgatgtaaagttggtgcccggttaagcattaccggatgttcacggataacttcttccagaatatcccaaacaatcggattttcattctctacttccctcttggccgctttaatcgtgctcgccactcccattacttccagcttattaaaaataaacggtttgaataattccaatgccatttttttcggtaagccacactgatgaagcttgagttgcggccctaccacaattacagagcgaccggaatagtcaacacgcttacccagcaggttttgacggaaacgtccccccttacccttgatcatatccgcaagtgattttaacggtcgcttatttgctcccgtcattgctttaccccggcggccgttatcaagcaatgaatccaccgattcctgcagcatgcgcttctcattacggataataatttccggtgcccgcaattccagcaaccgcttcaaacgattattgcgatttataacgcgcctgtataaatcattaagatcagaagttgcaaaacggccaccatccaatggaaccaatggccttagctctggaggcagaactggcaataccgtcaatatcatccactccggcttcatgccggatttattaaacgcctcaagcaccttgagtcgcttggcagccttcttaatcttagtttcagagcctgtcgtttggatctcaagacgtaaagactctatttccgataggatgtccatactattcaacagcgcacgaataccttctgcacccattgcagcactaaaatcatccccaaattcttctgttttattcagatagtcatcttcagtcagaagctgaccacgagtcagtggtgtcatacctggatcagtaacgatataggcctcaaaatacagaacccgctctatatctcgtaacgttatatcgagcacaagacccaggcgtgaaggtaatgattttaagaaccatatatgggcaacaggcgaagccagttcaatatggcccatgcgctcccgtctgattctagataaggtgacctccacaccacatttttcgcatatcacaccccggtgtttaagtcgcttatatttgccacacaagcattcataatccttaaccgggccaaatattttggcacaaaataaaccgtctctttcaggcttgaaggtccggtaatttatcgtttcaggtttttttacctctccatatgaccatgatctaattttctcaggagaagccaagcctatttttatggaatcgaattcttctttctgtgtaacttgtttgaataaatcaagcagtgctttcacgtgtcactcctgtgaatcaacgtataaacctgaataggccaaggaaatggaaattttgagtctcaatcttgaaaggcggctagatatagagcgcttatcagcacagaactgccatacaaaattgagacaaacacatcaatatcaaactaatagagatattaatgctgttctaggtcgatatccaaccccagagatctgatttctttaactagtacattgaatgattctggcatacctgcatcaattttatgatcccccttgacaatactctcataaaccttagttcgtccattgacgtcatcagatttcacagtaagcatttcctgaagggtataagctgcgccatatgcttccaaagcccagacttccatttcaccaaaccgctgccccccgaattgcgccttgccacctaatggctgttgcgtgacaagactgtaagggcctgttgaacgagcatgcatcttgtcatctaccagatgatgaagttttagtacatgcatataacctacggtaaccgagcgatcaaaagcttcccccgtccggccatcgtagagcgtagtttgcccggattccggcaggtctgccaatttcaacatatgtttgatctcggattcatgagcaccatcaaaaacaggggtagcaaaaggaactccatctgacagattttttgccaattccagtatttctttatcatccagagaaaccaaatcttcctgttttccgttatcgctatagattttacttaaaaaatcccggatttcagacgcatcacgttgagagatcagcatctcgttaattttcttgccaagccctttagcagcccaacccaagtgcacttcaagtacttgaccaatattcatacgcgaaggaacacccaatggattcagtacaacatcaactggtgtgccgtccgccatatagggcatatcttccacgggaacaatttttgaaatgactcctttgtttccgtgtcggccagccatcttgtcaccggattgcagtctccgtttaaccgcaatataaaccttcaccattttctgaacaccgggcggcagctcatccccttgggaaagcttcctctgcttttcttcaaaggcaaggtcaaacagctttcttttctgaaccaggctatctttaatctgctccagttgaaggctcgtattttcatcaatcagacgaatatcaaaccagtgatgtttttccacactttcgagatattcttgtgtgatagttgaattttttgccaattttttaggccctccagcagcaactttacctgtaagtaatcgttttgcacgctgaaaagcatctgcctcaacaatacgcatttgatctgcaagatcttttttaaagcgccccaattcatccgctattatctgtttggaacgtttatctcgatcaactccttcccgcgtaaagatctgtacatctattacagtccctgaaatacctgctggcacatgtaaggaggtatctttaacatctgatgccttttctccgaatatcgcacgaagcagtttctcttcaggtgttagttgtgtttcgcttttaggtgtaaccttacccaccaacacatccccggcttcaacttcagcgccgatataaactattcctgactcatcaagacgtgcacgttgacgctcggataaatttggtatatctgcggttacctcttcagtaccaagctttgtatcgcgactgacggctgttaattcctcaatatgtattgaagtaaatctgtcatctgatacaactcgctcagatatcaaaatagaatcttcaaaattgagtccattccagggcataaatgctattaacatattctggccaagagccagttcacccagatcagtcgatgcaccatctgcaattacatcctcacgagaaagaatatcaccaatttttacaataggcctttgattgatattagtattctggtttgaacggatgtatttggtgaggttgtaaatatccaccccaacttccccggcacgagtctctgcatcatgcacacgtatcactatacgccctgcatccacataatctaccactccgcctcttaatgccttaaccgcagttcctgaatgtacagcaaccactcgttcaatccctgtgcctactaaaggtttctcggcacgtaaacacggaaccgcctgtcgctgcatgtttgatcccatcaacgcgcgattcgcgtcatcatgctccaaaaaaggaatcagtgaagccgccacagaaacaatctgggctggcgcaatatcaacatactcaatctggtctctggacgccagggtaaattcatttttatggcggcaagaaacaacttcatcagtgaagaccccggtctgatcaaaatttgcgtttgcctgtgcaatgacatactgactttcttcgatagctgaaagatatacgacctcctccgttacgcgactatccttaaccatgcggtatggggtttctatgaatccatattcattggttctagcataaagagccaacgaattaatcaaaccaatatttggtccttccggagtttcaatcggacacacacgtccataatgagttggatgcacatcacgcacttcaaaacccgcacgctcccgcgtcaacccgccaggccctaatgctgatatacgccttttatgtgtaatttcggataatggattagtctgatccatgaactgtgatagttgacttgatccgaaaaactcacgtatagcagaagacaccggtttagcattgataaagtcgtgcggcatcagattttctgattcagcctgactcaaacgctccttaaccgctttctcaactcgagctaaacctgctctaaattgattttctgctaattcacctaccgaacgaacgcgacgattacccaagtggtcgatatcatcaatctcgcctctaccatttcgcaactcaaccagtattttgataacatcggtaatatcttcatttgataaagtcgtagagcctgttagttcttcacgccccacccgccgattgaatttcatccgaccaacgacagataaatcataacgctccggggaatagaaaaggccattgaataaagctaatacggcatcttcagtcggaggctcaccaggtcgcatcatcctgtaaatagcgacctgagcagacatttgatcagtactttcatcaaccctcaacgtttgtgaaatataagggccgtaattgaggtcattcacaaaaagagtactaatctcactatttttattttgagtctgcttaattcgttcaagtaaggtttcattaatttcgctattggctgtggcaataacctcccccgtttccttatctacgatgtcttcagccaaaattttccctaataaaaattcttcagggacagaaattttagtaaggttagcctgttgcagatcacgaacgtgttttgccgttatccgcttatctttttgtacaaaaaccttgccatcttcagaaacgatatcaaagctagccaactccccacgcaaacgctccggtatgaggtgaaataaaatcttattacccgcaagtgtaaagtgatcaaactcgaaaaaatcagcaagaatctgcgtggaagaatagcccattgcctttagcaaagttgtaaccggcattttgcggcggcgatctatcctaaaatagacataatccttaggatcaaattcaaaatccagccaagaaccacggtatggaataatacgggcagaaaataacaacttaccggatgaatgtgttttgccgcggtcatgctcaaaaaacacccccggtgaacgatgcagctgtgaaacaataacacgctccgtaccattaacaacaaaagaaccagtctctgtcatgagaggaatttctcccatgtaaacttcctgctctttaacttctttgacagttggttttgaagcttctttatccataatagtcagcctgactctggcgcgcagtggagaagcataagtcaaccctctctgttggcattccttaacatcaaacacagatgtgccaagcatataacttataaaatcaagacgagcgttattagagtggctttctattggaaaaacagcattaaatgctgcctgcagcccctgattcttccgtttaccaggcgccacatctgcttgcaaaaaatcagcgtaagattctatctgggtggcaagaagaaacggaaatggtagaatgctggtacgtttagcaaaacttttccggatacgttttttctcggcaaacgaataactcattaaatcactccgtgcactgaagatataatcgggatcgaagggcagtttatttgatataaaacgagcacctaaacaaagctacaaccttaacctatatagcggtaatacgtgggccaagaaacaaaatactctaccccaacaactcatagactacagacatgatatttaaagatcaaagaaacttttattaaactatgtcgccgggataggccagagaaaaaaatttttgaggtttaactaacaattacaattaacaatctattagtacatacttctatttatcagcgttatttctataccgacatacgagataaaggctgacgatacaatccgtatctgtcagcctgaattactaatacaattaactatttaatctcacaaccagcgccagcttcagtcaactgtttcttgagtgcttctgcatcatctttagaaacaccttctttgactgctttaggagcactatcaaccaaatctttcgcttccttcagacccaaaccggtgaccgctctaacaaccttaatgacattaaccttattgtcaccagctgaagtaagaatcacagagaattcagtttgttcttcaacagctgctgcagcagcaggcgcagcagccacagcaactggtgccgctgctgaaacaccaaatttctcctctagctctttgattaattctgataattccagaactgtcatattagcgatagattctaaaatttccccttttgccatagccatttatttctcctgatataaattaaattcagatcaatctgatacgaatcgctttaagccatctatatatatatcggcttccgattacttcttatcacatactgcagcaagcccacgcacaaattttgaaggaacttcattaagtgttctaacaaatttcgcaacaggcgcctgtaaagtaccaagcaatctggacagcaactcctctctacttggtaatgcagcgagagcagcgacatccttaccggacattactgtcccggccatagcaccagccttaattacaaaacgatcattacctttagcgaattcatgaagaacttttgcagtgatcacaggatcactgccaattccgtaagcaagtggccctaccattgattcagctaacccagaaaaaggggtgtcaacaactgcccgccttacaaaggtatttttgataactcggaaataaataccagattctcgcgccttgactcgcaactgagtaagctgcccaacacccaatccacgatactccgctataacgatagcctgggcttctgcaatttgatcactgacctcggctacaattgctttcttttcctcgagattatgactcaaaagactctccccatttagaattcagccaaaaattatcgttactactcataacgatatatttcccatttaaaaatggcgacctgaaccaggagaaatttctctctacctgctttatgggcacaccatctgcgttgggcgcaattttctggaataactgcaaaaacataataatcactttttatgatttacaagtattgacttgattgtcagactctattttcacaaaattgactattcatttataaatttctgctactttttgatgattcactgtgtttcctcatcgctacccagtaaacctgcaaccattcctttattgcaattaagttttcactcaaaaacagcaattagcattatagattgctatttttagataataaaaaccccaacggtctttgacaatctgctgatacaacatcttaacaacagcccaaagccttttattacaactaattaattattccagcatggtcaactcgcacacctgctcccatggtgcttgaaatggccattttacgtagataaacaccttttgatgttgctggttttgatttattcaatgcatcaaccagtgctataatattttctctcaaggcatctacactaaacgaagctctacctacagtacaatgtacgatacccgccttgtccgctctgaattgaatttggcctgctttagcattcttgaccgcacttgccacatcaagtgtcactgtccccacttttggattgggcattaaaccacgaggaccgagtatctgccctaattgaccaactattcgcattgaatcaggacttgctattgccaaatcaaaattaatctcgtttgctttaacttgctcagcgagatcctcaaggcctactatatctgctcctgcatctaacgcttccttagctttatcaccttgtgcaaaaactgccaccctcaccgtcttacctgtaccggatggcaagaccactgcaccccgtactacctgatccgatttacgaacatctataccgagattaattgcaatatcaactgattcgtcaaatttagccgtagcaacttctttcaccaaagccaaagcatctgttaggggatataatcgatcacgatcaattttttgagtaatttctttgtaacgtcttgaagatttggccatatcacactccctctacttcaacacccatacttctggcgcttccagcaattgttcggatagctgcatccatatcggccgcagtaagatcttccattttaattttagcaatttcttctacctggctccgagtcagcttacctaccttatccacatgaggctgggcgctacctttactcaaaccggctaatttcttaattaaaacagatgcaggagtcgtctttaaaacaaatgtaaaacttttatctgcatacgccgtaataaccactggcacaggcaatcccggctccattttttgggtagccgcattaaaagctttacaaaactccatgatattcagttggcgttgaccaagtgcaggccccactggcggacttgggttcgctttccctgctgggatttgaagttttatataacctattattttctttgccaaaatattctcctttttaggtccaaacgaatattagctacaatactctccctcttttttgctacaaactactccgaaaccacatctcccacaggagacaatcgcccatatattgcgcaattatattttatcaacctgatgaaaatccaactcgacgggcgtagggcgcccaaaaattgatacagacacccgtaatttatttttatcgtaattaacttcttcgacgtttccatggaagtcagtaaagggcccttctttaacacgcaccgcctctcctgcctcaaaaattacttttggcttgggcttttccactccctctcttacttgattaaatatactttctatttccttgtgactgattggaatgggctgcatagatgtccctcccacaaaacccgttacttttggtgtgcctttaaccaaatgccaggtttcatcagtcatttccatttcaattaatatatagcttggaaaaaactttctttcacttatgtttttttgaccacccttgacttctaccacctcttcaacaggaataaggatctcaccaaatttatcttcaaacttgtgcagcacgatccgatctcttaatgccttctttacactcttttcaaaacccgaataggtatgaacagcgtaccattttttactcatattcctcccggaacactttcacccttcctgatccattacatatttaacgatcaccatcaaacccgaatcaacaatccataaaaaaaacgccatcgttataacaaacgcacagaccacgccagatgtctgaagtgtttcctttttggtgggccaaacaaccttttttacttcttctatcgaatctttaaaaaatgaaaatagttgctttccttgtatcgtaaataaaataacgaccgtcgcgaaaaccaaccctaataacaaagctactactcttaccactacagggctatcttgcaaaaaataaaagctgaaaaagcctgctgctcctaatagtgctgctattccaagcttaatcttattcacttttttcgttcccgaaaattacttttaacttaaaaaaatccaaattacaaaccttctttttatttttcagcttgcctgaagatttgaaataaaattattcagctttgcttatatctatactttggcaggccaggagggcatcgaacccccaaccttcggttttggagaccgacgctctgccaattgagctactggcctatcttccaaacaaaaaattgcagactacaaatttatcagcttattttactcgattactttggcgaccacaccagcgccgacggtacgtccaccttcacgaatagcaaaacgtaatccatcactcattgctattggtgcaatcaaattgacattaactgatatattatcacctggcatcaccatttcgacgcctgccggcagttcaatggagcctgttacatcagttgttctgaaataaaactgtgggcgatatcctgcaaaaaatggtgtatgccgaccaccctcttctttgcttaacacatatatctccgcagaaaatttggtgtgtggcagtatactacccggcttagccagaacctgaccacgctccacctcttctcgcttggtacctcttaataatataccaacgttgtctccggcctgcccttgatccagcaacttccgaaacatctcgacaccggtacatgtcgttttgattgtaggtcgcaatcccacaatttctatctcatcaccaaccttgactataccgcgctccacacgccctgtaacaacagttccacgcccggagattgagaacacatcttcaacaggcataataaaagccccatcaatcgctctttgtggctctgggatgtatgaatccagcacttccgccagcttcagaatagctgcttcaccgatgtcacctttatccccttccagcgctttcagtgctgaaccaataataataggtgtatcatcccctggaaaatcatacttggataacagttcacgtatttccatttcgacgagctcaagtaactcagcatcgtctaccatgtcagccttattcatgaagacaatgatataaggcactcccacctgccgcgccagcagaatatgctcgcgtgtctgcggcatgggtccatcagctgctgacaccaccagaatagcgccatccatctgcgccgctcctgtgatcatattcttcacatagtcggcgtgacccgggcaatcaacgtgcgcgtaatggcgtttatctgtttcgtattcaacatgggatgtgttaatagtaatcccacgtgcacgctcctcaggtgccgaatctatctgagcatatgacttggcttctccgccaaatttcctggtcaggatggtcgtgatcgccgccgttaacgtcgttttcccatgatctacatggcctatcgtccctacatttatatgcggcttcacccgctcgaatttacttttcgccattacgtctgtttccttttattaatgcttgtatcagtaatctaataacctggctgcagcataacttggtgcccatggccaggattgaactggcgacctctcccttaccaagggagtgctctaccactgagctacatgggcgtatagaacaagaacaattcctcgccgtaatgttgtggagcgggtgaagggaatcgaaccctcgtcgtaagcttggaaggcttctgctctaccattgagctacacccgcttgtgcccggttcacctgccttacatttaaataaacagccgcactatctgcaatgactagtgcgatcaaattccagcattacacacatctctgatttttgttaccgtgactggtggagggggaaggattcgaaccttcgaaggcagagccgtcagatttacagtctgatccctttaaccactcgggaacccctccaaaatagcagggcattatgaacgcttagcctgatcaagtcaatgctatagcatgggccaaatacacaaaatttttgatactgttatcttgattgtttttcatatcaattcaatgcggatcgaatattattactcaaattttcgttcaggatacgcggcgtgacgaatatcagcaattctcgtttatcatctcgctttgcggtatttttaaataaatttcccagtaacggcacatctcccagtaacgggatctggttacgatcccgcttttcgacctgttcaaatataccgccgatgacaactgtgcccccattctctaccagcacctcggtgacgatttgcttggtatcaatggctgggccagccggtgtgctttctccgcgagtatcctgattaacctgcaatttcatgatgatattatcatcaggagtgatttgtggcgtaaccttgaggccaagaacagcttttttaaactgaatctgtggccgtgtcacactaatagtctgaaaggggatttccgtaccctgctcaatactcgcctccacacgattagccgtaaccaggcgcgggctagcgataatacggccctgactatccgattccaacgcagaaagctccagattaatcaatgtgccgttgttaatcttaatcaagctcaatccgagtgcagccgggccacccgcgactcctgcaagcgcagccgccggtaaattgacgttaagattatccccaccagacggtgatatcgtaccagcagccaattcactggaattgcccaaattcccggaaatacccagtcgccgtccattagtctgacttccgatccgagttgcgttctgcaccccaaaacgagctcccaggttacggctgaatgtatcggttgcctcgacaatacgggtttcaatcatgacctggcgcacctgggtatcgagattggccacatgccgagccacctctgcaagcctggtgggaatatcggtaacggtcagcgtattgctgatgtcatcaacctccaccgaaccacgttgactcagaatacccttaagcggaatcgaactggcagtccgataattcagtctgaatgcttccgtttgcaacacttccaactcggttatctgctgattctgctccagctgtaatctttcacgagcagccatttcttcccgtggcgcgataaaaatcacattacccaccctgcgtttatcaagatcgctcgtttgcagcacgatatccagcgcctgatcccagggaacatccttcaaccgcagggtcagattacctttaactgagtcgctggcaatgatattcaaatcagtaaaatcagcgataacctgaagaattgagcgaatttcaacatcctgaaaattaagtgaaagtttctcaccagtataacctccatcaatcagctttttgtgaatgggcatatcatcaccttcaactaccgatctgacttctaccgtgaaattggttccggtttggtaagatgtatgctcccagcgccctttcggctcgataatcatctgcacgttaccatcccgcgcgatagtctcaattgtctgtactggtgtggcaaaatccagcacattcaaccgccgctcaagattgggagggaggtaagccttcatgaactcgataagcaaccttcctccctgactatgcacattgactaccgcacctggttgtgacagctccacctccaccctgccctcaccttgtgtaccgcgatgaaaatcgatatcccgcaagcttaattgtgcttcacctcttactggcatggaagctgaaacggcggcacgattgagtgattcccccaatttattgccccggagcgctatcagcaaatcgttaccttccgtgctgatttcatacttaactgcttttgacaaattcataaccagacgggtacggccctcggcaggcacaacatccatactctttattacaccacgacctgatatcttgccagactcgcccagagcgctggcgacctgctccagatcaaaataaagacgatcgggatcattcagcaatactccggccggtagcgtcgcaatcggtcgatccaatgtcactttaacaattaaacgaccatctgtttgggccgtaatatccagtgcacgaaggatatttactgacgttgatgcagctacaacctgaacggtccacgcaaccagcagaacacacaccgacacacattgccaagctcgatgagcagccatgattatgcaactcttgcgccattgatttcccgttttccaatctatcatttttgctcctgagtttgcagcatgagtacactggcccgttcaacccattcatccgcactacctcgcgtaatctctctcaatttgacttcctcctcggaaacccttgtaatcaaaccgaaattctgcccaaggtaattgccggttttgacacggtgcacagaattatccggtgccttaaccagggcaaaaacgtactctccacgccgtagcgaaccgaccatagcgaggttttccaacgggaaattttccagtgcctctttgggacgtttcagatcaggctgcaactcatctcgatcagacttttcctgcttgtttcttcgattactgaagggatctggaatttcgaaagcctgataaacaaaatgcttcggtggcttgatttcaggcaggggatctacctttcctttcaatcccgttcctgattccctgacgaaagactccagatcttcatagccctcctgagtgcatgccgctgtaaacagcaccaccatcacagtcatccagaagcggaattgatcgttcatgacgctccctttgcattcttctgtttgtttttctctgtcatttcccttttgcgctctgcaatttcctcatcatcgagataacggaaagtttttgccgttgcgttcaatatcaactggcgatctttcccgggaatgatttcaatatcctgcaacgtaacaatacgcggcaactgggccacatcgcttgcaaaagcaccaatatcgtgataattacccgtcaccctgacagaaactggcagctcggcatagaactcacgaactgtttccttggcattgggtttgaacaactcaaattgcaatcctcgtcccaatccggcccggttaatatccaccagcaacgcatccagctcggacttgttaggcaactgtttcagcaaggtacccagcgtttgctccacctccgccaattgcacacgaaaaagatcaagattgaccgcactattttttttggctataaaagtagctttcaacgtatcttcttcttgctgcacctgttccagtgcctcccactgctcctcccaatccagaaggtaacctgccaccatgagggtccccaacaatgacgcaagtgcacccgccttgagcacaactggccagctgccaggctcattgggattgacatgacgtaactcttccagcagattcatggttgccccgccgttgcagtaatttttgctgccatctcgtttcttccggaatggccatcctcttctggcaactcggtcaatttgacattcaaatcgaattcactaagcctgacaccactttcggtagctgccttaatttcaatcaacaatggcgattccagccaaggtgatgcatccagatggcgcatcagcgtcgagatcccagcattggactgagcgtaaccagcaaggtgcaggtgctcatttgtttgttttaagctcttcaggtaaaccccctctggtaactgcctggctacctcatccagcatatgcactaccttgatgcgatttccctgcagcgattcaacgatctccttgcgtgccagcatctcctggattttttccttaatcgattttatttcggtaatttgccgatcgagaacagcaatctcatcccgcagatactgattacgtccgttctgatgattgattttatccatcaccatttcatgtactccccagataatcagcactcccaggccaacagtaagacctgccagtacggcaaactgttgctgaagcgccttacgcttaagttcacgatgtggaagcagattaatacgtatcatgatggatcaaatcctcgcatagccaggccgctggcagtcagcaacaccgcagcatccatcttcagctgccgcggtgcaatccggccggataactccataccggaaaacggattaatcacctgggtaatcaccccggtacgttcagatacgatttcctcaagacccgggatcactgcacaccctcctgacaaggagatatagtcaacctgagtatgttgagtggaagtataaaaaagctgtatggctctagccacctccagcgcagccgtttcacaaaaaggccgcaatacatcattttgataactctccggcagcttaccgttgcgcttggctgtctcggcttcttccggagagaaattgaactgattctggatttcttgcgttaactgatttccaccaaaggataaatcccgcatatagatagaggtatcatttaacagcacattaatccgcgtgacgctcgcgccaatatcaatgagcgcaaccaccttatcttttcccccatccggcagctgactgccaatcgctctggaagaaatagcctgggcagcaaattgctcgatatccatcaccattaccttcaggccggcagacattgctgttgccacacgatcttccactttgtctttacgagcagccgccagcaacacctccacttcttccggacaatctggagccggtccaatcacctgaaaatcaagattgacttcatccattgcaaacggtacatactgattggcttctgtttcaacctgaaacaccagatcatcctcccgcaaacctgcaggtacgttgattctctttgtaataaccgatgtcagcggcagagccataacaattttcctctgtcgcgttcccattcgtttcagggcatgctggagactgtcactcacctgttcaatctggttaatacctccatcttgcagagcatccatcggcaatggttcgataacatagcgttccaaacgatatgattctggcgctccactttttctggataattccactaacttaattgaggaagcgccgatatccacccctaacattcgggaggtacctgtcagcatgccaaaatggatatcaaaagatttcttcagtgccatatcagcttttatttgcataatgtttcgaccagaagatttttattcggatgcaatacttcaactgaagccgattctgacaggtaagtgaaaaaatcaattcatgcaataacagttgatataccctttataatcttgcgctggatcatttttttacccacacaacactctgccttttaatgttattccgctggcttttccgtttcctcctaactattctggctgctggtttacttgcgacgttgctcgtgatatttgccgccctggttacgctaccttctttacccagtctcgatatgctgactgattatcgtccgaaaatacccttacggatttacagcgctgatggtttgctgattggggaatttggtgaagaacgcagggattttgtaaaaataaatgaggtaccagaatctcttaaacaagctgtgctggcagctgaagacgaccgtttttaccagcattacggggtagattacataggtgttttgcgcgccatttattcaaacttcacggcgggcagcaccctccagggcgcaagcaccattaccatgcaagtggcacgcaacttctttctgaccaaggaaaaaacatttaccagaaaattcagcgaggcattactggcttttaaaattgaacacagcctgggaaaagatcgcattcttgagttgtacatcaaccagatttacctcgggcaacgcagctatggctttgctactgcagcacaatcttattttggtaaaaagctgtctgatattaatttggctgaagcggccatgctggccgggctccctaaagcaccttcacgctacaatccgattgccaacctggagcgcgcaaaaatacgacaacaatatgtgttgcggcggatgtatgagctcaactatatttcagccgaccaactcgcgctagcaaagaaaacttctattgcaattcatcgccaggtaaaagtatttgccatgccggctgattacgtcgcagagatggtgcgtcaggttgtttacaatcgctatcatgaagaagcctatacccgtggaatcagggtttataccacgctgagaaaatctgatcaggaagcagcctaccgtgcgctgcgcaaaggagtaatagaatatgacaccagacatggttaccgcggcccggaagcattcctgaaactgccaaaagatctcaaggatcatgaagcgctgcaggatatcatgcaaaatatcagcaacagtgatgatattttggcagccgttgtcctgtccgtaacacccggtgctgttgaggcctccctcaaaaatggggaaacaatccggattacgggagatagcctgaaagtagccagcaggtaccttggcaaagatccaaaggttaccgaaaagcgaatacgccccggtgctctgattcgagtaaaaaagacagaaaaaaacagctggcaaattactcaattacctgaaatagaggccgctctgatcgcaatagatccaaacaatggcgcgattcgcgcattagtaggcgggtttgactataacctcaacaaattcaatcatgccacccaggcctggcgtcaacccggatcaagtttcaaaccgttcatttattccgcagcacttgaaaaaggctttactccggccaccattattaatgacgccccactgtatctgggacctgatcagactggtggcaaggcttgggaacccaggaattatgacggcaagttcagcggcccgatcagaatgcgcacagcattaactcattcgaaaaacctcgcatccatccgtattcttcaggcgattgggctatcctacgcacaggactacattacacgcttcggcttcgataaaaaacatcatccagcagttcttcccatggcgcttggcgccggatcggtcacgccgatgcaattggccgttggctacgccactttcgccaacgggggataccatattcctccctacttcattgaacgaattgaggatgagcacggaaaaattattgagcagacacaccacaccactgcaagccagaacgccaaacaagttatagatccacgcaatgcattcctgatgacaaacatgatgcaggatgtcgtccagagaggaactgccgcccgggcaagagcacttggccgcaacgatattgccgggaaaacaggaactaccagcaacgccttcgatgcctggttctgtggttaccagaaagatctggtggcggttacctggctgggctttgatgatcccaaatccatgggaaacagagaaaccggaggacaggcagccttacctatctggatcaactatatggccagcgcacttaaatcaatacctgtcacaaaaatatctcctccaaaaggtattgttacggccaagattaatccagaaacaggcttgagggatccattcgggacactcaatgaatactttttccaggaacagcttccgccggaaacagattattctttccaggaccctggttttacggatcaaatggaagactggctgttttaaatcagagagcagtcgagtgcaggagtatttgtcgcggttaaccctcttctaccagagctccttaaagccaataaattcagcaagatagatgcaacgaacaactgccttagatgtccgtccagatctggccgctaaaggcggtatggtgaaggaagttcaacattcagcagcttcccgattgaggcttccttgaaccaggaaaattctttgaagggtacgcagacttcccgaaaaacggcaagcttagcaaaacccgtggtctgccccctacctctattactggcctattattctgctaacgttctgatatgtgcagtcacacttcttcccaatgcgcccaacgcatatccgccttccagcactgaaacaattcggttttgtgcatgtttttcagcaatagccattatttgcctggtaatccaaacataatctgcttcaaccagatttaattgcgccagcgtatcttcccggtgggcatcaaacccagccgaaataaagataatttccggtttgaatgcttccagtgccggcagccaataatgcgttaccgctacacggaacgcttgtccattcgtatgtgcagcaagcggtacattaataatgtgatcacccccgctatcagtgccgcaatacggataaaatgggtgctgaaaagtggagcaaaacaagacacgcggctcatcctgaaaaatatcttcagtaccattgccgtgatgcacatcaaaatccacaattgctacacgttgcagactatgatgcgccaaagcatgtgctgcgccaatcgccacattgttaaaaaaacaaaatcccattgcctgattgcgcgttgcatgatgtccaggtggacgaacggcacagaatgcatttttcacctgcttgtcgatgaccagatccgtcgccagaacaactgcaccggctgcataataagccgcttccagggtaaaaggattcatcgcagtgtcattatcaagataaaccaggccttgctgtggtgcagctgatttgatctcatgcacatagctttccgtatgagctcgcatcaactgatcatcggttgcacgtggcgcttcatattgctgtaaacgtggcagcgtatcggtggcaacaagctgttcctgaatggccagtaatcgttccggacattctggatggccatgtttcatatcatgcttcagataaatcggatgtgtaacaaaggcagtagtcatggaaaaccttcacaagggatgaaggctcgggcacttacacaacagattttacagtctcgcagctgggcggtccgtggcagatagtcaaagccatttgctgctacccacagcaacagatgagtatccagcaaaagcttcatatgccctcttcaaatagccttgcgatttccgtttcatccatccgatcaaaatcatccggcacatggatttacccagccataaaaccaaactgcttaatctgagaaggctccgatgcccggagcgcaacaaccttggccatcggtttgccagccttggcagcttgttcccccaaccgggataattgagttttaacgtcgtgaatattgtatatccgcatcgtgctcttccaattaaacttagttcaactaacttagcttataccaacttggtttctcgttctatcctgtacttgtacattcgtttggaacagatgtattttgaggggatagggcgcttgcgaaatggtgtagccgctcacagcaatccagggccattgaagatacgcaaatcggcgcaccaggtagattaattcacgtgaacaggctcaatatgaaatttcaggttaagcgctttgataaccttaattactgtagagaattccggatttccgtcaggagacaaagccttataaagcccttcacgaatcaggccggtttcacgagcgagcgagccaggtcattctgcgggcacgggtaatatcacctaatgcagcacgaatgagactgccgtcacccggatcttcttccgtgcaggcctcaaaatacaattttaggtcttcatctgttttgagctgttctagccataacaggcaatccaaaattgcgtatcttttgcctcaattaaagtactgtggcattccacgcataattcatggcaccatcaaataagccagtgctgacggctacacacatacgagccatgagctcacctcttaattcaggtggtatttctcgtagctctcttgcaaatctctccatgcgtactcgatttcttcggtgctcgccagcacttctcgtggaattccaagcgaagctgtcagctctgctattgctggaagaatagtcgtcggaagcgacggtaatactggctcttccttttttatgagatcgctcatatattccttggtttgaattctgggtacagctaacgcaatataacgacattctgcccaataaccccgcatgcaatgtcgtataactctgaaacaggttaattctcatcacgtattccaattaaatattcatccgacacgacaattgatcagcttaaaaaccacctgaccagatacaagagagaataaggtgtaatgctgccgtttaagctctgaaaataggatatatttcatgagttaccgttaattttatagcctgtgatctcgcgagaacgatagcaatggcataagtgaagtaaattccccgtccttgcgaggaagcgcagctgacgaagcaatccagtgtcttcgttaccatcgccgcttcttgatcctgatggatgtctggcgcgattcgtcgcagccatggcttgaagaaacgggcgtgatcggctcctgtgaatcaaagggccaggtcccgaatcaataacgctcttcatatttattttcctgattctggacctggcctcgatcatgtgcattctcgacccgaccctgaccacttcactgaaatccaactttatgcttcttgacaggtgctattaacaggtgctataaactggtcaaaattctggaggcagtcatgacaatcaagttctctgaagatgtaattcctctttcggatttaaaagtcaatccgggtcgcgttgtaagccaagttaaagaaactcacagacccattcttttaactagtcgtggccgaggggtggccgtagtgcaagaccttgatgaatatgaaaagagccaggaagagctggcttttgtcaaagctattgcccaaggtcttatggacatcaaagagggcaataccatgtcattgtctgaggcgaaaaagcgcttaggcatcgaatgaaagtcagcatttccaatgctgcctttaatgacctggaaaacattatcagttattacattgaagaaggtgttcctgatattggttccaaatttgcccgggaaataatcgagcatattcagattttaaccagccacccggacatgggcagaatagtgcctgagttccaactctcccatatccgagaaattatctttgctcctttcaggatggtttatcttagggaaaaaggcgccataaaagtgatccgtatttggcgcagcgagcgactgcttgttttaccaaccgaaacataacgattaaggttatgtcgtgatcgcgaagcaaacgcatggtttgcaatgatcaggttcagatccagaatcaatagctcttgctacacactcgttcgattatgcggcattgccaagccgcaacccgaccccgaccatgcgctttccttacgaatgcttaagatcgcgatagaaattttcgtgcggcccgactgcttcgagatataccagatacacagcctcatcaatactgtaaccgagcagatacaactgattttggctgtggaatttatagaccaggagctccgccagatcctcttttttacactcgcctattgccggcctggctgccacgacctcgatcgcagcatcaacgtcccgtgcgacattaccgtgtaatttcttataggcgcgggcgaatcttcgggtttgcttaaccccgtagctcatcagcggccgaccggggtacaaaatctgtagcctcgctgcgaggctcagccatcgaagccagcgattcagcgataaaactcaccggcagatcaggattatccagtgcagcacgccccaccctggcccagtactcgatctgaccggcgatggtacggtgctcaaccagggcctcgctgcgtgcctgttcatacaacgtctgatcgatacgaatagatgttgaagtattcatgatgacctccacgcttgccaaaatactcactaccatcatcttaccacaaatgtggaaaggctgagtttcgaggtagattgcttcgcacttttggcataccgcaatgacaaaatagctgtctttcaggccttcaaagtcagagccagaatcaataacgcttaccgtacttattttcttgataccaaacctgcccctgactatgtaacctcactgggatcaatcagattcacatgtgctgattattgtgctatcgagcttttccggtaccaggcgataacccagcgcgttcataatcgaattaacattatcgaatctggggttgcctttattggacagggcatgttgaactccctgccgcgtcattccagttttttcagcaatgtgactgatgccttttaccttggcgatgacacgcaatgatgccagcagggcagccgaattatgatcttcagcatactcatcaaaaatctcatcaagatatgcgtcgatttcttccgggtgagtgcggaaatactcttcctcaacctctctgaattgtcggtatgttcgtttagccatgatccttgtactcctgccagtatgctttcgcggcttgtatctcccggtcttgactatccttgtcgccaccacataacagaatcaccatatgactggccgcttcaccaaaatatacccggtagccggggccgaaaaatatccgcagttccgaaacacctccaccgaccggacgacaatcgccgtatagcccttgttccagcttgccgatgcgtctcaaaatgaagcgacggccccttttggtcgcgcaaactatcgagccactctgtaaaaggctccttgcctttatcatcctgataaatgatgactgttttgggttccgtggcctgtaccatttctttattttttgaccccatcgtcgccaaatatatttggcaatgcattttatcagaagcgctatatctgcttaacccataacatatccgtcgagggttccaagggcacaagtcaaacagtcaaaggattcgggatcaatagcgcttgttatacttatttttttgatccgcgacctgttctcgaccatgcgggcgacacggcataactactcgtcagaataaagcggtaagcttattagagactgtggtctgtccttcgttatttgcaagctggtgtggaacggcgggtacagcgctgtgttatgcgtgaaggggttcggttttggcaacttcatctttgattgtctgcgcggcgtcccgtagatctaccgctcgctgagcgttaacccaaaattttgcagcattgccaaaaagtcgcgccaatttaagcgccatctcagggctgacagcacggtgctcacgaagaagctcattcatggattggcgcaacacgcccaattttttgccaaaattgaaatcgaatattgccctttccgatcaccactcaaaaacctgttcaaagcaagaataattatctttaaagctcagcgcttaatccgccccttccaatagtatggatgacggcgctgatgtgccaccgcgactaccaaaatgaattcaacttctatcgtatagataagagaaaacggaaagtgtaaaagcaaaccgcgtcgaagtttatttgctaccacccctcctgattttgggttatctcggagccgatcaattgtgcgctgaatatcatctaaaaactcagcccctaatccgcgcgcctgtctttcgtaaaacagcatagcctcgatcatttcctcttcagctggaggtaggtatcgaaaatctatcacttaagacagtcacgcgccctcagcatcgcctcctcccctggaacagatttgagtgctcccgatttgtaagcctgatatcggcgctgcgcctcttcaagccatatccgctctgcatcgtcatccaggctgtcatccaggtcctcaatcaaggtacgtgctaatgccgcttttgttcgaaaatccaaagctctaacttccttttcaagtttcttgaaatttgtagtcatagtaataattactcttctggatgctaagacctatcgtgttggatcattcagtttacccaatctgaaccgccccgggttttgaggaggctgtttggttaaagtcaagccaccggaatggcttccttggcgaattgcctatagtagtttacctcagcttctgcgggagggatgtaaccgattggttccagcagccgctggttgttgaaccaggctacccattccagcgttgccagctccacggcctccctggttttccagggggcgcgcttgtgaatcaattctgttttgtacagcccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggccatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaacccgatccagtggacacggcagcgccttgtccggaactgtggtgcgcacaatcttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccactgtatttgcggcagcagttcatcatcacgcaggacgcgggcattgcgcaaagccggattacgctgctgcgcggaatatcgccgataccctgatgggacgacctgtaaaaccttgcagatcggctcgaccccatgggcgtcgcggtgctggtcgatgaacgatctcaggatttgagtttgcggtcgagctccgcccgagcgaaaaaagcactggccagcttcagaatctcattcgccttgcgcaattcctttacttcgcgttccagggctttgatgcggtcgcgctcttcgctggtcacaccgtctcgcaagccggtatcggtttcgtgtttgcgcacccattcaagcaatgtgtgggctgaacagccgatcttcggcgcgatggattcaatcgtcgaccacaacgagggatactcactgcggtgttcctgcaccagacggactgcgcgcgctcttacttcgggggaatatttatttgatttgttcatggctccatcttctcagatagtggagcctcctcaaaacccggggcggttcatacagcaccatctatcctctcattcgagcgtacaccgcttggcggcttgtgcccttgtgtcattcaatctacgcttcgcatatcttgaattacttcgggtgactgacgctcaattcgcgaccagttagcgatcacttacgttagagcatttttggtttacttgtttacatatccacatgaagcgaagtagttggcacacccccccggagtgaacagatccaacactttgccgatctgtgcccataaggcatccatggttcgtttggcggctttgcgtaatagagctttgagtttggagaatgaatcgtcccgggttatccgttgggtgactggagggttcgccatctgatgcagcaagccagcttgccagtaaagtatcggaaggagtatcaggagaaaactaaccctcattaccaaccaccagggtttgagaatcagctgaatcgacccttcgatggggtcaaactaaatcaagtctacgttggggcagaatctctcttgatacccggcaaggctggcagtatctggcgggtcccgatggagtggatcccgtcacgggcacgtggcgggacgtggcaagccagtgtttactgccggttatccgttacgcctggccgttgaacaatacgccctgaatcttccccagcgcacccgcaattcggatggcttcttccgaaggaatctggcgaatgacttcctgcgtttgcatatccacaattctgaccacggtcttgccggtatcttcatcaatggaaaatttcaggttctgcgttaacgtctgggtgaattgctgaatctggttgacggctgcttccacctgctctggttgaatcacatcatgctcaatcttttcggcaacaggcggttcttcacgaatcgaacgatccatcggtggcactggcgccgctgtttgtgtctgcgtctgtaacaaatcagctactacactggtgatatgcatctccatgttccctctccttttctcaattcattcactctaccaacccctctggattgccacggccccaaagggccttgcaatgacaaagtatgccgtctttgccaagcacttgacgggaaaaaaaccgccattgcgagcactggtacgaagccacccaccccgtctttgcgaggaagcatagctgacgaagcaatccagtaaccatcgtcaccattaacagcaatccggtaactacctgcatactggatcaccgcgtcacgttgctcctcgtgatgacgagagaaatgccgtctttgcgagtcgcgtaagcaacgtggcaatccagaaacgttacggaacaatccggccctttcattcccataaccactactcacacaatttcctcatacaaatctcgccaatccgggttttgcgtttcaatcaaggcaagtttcctggcgcggctaccggccttgatctgcttctcccgcaaaatcgcactttccattgacccatgctgctcataccagaccagcaacttgcactggtatttcttggtaaacccttccaccacgctttccctgtgctgccaggcgcgttgtacaagatcagaagttacccccgtgtacaacgtaccattacgcttgctagccatgatataaacacacggatccttcatctttacctattgctgacaaaaaacaccatcctggcgttgctgctggatcgccgcagccttgtcaggcttcgcgatgacggagtgtgccgtctttgcgagcacttcagtgcgaggcaatccagtaacaatctgcgttactggattgcttcatgcccgtggcattagcgatgacgggcgggaggcttatctcaacagagacaatacattgttgggcaatgcattggcctgggcgagcatggccgtaccagcctgctgcagaatctgcgcacgagtcagggcagcagtctcactagcgaaatcggcatccataatacggctgcgggaggcagacaggttttctgaagtagtctgtaaacttgagattgctgtctcaaagcgtgattgcaaagcaccgaagctggcacgctggccgttcacagaagccagtgccgagtcgatgatcttcagggccttggtagagccttcgacggtggacacgtcaatctggttgaccgcgttcagcgaagagttgccggccgccacataagccgaactaccgcccagcgagaaacccttgtcggagctgaactccaccgtgccacgcgacacggccgttccggtagcaacaaccatcgattgcgccgccgtgaaggtcagcgacgatgcggttgcgtcctgggaagctagcgatgcgacggctaccgcagacttgttggtcagctggatgtcggcgcctgcatcattcgtcaggatgacgccatcgcccgcactattgagcttggccgtaataccggtctgcgacgacacatcgttgaaggccttcacaccttcggccaggtcggtcgccgacttggcggagaagctgatcgttgcagccgtggtggtgttgtcacccttgatctccagcgacacggcaccagccgtggtgatcttgaattccgatatgttgcgcgccgaggccgtcacgcccgtggtttccgccgcgccgttgaccgctgcggcaatcttggccgccgtatcggaagcatccacattcaaggtcttgctctgcaggccattcacgatcaccgttgcgccagcagtagcgggcacgcccgtaccggcaaccacggtattagccgatgccttgagctgtgcaccataggtggtggtacggaaattccccgtggtcgccgtaatagtctgattggcgttggcgcccacctggaaggtggccgagccaaacgaaccatcaagtaacttctggccattaaactccgtggtctgggcgatgcggtctagttcggataggagttgcccaacttcagcttggatagccttacgatctgaagcactgttggtcgcgttggctgattgtactgacagttcacggatacgctgcagagcattaccggcagattcaagcgcactttcggcagtttgcgccagcgaaacaccatcgttggcgttacgcgcagcctgattcaatccgcggatttgtgaggtcatgcgctcggagatggagagcccggcggcatcgtccttagcgctgttgatgcgcaaaccggttgacaggcgctgcaaggcagtactgagtgaaccttgcgatacgttcagattacgctgtgaattgagtgacgcaacgttggtattaataacttgtggcatttttatttccccttccgagaagtactttttaaagtatcgtggcgctctttcatagcgagcccaccatcgttttccggccctgatctgcttctgtgtgcagagtattcaaccgccgttgagagcagtaacggaccgcgtaaggaaaggtttagaggaataaatagaaaaacagcttttcttttttaaccagtgaaaactggaactgaagggaaaatgggcggctatttaggcgtttgcctaaaaaccgccattgcgaacgcccagcgtgaagcaatccagcggcaatgttaacgaaggcataaggtgatgtgccctggtgcttttctggattgccgcggcccgccacccgccacacttcgttcgcggtcgcggctaaaggctacgcggctcgcaatgacatcggtgggtgtggattgtggtgttcgggtgttgctgtcggtggtgacaatggccatgggttgtacgcggcacgacggtaggaaaacaacctccgtctttgcgaacgcgtagcgtgaagcaatccagcagcaatgataaggaaggcactggattgcttcgtcagctgcgcttcctcgcaaagacggcaatttttatcactggccggtactggactgctacctgccacactacactcacacatgtgttcgctttatctattgctcagcttgagtaaggtaactgaatcgtcctgggttttgaggaggctgtttggttaaagtcaagccaccggaatggctttcctggcgaattgcctatagtagtttacctcagcttctgcgggagggatgtaaccgattgtttccagcagccactggttgttgaaccaggctacccattccagcgttgccagctccacggcctccctggttttccagggggcgcgcttgtgaatcaattctgttttgtacagtccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggcatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaacccgatccagtggacacggcagcgccttgtccggaactgtggtgcgcacaatcttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccactgtatttgcggcagcagttcatcatcacgcaggacgcgggcattgcgcaaagccggattacgctgctgcgcggaatatcgccgataccctgatgggacgacctgtaaaaccttgcagatcggctcgaccccatgggcgtcgcggtgctggtcgatgaacgatctcaggatttgagtttgcggtcgagctccgcccgagcgaaaaaagcactggccagcttcagaatctcattcgccttgcgcaattcctttacttcgcgttccagggctttgatgcggtcgcgctcttcgctggtcacaccgtctcgcaagccggtatcggtttcgtgtttgcgcacccattcaagcaatgtgtgggctgaacagccgatcttcggcgcgatggattcaatcgtcgaccacaacgagggatactcactgcggtgttcctgcaccagacggactgcgcgcgctcttacttcgggggaatatttatttgatttgttcatggctccatcttctcagatattggagcctcctcaaaacccggggcggttcataatttagaggaagatctcgatttattccgaacacttcatctaccgcatgcgttttctcgatcaaaatccttctcctatatagaacttgtttttagtagggtcataacgcctgagcttagctgcgtttgaggcgatacctgtttttgcagcagcaaaaatgggcagcgggttaaacgtccgctgcaacaatttgttagccagcatctccacctcccgccgggaacacttctgcaatcttgtcagtcaggccggtaacaatggcatcaacaattggcgagatgtattccgatgcgtttttaagcaaagcttcaccggtatccgatgcaactttacctgctaccttcttcaataccgctttcaaaacccctttgaacgacgtatccggagcccctgccgaaactaacgcggccttaacaggatctcgctgatccttaggaatgtagaattctatcaacgcgaccatggcatccagcggaagctttacgatacttggtgagaatgagccgtcagatacatgccccagatcctgtatctttgagcggagatggtctgagatcagaggattctccacttccagaacaaattgatccccggatttttggatgattgggcgttttaatagattccgtacccgagaatccaactcggcgggagtaagccgcctcagttctctctcgtagataagattccgagctttagttctggtaacccgcagttttgaaacgagctcgtatacacccggttcagcagatatggccccaacttcttcaagagctcccaagaggagtaattcaatctcggacttaggcaacgctccgaatgctggatcaagaaatcttttgagcagtgtcttcaatgcacccgctgctcgcgcatcaccaacgtcttggattatgttttctaagtccaaggttatctccccattttctaatgccagctaatatttagtatgcaccgtaagcggtgcatacttctttgtaagtgggtgtataacaaaacgcattattcagtaagattttgaattaaaaaacttcatgaatgaaatatcgccatcttttgttttgattatgccttgctcattcggtcagcttcgcggtggcttgctactctgatcaggagtcaatcaactcttttgaaatttcaaaaatgaggtttcaggtattctgctgcgtttgaagttgatcttaatcaacaagtaaaggaggaattatctgtttattacggtggggacgatggtggctgatagatcaataaccagaatcctgatcctggatgacccattcgtattgaagtggttggcgtgtatgccggctgttcggggatttctggctgtcgattactatccagacggtgtgtgatctgacggtggttggctggatgagcacaagaatgaaagcaagattggcttgttgtgatgcattgcaaatggctgtctggcaacgtcaaccacaagtgggcttgttacccccaccttcgagcgcgctttaaaaaaactacaccctccacagcaatccaagttgaacgaggcagcgcgtgccattactcaccatcctgaaagatctgcaaggcattcgagtcgacaagtccgattatcgaatcagttatgtatgctggcttatcgtattctcgatgaggattgcctgaaactgctgtcctttggtccatccgcacgatgatttttatcgcgatctcaagcagcaagataaataagcttttagaagtaatgagcccatggctatttgccgcgcataaacattttatccagttcagccaggctgatttcaaaccaggtaggtcggccgtgattgcattgatccgagcgctcggttacttccattttgcgcagcagttcattcatttcaatcagcgttaattgccggttagcgcgaacggcaccgtgacaggccatggtggccagtaattcattacgacgggcggcaagcagttgagcgggatcgccattcctgatttcatccagcagagcacgtaccagtttttccgcatcagcatgctgcagtgtggtggggactgtgcgtataacaagtgtggtagcggacagcgtgctcacttcaaaacacagttgctgcaaaagcgcctgattttcctccactgtcgcgatgtcgaggctatctgcgtgaaatgtaaccggtatcagcaatcgttgtgcggataatacttgttgatccagttgtgtcttcaactgctcgtagacaatgcgttcgtgcgcggcgtgcatgtctacaatcaccaatcctttttggttttgcgccaggatatagatgccgcgaagcagccccaacgcaaagcccagcgggggcatggccggattttcatcgctttccccttccccggtttgtcggagttgattctgcatggcagtggcgccggattctccgccggttagaacctgataaaagttaaaaggctgcgccaccctttctgatggcagccgtgcttgcctggggtagttcaacgtcggcacagccggtgtaaaaccggtgcgcgttggatcaacagatgcatcctgcgcacctggccacacggccccaacaggcgaggaggatgctacacccgagcggggtagagccagcgccttgctgacgccgtggtaaataaattggtggatggcccgcgcttcgcgaaagcggacttcggttttcgtcggatgtacgttgacatccacctgttcaggatcaatcgccagatacagcacgaaagcggcatgacgatcaaggtgcagcacatcacgataggcttcacgcagggcatgggtaatcagcttgtcgcggatgaagcgtccgttaacaaaaaaatactgcatgtcgcgggtggcgcgtgaatacgcgggcaatgccagcatcccctgcaggccgatgccggcggattgttcgtccatccaggtagccgctccggaaaattcttcgccaagcacggctccgatgcgctctgcagcctctgccgcctgccagtggctgcgcaggtttccattgtgccgcagcgtaaaggtaatatcagcgtgggaaagtgccatccgccgaaaaacttcttcgcagtgggcaaactctgtagcttctgttttaagaaatttgcggcgggcaggcaggttgaaaaacagatcccggacttcaaccgtagtgcccgccatgtgggatgaaggctccggcgacattaaccgtgtcccctcactgcggatttcccaggcatgtttgccagcgggttgatgactgatgagcgacaaatacgaaactgacgcgatactggccagcccttccccccggaatcccaggctggtgatgctgtgcaaatcctcctggctggcaattttgctggttgcgtgacgtgtgagtgcaagcggcagttcttctgcgggaatgccgctgccgttatcggtcacacggatcagtttcaatccaccctgtgcgatattgaccgtaatttcagtcgcaccggcatcgatggaattttccagcaattctttcagcactgaagccgggcgttcgatgacttctccagctgctatctgactgattaatccatcgggaagtaatttgatcgcgcgcattgaaaaccggggctggaatagaaaaaatatgcggaaaaactcactgaatcggtaattatactgtcaccaagttatgatacgcttgctgtcaaacaggggaaggatgcgcgagcgctccgagtccttctcaataagagcactatttcaagaaccaattattaaaatcatcatgacacaagacgaacaaaaacgggcagtggcacaagcagctctgcagtatgtgcaggtaggtgaaatcatcggtatcggaacaggatcgaccaccaatctttttattgatgaactggctaaaatcaaacacaagattgaaggggccgtggcaagctccgaagcaaccgcagcccgtctgaagcaacatggcattgaggttttgagcctcaattctgttgctgacctcccggtatatattgatggcgcagatgaaattacccggaacatgcacatgatcaaaggtggtggcggcgcactgacacgtgaaaaaatcattgcagccgtcgctcggaagtttatctgtattgctgatcaaagcaagctggttaaggtattgggaaaatttccgctcccggtggaggtgattccgatggcacgcagttatgtcgcccgggaaattgcattactgggcggacaaccagcctggcgtcaggatttcatcactgacaatggcaatgtaattctcgacatacataatctaaatatcatgaatccggttgagctggaaagcacgctcaaccagatcacaggggtggtgaccaacggcctgtttgccagacgaggcgctgatgtactgttgatgggtactgatcagggcgtggaaaccattacgatctaggaacttgttcaatatctcgctgaaaggcgcattacggcgttgaaattgaactcaaaatgctcacatacttcaagtatgctccgctttctcgttcaattttgcctggcactgcatcccttgatcgagactttgaacagattccagggaactgtcgaacttaagatgggtttcttgaacgcgcaggagaaaaaagatggtaaataacgtgattaataaagaacatgtctcaaaaaaatttgatgctgatctcgaagaaatccgcacacgggtattacagatgggcggatttgtcgaggaacagatcaagaacgcagtggaggcattgactgacggtaacgagcacatgattgaacagatcattgacaatgatcatcgcgtcaatgccatggaaataaagatcgatgagctctgttcccaggttatcgtgcgcaggcagcccaccgctattgatttgcgcatgatcatgactgtgatcaatactattactgatctggaaagaattggtgatgaagcgaccaagatcgcccgtatggcaaagctgatctacgctgcagatcgcatgcacatgccgcgttttgttgagatacgacatattgccgccattgccatcgatatgttgcgcaaggcgcttgatgcttttgcccggctggatccgaacgcctccgcagaaatcgtgcgccaggatgaacaggtggatgaggaatttcgctcgatcatccgccatttgattacgttcatgatggaagatccccgcaaaatctctaccgcgatcgaaatattgtttgccgctaaggcagtcgaacggatcggtgatcatgccaaaaacatgtcggaatatattgtctacctggttaaggggaaggatgtccgccatgtatcggcggatgaaattgaacgcgaagtcagtaaataaaccgttcagaaccagcccccgcatcatgcacgcatactcaacgctcgctgccgttgatctgggttccaacagttttcatctgcaggtcgccagggtagaagaaaagcaactctacctgctggataatctgaaagaaatggtacagcttgcagcgggattatccgaagatcagacgctggacgaggcatcacaaaaccgtgcactcgcctgcctggaacggtttggcgagcgtttacggggactgccgtatcatgccgtcagagtggtgggcacaaactcgctgcgtgttgccagaaatgcagcaggttttttgcaaaaagctgaaaatgcactgggctttcctatcgaaatcattgcaggctacgaagaagcccggttgatttttcttggtgtggcgcacagcttgcctccttcggatgacgctctgctcgtcgtcgatattggtggtggctccaccgaactgatcatcggcagccaactgaaatccagcaaactggaaagtcttcccattggttgtatcagctacagccagtatttttttcctgatgggaagctcaccaaagactcgctgaaatatgccgagctggccgcacgttccgaaatacaggccgccaccgctgagttctcctcatcatactggcaaaaagcctatggctcttccggcaccgcgcgcgcactggcacacatcctcgcaataaacggctataacgacagcgatgatgcagaaatcatcacactcgcagggttggaaaaactgcgcgaattcctgcttaaaacaggtgatctcagaaagctggcaattccaggcttaaaccccagccgcagaataattattgcgggtggatttgccatcatgagcgctatttttacagagctgaagatcaagcgtatggaaattgccagcggcgcactgcgtcagggtgtactctacgacatgctggggcgctttcacaaagaagatatgcgtgaagtctccgtacaggaattcatgcagcgctaccgggtggatttgcagcaggcaacccggattgaatcacttgcgattttgcttggcaaacaactcctggcggattaccccgatcaggaaaaagctgagaatgcactgaaattgctttcctgggcagcgcgtttacatgaaatcggcatttcggtggcccataccggctaccacaaacattctgcttatattctcgataacgccgatatgcctggcttttccagaatggagcaatcccagttaggtcagctggtgctatcgcaccatggctcgcttgccaaaaccggggatttccttagccaccccattaaccttgctcgttcagttgccttgcgtatcgctacaattttttaccgcagccgtacccaggttgatttgccagccttgatgctatccatgagtggaaggcgttgcacattacgcattccgcaaacctggctggaacgctatccgctgaccgatacgctactgaataatgaaatcaagacttgggcaaaagttgatgttgacctgcgtattgaaaacctgactgaacatcatcgcacccgatcgggtgcagcctgatagcttatttactgccagcatttggcaatagcttctgctcctgtcactccacctgctcctcgcacacctgtatgagtcaacgacaaggtaccgcaggtatcacttgccatagaacctgtcggcaccgcctccagcgtataactattttgtgttggagtgccttctgcaaaccggatagtatattttgccgtacccgttcgcggtgattgcgtcaccggcaatgcaaaatcgcctcccgcactagtctgatcataacgattagcttcagtgtaattgcgttccagcaattgtgccatttccaacagaatactgctgacctccacccgattaccccgccgtacatgctcctggtaggaaggataggcaatcgctgccagaatgccgataatagccaccacgatcatcgtctcgatcaacgtaaagccgtgatttttcgtatacatccgagccaggttcatttaactggtcctcctgtttactgtatctgtttactgtatctgtttactgtatctgtttccaggatcggcgcggcggcggagcgccgttgctgatcgtcactttctccactgcccctgtggtagttgccgcgatcagatgcgtcaagctaccggcactgatagcaaccgattcactacgaattccatctgagcctacggcagcaatgattcgatcgctaccgtccagcttgccatccccattggtatcaaactgcggcggagaaatcattcccccattttcagcattgagtaataccaaccagttacgcccgcccgcttcgcatggatcgatggaaggaatcagcgtggtaaaaataatccgcccgaaactcagcatcggcataacgactgaacgctcgccctgttgtgtcccttccggaggttgcagcagatcgatataccagccacgtttggctgaccagtctattccattatcggatatggtacgttcaaaaggaggaacaacggtttccgtcaggatggtttgcggctgtaatacactgcgatctgtttctgaaatccggctgccgttatcccagataccgtagagactttgcacctttttatcggtagcgtcaccggaggcgatgaactggccggtgccaaagaaaatcatataccctccctgtttgtggtagcccacttccaaaggagaagtaatcggttgtacctgattgctggtattcctggccgtaaacaagggtacgccaacgctgccagatttatacgccacatcccattgtgccgagctattttttgacaaatcaaatttccagacattgccctgcagatcccctgcgtaaacaacatcaatgatcttgtcgttattggtatccaccagtgccgggctggaaaggccattatttgtactgttattggttggaatttttttgatcagtgtgcctgtttgtagatcaacaatcagcaagtacgccttatcactggcactgttgtagccgttactgatgattgccgcccaggaaccatcattcaatcgtgcaattttcgcctgaccgtgaacgaaacccagatccgcatcggtaaattcccacatcacatctgatgcagagaaattggctggatcggtaatattcaacgcaaatatacttttaccgccccctcccagcgttcccagcaatactgttttccaggcgggcgttgcaccaatgtaggcatctccggcataggcgttgccatcaacaaaatagcgatgcacataaccggaatcagtcaatttacttaattgaggataaacagcagcgggaatgtaagcgaacagctctttgccggtttcagcactgaaagcatgcagcatgccatcattcgccccggtataaaccattggaacacgactgttgttcgactgcacataggcataataggacgccttccctggcgttccgtccaagaatgcgtcgtaaccaaaatccagagtcttgacgaacaatagatcggaattgacgatatcgcccagtacgccgttgttacgtttgcgaaatgtgccgccctgcccaacttctgttgtttgatccccacgcagccaggctaatcgctgtaatccctggtcatcattgaccccatttgtacttgtatccaacacggtctgttgtactgctgaaaatgaagaaaaattagtagcggtaaatgccagaccagcagtaccgttatgggtaaaaatcttgcgactggcatgttccggcaattgttcagaagcctcccattgcagtgggcccagtgaagcatcggattccagattgaatgccagcagctgcccgctccagtcagcactgttgaactttgcctgataaatctgtgcgccagtattaagccggctggtattggttgtcaccgcagcggctgaactgactctggcggtaatattggttagcgcattcgtcagtccagcggcaaaagtggctggatcctgcgcactgaaaaattcaccccgactattgacggcggcatgccaaagatcatcaatcttctcccccttggctgcactggttgttggatctggccagccagccggcccagggccatttggtgaaatgggtagtgttccctcaactcccagtccgacagtaaaattcaccatgtgctgccagaacgccggatctttggcattggttggaaccctgttggccaaatcaggacgcagatcagttttccagtaatacatcgccacatcagccagcgtattactgtgattgtccttgtatggcaaagctggtacatatttaaaatttttgggtggagcattgggaaaatcgttagcaatactgtcgccagcggtattatcaacattgcctacatcagggttagccttattactttcccagtaaccatcggtcattagaatatgataattctgtcgacaaaccggctgactacctccattctttccaggagtatcactccacggtcctttgtcatctgaacgcatcagatattcaccaacccccttcatggcggtgcgtaatggcgtaccggcagccgggatagtgtgcttataaagcttatcgaaaaaattattacgatccactccagcaaattgcctgacaccggtaatgagcgtattcgtggaaacttcgtctaccttatcaccgctcccttcgttgattgcaccaaatgcaactcgcatattgttaccctgtgcggcaaaagctcgccctaccccggcacgcgctaacaaaatacgagaacggtaataggtataccagttagcaaaattctggatttcttcggcataagtacaggtcggtgcagctgcacaatcggtacgaccgggacccccggtataagatttgccagatttaatttcaacctgtgtataactaccggctaaattaatatcaccactacccttatagagaaaataaactgccgggtaaaaagtttgttcctcttctgatgaggttgtagtaccgtcgctctgaagccagtgtgctttttgtttattattctcagtcaggttacggcaacccgcagcagtattgaacgggttatgcggtgcgcaggtaatacttgcattatccatcaacgacccatcggccttactccacggcagatagcgcacagtcgggtcatagtaaatcttattgacatgactggaacgcaacctggccgtgtacttattatccgaattaaagccaactacatagttattgtaactcccccctccatacgtattgcttaccctagggtaaacaaagcgcacatcatttttaatcaatccttccggcatgatttcaaactgcatggaaccggaatcatccaaggtaaaaataacgttgggatcaactgcggtcgtcagaaacagcggtacatctgatagcgatagtgctgcacctgcactcccggcgcgaatcagcatgcaaaggaagcatgccatgaacatccaggctcttatcacgccacgaacagttttcatcatcaattccttttctaccgccggtaagtgctttgtaacaaaacagtagctgtctctgaaccaccaaccccacgcgctacgatacgaaacatacttgcattaagtgatgcaccggattgctgcgcactccctccatcccccatctgtggaacactgggaagttgctcgataaaatagcgcgactgattagccacaccatccatggtgacatcaatctccctactgtcatcagcatcccaagccattccagtgacaggatctggtgttggtgagcatgaatggggttcatctacctcttcgccctctgtatcaggatttggcgctgaagagcaggcgtggtgatacaatccgtttgagccattaaattccggaatagtgacctgttcaagaaaccgttctcccgatcgcagcgccgcttctgccgcctggaaagccagtgtttcatcacgcagattgcctgccattttttcttccagaatcgtgctctgcagagcagttgtgccgagtaatgtcagaaccaccagaaaaatcaatccggttatcaatacagcgccccgctgcgtggaagcaacatttattctgtcattgcgaccaccaagcgatggcgcaggaagtaatccagataaccaggcgccaaggtgctggagcattccgctgttgcgtaactcgtgatgccggcagattctggcgcgtggtgtgatcacggaaggttctggcactgcttgcgatgatccacccgaatgattgtgaagaaaccggattctaaccgtgaacgaaacgtgacgaaccaccggtgaagcaactttccggggtttaaaaaactgatctttattgttgccggaatctgccgggaaatctgcatccatgttttctactctccaggaagaatcatcagggagcgcggttgcgcaacgagattacggtggaaaatacctgtcgcaaccgccggtcagtcggtgttacggtctcaccattgaaggtataggtctgcgactggctggtaacattatcttccaccgattgcaccagcagatcgatgcgtacactgacaacattctcccaatctgccaccagatccgctgtgcgataaatgtccacagccctgtccccgttggtatcttcaccgtattgaatttgcatattttcaatgccctcaaccagttcatcggcatcatccttcccttttttccaatacagagcagggggatttcctggattattccgaatgtaataaaccctggtgctaattcgtactatttctccgttgagaaatatttcacccagctctttttcatttcctggctctacactgctaccacctgtagcatgctccaaaaactttttatcagatatattattaatacctgtcacctgaaaaatggcagtgtttcgacaattacttaccagtactataaaaggtgatttaggattcgatttatcaaaataattttgtagttcttttccaaaatcactacctaattcaactcctggatcggccgactcagatgcatgggaaattactctggcgtaactatcctctactcctcttaccacaatgacatctcgccctacatctcctcccttcaatggagaagttacttcagacggtaaagcaggtgtccagccgcttgcgctggttgcttcgaatccctccagaggctgatcaaatctccacaaaaaatcatttttattattaagtacattggttatagcaacaacatcacccacacagccgcgatatcccgccatacgaatatcgcgagacaaaagctggaaggcatagcgcgcgttttcctgcatacgcgccattgcttcgttaacacggtaagtctgctggctggcagtcagcacggtgatcacgccaccaagcagcaccaacccgatggtcatggccaccatcatttctaccagcgtcaaaccatgctgacttcgactgaatgcctgatttatccgcatgcttttcatgtcacctgttacagccgggtagtcatgacaaattgctgcgcagccaatgcaccacggctgtcatcccactgaatggtgatggttactttattgtcagcatccacattaacagcgccggtaccatccggcagacgcagagcaagctcttccaaccagggtttaacatccccgggaatcccggcttctgtctgcgtttcctcctccgtctcctcctccgcttcatcctctgaagcagtatcttccgagatcgcatggttgtagctaccttctcccgctgcaacccgattcgcccgcatactgtccagaatgccgtatgccatcatggtggcagttgaacggaaaccggcactctggttattcttcaatccggcggtttgcagccctgccagcccaagcagtccgatcgaaagaacaatgatggccaccagcacttcgatcatgccgacacctgtctgggcatgggtaaatacaagattgtgatgaatatttggcatagcgataccttctctactcttgttcagttgggtgaacaagaaaaatctttcacgacttttggacggccagaattattcacaacgaccttacgtccgctggcctggttgcatagttcgaatctcccagtttgactacgcccgttaggtaaataagaaatccagttaccaaaaccgaatccattcacggtgataccaccactcaattttgggaagactctcaatatttcatcatcactatcgacagcaccagccgtgcccgcatcgctaaaaaccagccagccatcctgccagctaccgtcattacaagttgcaccatccgagcttttgcagatcgtgattctccctccccgtttcactgcttcagaacgggcatagtgcagcgcagtcatcagttcattggcttgcgcggtcaagcgcgattcccgcatgagggattgatagcttggaacagccacggcaagcaggatggaggcaatactgatagtgatcatcagctcaaccatggtgaaacccttgctgacagatacagtcatttcattgtttccatagataaaactgttttgtgatcctgaccggattagtgcctcagtgaaaaaatgaacccgatcgctgtatttcttccggttacattgcggatcaacggctgttacctatggaaactttaggccacttctgaaaaacctacgagtttcaataagaaaggatacctatgcgaccatctgttgtgcttgacatgaagcgaagtgcggtgcgcgaagtggtgagccgctttcgcgtggcgaacccacgcgtttttggctcagtgttgcatggcaatgatcgggatggcagcgacattgatctgctggttgatgcgctgcctgggccacatgcagcaggccgctaccgatgcctgcggcttcgtggaaggcttgaccaaagaggattttaaggtaattggctcaaagagcgcaggaaagggtcaatcgaccaggtgatgcatgatggcgtagcggattaattcgctgttgttggtaagctttagtttttccaataacctggcacgataaacactgacagttttcgggctcagacatatttcttctgaaatttcggaaagccctttgccggaagcaatcaggcacaacgtctgaaattcccggtcggataatgaagcgtgcagcggccgatctgtattcgaggtaatcgcgtttgccagctccattgccagcgcaggggtaatgaatttctggccggatgcaacctgacgaatcgcggtaaccagttgcgccggcgcactctgcttgttcagataaccagccgcccccgccttgagggcacggatcgcaaactcgctttcattgtgcatgcttagcatcagcaccgccagattcgactgttccttcttaatttgcttgagcacatccagcccgttccgatctggcaatgaaatatccagcaacatcacatcaaaatcctgttgacgcacaaccttcatcgcctggaaaccgctttccgcttccccggttacgctgatgtcaccggtctcgctcagaatctgcttgagcccctggcgcacaattgcatgatcatcagtgatcatcaccttgatcatgattacatcctcaccctatcagctgacattccttgtctcatgtttcatccctcaatccggccactcatcctgataagacgatgaagactgcccattcaccggaatccagatcatcacccccgtacccgtctggggttcaccctgaatatgaaaccgcccgccaagctgttggcagcgctcgcgcatactgcgtatgccgaacgaatttaccttctccatatccgggtacgtaatgccgcagccattgtctgccacttccagatacacttcgccactcgcttcggacaatttcacccgcacttccgatgcatccgcatgcttggcgatgttggtcagcgcttcctgaaaaacccgaaaaatcgccacggccagatctccatccagtgaaatttcctcatcatcacacaccacagcacaagcaatcccggtacgctgattaaattcacgggcctgccattgcaccgcggctacaatcccgcaatcaagcacacctggtcgcaaatcgagcgcgatccggcgcgtgctgtcaatcaccatatccaccagcgattccaccgctgcggccttgttgcgataaaactccggcgcacggctggagttatccaggcaaggcaccaattcacacttgatcgccgtcagagtcccaccaatatcatcatgaatctcgcgggcaatccgtgtgcgctcctgctcttttgctttttgcgaatatgccgaaagctcttccaattgcgcacgcgatcgggcaatttccagttcgatctgtttattacgcgtaatattcagcataattccatcccacaacacggcaccacgcggcgtccggcgcggtgtagctcgcaggctgatccatttcacatcagcatctccccgcgcctgaatacgtccctcccaattccacgccgaaagctgtttgcacgagttctgtaacgattgatcgtagtccgacatatcttccgtcagaatcaagccagcaaatgcatccggatttttctgcaggtaatcgggagaaagcccgagcaatgttctggaactctcgctgacgtacggaaagaaaacgccgccatccgattccagtacaaactggaacaccagccccggcagattggaagcaatcgcacgaaaacgggcttcgcttctttccagtgcggattgcgcctcgcacaaatcttgcaaatgttcaatatgccgctggcaaccccggatggctgccatcagccgtatcgagtccgatttcagcaatacatcctgtactcccgcagcaaataaacatgctgtggcctgctcatcctgccgggaaaccagcacaattaccggaatatccagccctagttccgtcaatgaatccagtaccggcaccacgcccaaatccggatgatcacccgccagcaccagatcccactcctgttgctgcaatacctccggcagcgcatctgtcgtcacacaatgcacctgggctgacaggccgccctgctccagcaaaccacgtacctgctcaccctccgctgccgtaggctcaaccatcagaattgcaagtgtccgtaccatcaaccttattcaactccccacacatccaactaactggcaaccaaccagataatgccacaatgacatacagatgtagctactgttaatcttttaacattaaaaacataaacttatatctgtaatcagaataatatattggtaaagtgtaacagagtgagcgaaatgaagcgggccaggcaaataccacaagtgatatttgatgaaattcagaatttacaggaggtacacaacatgctttcagaatgtaccaaagactgaaaacagcaaggaatagaagaaaagcagcaggaagaaggtaaggacggggtttgttactgcatcagttggtgcagcgctctgatacgctgggacgttaggtaaaatgcatcctgatgacacggactatcaaagggccacctcgaaaattccgtttctaaaaaaattgactgtaaaatcaattttttatatacagatcttttcaaaatttataggtttttcgaggtgcccaaagacgcatgaagattgattttgaaaagcttcacataaggaaatagcaaggcagcgtcaaaggttgctccgaggaatttctgattcatccacccgcagatcaataagcaccgcgaaaaatctttgattttgtcatttattatcagaatctatcgatacctctaacgttttttatgtatttatttattggcatcaagtgcaattattccctgcgaccagaatcgtggctgaagatgactaccaaaggttttggcgtatatctcttcccgttgctcaagatctggataatcacgcacaacaacaaaacccagtaacgctactgcagcggccaggatagccagccatgagaaaaacatacggcgaggtgcaaacgtaacagaaccaggtgacacagcttgcggctgcaaaccaatcagccagcctgcgagtaatgccagccacaactgtgaataaggcatcaccagcacaccatctaccatcgcttgggttaatgcagcaatgattgaagcagcaaggcacaaacggagcacatcttgctcttgcattgattgcgcgcgggcgcgcaacacaggcaccagcctccctattccacgcatgaccaaccaggttaccagtacggctgaaggcaggcccagttcagccacccactgtaaccaggcttgatgagggtgagcagccacgccgttcggaagatccgcaagctgcatcgggccaatccccagcaatggatgattcagcgcctcctcaattgcctgaatccagataatgtcgcgcagcgaaagcgaggtagtgagcttggaagcggcatggtgagctactgacatatccagtgctgcgggaatcactgtcatcatgacccatgtcagcaccacaccaacgcaggcggctgcaacatgtagcattgcccaacggcgtccaatcggcccgatacaagcaagtactgccgttgcacacgccaggccaagccaggtgccgcgcgtccccgatacaattgctgttgtccataccagcacgatcaatacgcccgccaccagcgcatagcggcgcagatttccctcaaccagcaatggaactgccagcaacggcaatgccagcgtcaaaaactggccaaagaaacggggattggagaaaccatccaccagcagccatgcatccagtatgccttctccattcgtgatagcggccagataggatacgtcaaagcgtgccaccagcccggcgcagataaagaacaacgttgccagcagtatgcgatctaccgtgtggccaccagtattttgtacggcatataagcgccgcagggaagccaccagccaggccaaccccaggctggccacacccagcgccagctcggtaaatgcccagagtggctggtgcgccaggtatgcggaaacaccggcaacgactattaccagcacaagcagacgacgattcgtgtgactcaatagcagtggtgtgcgcaatctaccaaggccaaaaatcagtaacgcagcaatcacagccattgccaatgttaatatttgcccaatacgctgctgatcatgccagtgcgtattctccaaccagactaccaatggcagagttgataccagtaccaacgcagcgatcatcagcagattcgcgacccgatgtgaccagacaatacgatttttctggcctggtgtggttgcgcacagcaacgaatggaacaagagattggatcgacccgcagccaaaattctatccatgatggatcctcattatggaaataaaaaggggcgataatacgcccccttcattaagctcaatttaagccctactctgaaataaggcttaattcaattataaagatcaagttccacgacactcagcaggaacaaatttcgtgttaattgttgtcgaacatgcccatgtaagctgaccgttggctacatttgtcggtgttagtacaatatttccagtggcgttaggtacagtcgatactgccgttacgactcctgacgatgccgcaatggttacgccagacacatattttgttgcaccggggaaagtatagccattatttgttgcggtcactttgtctaagccacccagtgaggatgctgtctctgtcacagcaagcttagctggcgcagccatagccataacctcggtaattttagcgcgagtcgtatagtcctgatacgccgggatcgccacggccgccaagatgccgatgatcgcgaccacgatcatcaattcgatcaaagtaaaaccttgttgattgtgttgcatggttgggttctccatttgttaacaaataaaatagaattcgctggttacagcttggtgcgctgatgaatactgctggggagtataacggcgatcgtttttttggctttagaaaaatttcgacggcccctcaaaaccccacggttgctccatctggattacgcgggtcggaataaccccaaagttcatcaccgtgcaactggatagtctgggtacggcccatggtgggcttgataacaatgcgatgcccctttttctgtaaaagacgcaaggtatcaggcgaaatccctttttccagtcgcagttcgtccggtatccactgatggtggaagcgtgcagctgaggctgcttcagcaggattcatggcaaagtcgatactgtttacgatttgctgcaacaccgtggtaataatgcgtggcccaccggggctgccagtcaccaaccagggtttgcccgccttgaaaacaaacgcaggcgtcatggatgagagtggacgcttgcctgcggcaactgcattggcctcgccgccgatgacgccgtaaacgttgggcaccccgagtttgattgaaaaatcatccatttcattattgagcacgatgcccgtgccgggtgcgacaataccgctgccaaaattggtgttgagcgtataagtgacagcaaccatattgccggctgaatccatcaccgaaaagtgcgtagtctgattgctttcatggaattgcggctggccgggtttgatggcctctgcgacacgagcgtgatccggatcaatgtgtgataccagcgcctcagcataagctttgctgatcaggccagtgagcggaacgttgacaaaatccggatctcccagatattcagatcgatcggcataagccagcttcatggcttccgtcatatgatgaatcgttcgtgcactgttgtgcccccactccctgagcggccaatgctccagcatattaagcatctgtaccagatgcacaccacctgaagaaggcggcggcatggtgacgatctcgtaaccgcgataagtgccacgtaccggctcgcgctcagttatccggtaatttttcagatcttccattgtcatcgggctgccgtttctggccatatctgcagcaatcctatgcgcaatctctcctgcataaaacgccctggcgccatcgcgtgcaattaagcgcaacgaattggccagatcttgctgtaccagcttgtcacccgttttcaacggcatatcatttttccagaagattgcccgggtggctggccacttccccatgttgcccgctgaatactgcaagcctttggcgagcgttttgctgactggataaccttcttccgccagtgtgatcgccggttgcatcacttttgccagcggcatggagccccagcgttgcaatgcgtggatcattccggcaaccgtacctggaacccccaccgctgcgtgactgaaaagtgattttttatttatgacattccctgccgaatccagatacatatcacggctggcggctgccggagcagtttcacgaaaatccagcgcggttgatcgcccggtttgggcgtcatgaaccagcatgaatcccccgccgccaatattgcccgcattgggtaacgttaccgccagaccaaagccaatcgccacggcggcatcaatcgcattgccacccgctttgagaatgtccaccccgattctggaagccagtttttgctcggtggccaccatgccatgccgcaccacgacaggatggaatatatccatatcccagtcgtagattattgcagcggcggtgatttgtgataccgacgggggggttgttagcggaacggttggagtcgtgctgcatgccgtcagcagaaccagggaaatattgcttaacagcaagaagaggttgcgaatgagcaaatggatactccttttttaatcccatgctgctcaatgcagccggcaatccacgcaataggatggcgggtagtggttaggatagacagcatgctctcccacgagaaagcacgctgcccggcaattcacaattgtttggctaagttgcagattttataatttcacaacatgcgtcaaggaatctctaaaaaatgttagcgaggacggcccgcacaaggcaaaattgaacgagaaagcagaacatacttgaagtatgtgagcattttgaattcaatttcaacgccacgatgcgcccttcagtgagatattgaacaggttctaagtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcaactgatcgtgtgagtcgtaataataccgttttacagtcgcatccttgatggttcgattcatgcgttcaacctgaccattggtccagggatggttgggtttggtgagacggtgctcgatgccgttgatctgacaacatctatcgaacatatgcgttatatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacatctaaggaaacgcaggaattctgggctctgtttgcataacttcgacctgaggtaaatgcagtcttattctatcttcaatttcatcgacccgatctttaggcacatcagccaacaccagcaattttcccgcttcaatcttatcctcaaattctttaatgcgccgattaccaagcgtcatgccgatcatgccacctacccacgacccaatacttgcgccagccagtgtagttgccaacaaaataccaccagcgatgaccgtcgatgcaggcgggagtgcgacagcaaccaacccggcaagcaatcctgtcgcaccccccagcgcaaccccttgctgaacggcagggataaaatcagttttctgtaacaggttagcttccggtaaatcttcaagtggtgtatcgcgcttcgcaatcacatgaatatgcctctcttcaattcttgccagaagcaaatcatcaacaattttcttggtggtagctatttccggaaccaaaaaatatatgcgtctcatgatgccctccatttagaactgccaggttaagaatgaaagagtggtgatttactccttcggcgaaaacacttctgatagataccatgactcacgtgcgcgaccctgtgggattcatgcagaggcgctcccttggccatagattcaaggtttccaggggcccagaatctcactgtttatgggccaaacgttatttctatgcccacatccgccagccccaaaatgcccgtacccactttcccctgcagtttccattctttgggtgtaagcaggttagaaataatctgccatatttttgacaggaaacgcttcagcaaaggggttaaaattgtttttattttgttcagcgcggcacgtacagggtttgtcacctggtttataaaccgctgagcggttgtttgagtgtcgtcttgaatcatgttttcaatatgttcaagaacacccttgagccattcgagctgtgcattcagctcattcgcaagtgttgcaagtgaaaaagcagatcccccgtttaatcttccagacgctgaagatccaatttcttcgagcagctggctgattctgtcaagtaactgtgccactctgtctcgaaattcctccagatcatcagccagcggtattcgcaaatcccgtaatgctggatttattgacactaattccgaaaattccaggagctccgtacgaagtctttctacatctccgagtgccgcttccgtatcacgttgcaagtcttccgggtttgtcattctgacctcctcaatttggtatttaacagctgaaaaccgtttaccccccatgttcaagcatattgcctgcaatcgctactcaacacattggatctctaatatggagccagcgtagtgctacccgctttcaccgcagcatgctgcctcaattgccgcaatgtcgatttttctcatctgcatcagggcgttgaatgcaccggttggagcgcaatatctgacattgccatgtctcgatcatctatctatcacatggaatgcagaccaatcatattgccttcggtatcgtgcaccagtgcgatgaagccgtgtttgccaatggacattttttccttgaaaacgctgccgccactttcggctgcacgggcagcttctacagcacagtcgtcacaggcaaaatagatcagcgtgccaccatgcccggaaggagccccttccatttttaccaacatcccacatgcgccgtaagtggtgtgggcggcatccttgtctgcgggaaagctccacatttccatgttcatttctgctgtcggggcagccattttttccagcttgactgcaaatacggattcatagaatgctttggcgcgctccatgtcctgaacatagatttcaaaccagacaacgggattgctttgattgcgtttcatgcgactctccttctaaaggttggttgtgataacgcctggcgggaggcgggctggacggatgaaaggtgctgtaataccccaccaccatgcggtttccacttgaataagacggcaggtttccagcacattggattactcctgaaatctggttcaatcagatccgcaagctgtatctgatatggattaaatctgttagacggcaattaacctgcccggtcagcctgctgctccgtctcgtgatggatgtcctcgttcttctcctttttttcttccaccacctgcgtcatgtaggtctccacttcctcacggctaagctcctcgacacgagcggcaaaggctggatagacctggacatgggtttgaccgacgtaaggcccgctgagctgaaaaaactgccagccttcgctcttcagtgcctcaactgtacgccggtaatggcgccatcgttcgccatagtgaaaaaattcctccacggcggcactcaatgccaccacgagactgacgatgaacgtgagcgtcttgattgcggccgcagcaccatcaccgacgttcaagctgaccagtgccggaacgatcacacctccgataatcgtcgtgaggcgcagaatgttatgccacaagatggaattccatgccctctcatccatccagatcacttgctccagccaccgtgcccggagaaactgcttattcagctccggcaactccaatacctcgatgagcttgcccatctccagccgcatctgttcatggtctttcggttttctcagcatggtcgcctcgcaagaaaaaaatcgagcgcatctggtgtacaggaaaaacaaatgcgtttttcccaaggatcttctgaaaaactatctgcgttgccatcactacgttaaaaacagcctcgaaatactcatttactatcaataatccacatcccatccatcatcagaagccaatcttaaagcgcatggcaaaccaattttcctcatccatttcaagctcaccacgccgtaccagggaaccgattctgagcatcgcacgcagtgattcctgcatggtgatttccgaggcatagcggccgaggcacttatgccgcccgtaaccgtgttgtaaataaatcaggctttgaggcgcctcgctcgcgcgttcctgattgcacaagtaaggcgtcagccgttcatctcgcgtgacatcaaaggccgctggattcggcaccacttccggatccagcatggctgcggcataagctacaaaaacaaccgttcctttaccgagggagacaccaccaagtacatcgttgtcttgtacgcacacccgcaataaaacctcaccttgcggtttgagacgcaaggcttccagggcatacttgcgaagcctttccagactttccgcataatccggctcgtccggttccacatcggcccaataaagtgcctgttcgaagctggaatcgttcaatacttcgtatttatcctccttcaaacgaagcatggaatccagaatacgcgccgttgcttcctggggattgactaccgcaccgacggttataccaaatacattcgaccggatcattgaatccgaaagacgccgcgccagttcaccttgtggaagcggtgcaccaagcagcctggcgaattcctcttccagcttgccagagttttgctccagttcaagctgcatccgcagcagtctcgtcagcatggtgtcaggcactatttcaccatgctgtaaccgtgccttatggtgctgaagcagtgcaaaaatgtaggcgctgagatattcggtcgcgataatgccgcgctcacggtattcggtaaatttaggatgagctggattaatgttattgaaaatattgcgaaaagcatccttcacccagtcaaacagatcatctccggtcggcacgatgccttcttttatcctggtaaaggtaaaaaatttctgcagattttcatcgagggcaaaatgatctcctccccgtaatcctggcaatgctgaaggtgctcctgcctcgcaatagtggacgcccagataatcgccaacgatacgcagcggtacgaatttggcgatcgttgcgaccacatcgatttcaccagtgccttcgacttgtacctgatgtgtccagcgctcagcctcctcgcgggccaggcggatgagcgtgtccttgtcgctacgtgacacagcccgtcgcaatattacgtcatcaagttgataaagatcatcgcgatcggtaccgagcatgaaatgtgtgtaagcatctggatgcctggttttgtcatccgtggcacgcgccatctcggcggcatacagatccaccgtgaagagatcagtgcgctccagacaccgaatgacttccggatgccgcataactattacgggaccaatcgctggcttgaagatcggcatagtgcttcttggttgtgccaggagttcctggaacatcgcatcaggtgaagtggccaaccattgagtgattatctgcgcaaccgcagcgccgcgtacttgtgcggctgcggtgaaggctgtaattgcagcttctgctgcctgcttgtcccggcgataaacttcaggatcgctggcgtacttaggatcatctggattgggaggactgggcggcggagggggtaacggtgaactcgcctcggcattcgcaatatcgctcagaaagcttgcagtcggtggtggagaattgggcgcctcctctctacccggcgatgggttgccctgcttctttcccgatgtcatttggattagcttgatgaaaccgcaaaccatgccataaagctgatcctttattgtcatcccattttgcctggacatatcccctcccctttctacaacgttttcatgtactcaatgactgcccacgcctgttcgtctgtccactcgctgccgtaggcatgaccgacatttgaattaccgtgcactgttgtatcatgctcggcaaagtgcacagcatcgccagggccgtattcatcaagcgcaggagccttgtcccatacaaagccaattttttcttcatcatatttgatattgccgcgaataaatttcaccggccgttcagcaggccgcaagagatgccacaaagttggtacagagccgttgtgaagataaggtgcctgagcccagataccatgaagcacatccggcttgtaacccgatgcctcaccgcgcggcgtgacgaaatacgcctcgtcatcggctgcgcgactgcctcgtttgggacgacaccaatcactgccaccccgttcaacgtaaagttcacaagtctcacggatcaattcaagcaatcccagacgagccgtcggcgtgatctgcattgcccggttcatatcagtgccgatgttataaaccttcttattctgagaataatgacatgcagaagcgcactgctgttcgaaaagaggtttgcctttggccgccagatcaagatccacggaaaaggggtaaggagaaggtggcaaatcattgataaacggattcattgcctcatggatgcggacatttactttagatggatcacctcccgaggaaacccctgaggcgagtacccgtgcctcggctgcctgattcgcatcccagttagccaggccatggtcacgtgaataccacagactcttgatatcggaaatgcctggaagatgagatatccattcatttgccgtattaaacagtcgctcaccggcctttttaagacgttcttcccgtgggagattttctagtcctgcaaagaaaggatgatcatccggcaaacgcgccaggtagctgtcacgtctggcatgcaccgcgaccagtccagtagcggtgccaaacgcatccatgcgcccgggagttggaccaaatgcacttggtgctttttgtccctctttatccgtgtgcatcggattcgaggcctgggccagatacataagctccgttgtcttggccaggccaatcagaaacttgactgcctcttcgaggttacccaatacacgcgtaacctgaaccttggcgtactcagcactggctaaccgctcctcaggcgttttaccaccgtaaaaccaggccgggtcagtctcaatcctgtttttaaggaatgcagcaattccgctaacctgatcaaaatcaacctgaattttgcctgggtcagggctgtccactttaatgagtttcttggccgtaccgtagagcaggccaacgtatcctgacgactcgatttcggtattaggtgcaccgattaaatggcggatacgatctttaacgtagacccggccggtatggcatgcgccacaagagaaaaagacgttatctgtgcgtttatcttccggaaccaccggatcctgtgccgtgaaaagcccataaggcaaaggatggcgttgttctggcggaagcagcttacccgattcgggatcatagtcatccggatggggaccaaaccccaggttacccagcgagccctgtcctttccagatatcaggataaacttcaattacggcgcgcagcagcacataaggcacaccgttgaaagcaagtggacgagtattaaaccattcgcggcccaaccgattgctgtaccaaggtgtacgcgcttcgctgtcggtcacgattcgtttgatgacagcatcgttcaaataggcagcctgttgctgttctcgctgtgcgcgctcctcctcccagctgagagtctgctggtcgggtgggtgaacgtctcctttccgggaatctttgcacgaaatgagcgccgcgaggatgaacagagtcattgcgcagcgaatcaaggtggaagtgaaaaagcctggattcttcattgcagcccccttccagacagttggcggaaagttattctactgtgctttttctcataatgacaatgtcaaatgataacaatgcatcaaatatattagacaagaattaatctgtccggtttatcggtgcaatattgtaacaacagcgccctgacatgatccgaacagcctataaatttacgccgggtggaagggataacggcaagcaatccggagacatacggggtacgcgaacgcgaatcgccaccaccacgaacaaaatgccaatgcaagagattaaatgtttcagtgtgtgaccgctgatgccgatagcatcatagacaggcctgtcgccgagttcaaataccttcgccagtacgtaagctgcaagcggtgcccacatgaacgttgacggttttaagcgagaggggaacaacagcataatcaatggaaccagaacgataggcaagtactggaccagcacgtagaggcgcagatctccccgcccatgtaactccgtaaagtaccagtaaaaaactgacaacgatccaaataaaagcaatggaatcaacaaatttcggccgtaacgctcgctaatatgttctccaacgatgatgcagagaaatgccatgaatgccgcagccatgggtagccgatcccaaaccagtgtggcgttattgggttccagatgatagtaagctgagcccagccctatgaatatcgtggcgataaaaaataccgcataacccgaccgcaaagcccgcagcgctccttgtgacttgctggatctcagcatcgccagacccacagccccaaccagaacaaacgcaacgctggaggcaacgtcatagaagttcgggatgcccagcaagtacctggtatccgcgaaattgttgtagcgcggatcttgcggaattgcttcttgcgtaaagacgcccatcgcgctaacgatcgcaatgacgatgatgaatattagtcgctttttgtgtgcaagatgctgaggtatatccacggcaggcatcgtcttacactgagcggagcggcgcaatgggacaattaagcgcgagtattcgggtgcagtacgacgtaatgcacggacgattctgaaacaaatcaactctttggcgtttcgtatacatctgttttacccgttcgccgcaacatcttattaacctgatccacatgcatctcctcttcgacgatgagaccgcgcgcataatcctccagcagcactgatttactctgggccagctccagcaacgcatagtaggcagtaagtgactgggtttcatgcgccagtgattctcgcagaatatcgccgatatcatgcacgtgcgtttccagcagagggccgatcgcaagtgagggatacccccccaacagcgtgacaagttcgccggctttatgtgcatggagcaggccttcttcggcttgttccttgagccattccaccactggaatacggttataaccaaataccatcaacgaataatgcgtatatcgcaccactccagcaagctcaagctccatgatcttgttcagcagcgcgattgccttgtctttatcgaaatccatgtgtgtctcctttatggttatgacatgtgcaccagtttgccgcatcagagtaccccgccatggctttcataaaattacaaggcatcgaccaggcacagcattgcatccacatcagcatataggaaaaacaaatacttttttaaaatttattacgcataaaccattgcacctgtcatgagtcccttgctctacagtgccgcttcgtcgagcgagagcagggcggcattaccacccgtggccgccgtgttggtacaaaccgtacgttcgacagcgaagcgatggaggtaatgcgatccgcccgccttcggtccggtacccgagagtccctcgccgccgaacggttgtacgctgacgaccgcaccaatctggttacggttgacgtagaggttgccgaccctgacgcgcgcgcgaatgaaatcgacggtctcctggatgcgtgtgtgcacgccgagcgtgaggccgtaaccggtcgtgttgattgcctcgcatactttatccagccgggttgctttgaagcgtataacatgcaggatcggaccgaacacctcgcgctcgatccggctgatcgcatcgatctcataggccctcggtgcaaagaagaagccatccctggtttcgtccgagagcggtgcttcagcgatgaagccggcctcgcggctcatgcgttttgcgtgcgcttcgagcttggcgagcgaattgctgtcgatcaccggcccgatgtcggtatcgagcttcatcggatcgccgatcctgagttcggccatcgcacccctgatcaggctgatgacgcgctcggcgatgtcctcctgcaagaacagcacccgcagcgccgagcaacgttggcccgcactgtcgaatgccgaggtcagcacgtccctgacgagttgctcgggcagcgccgtcgaatcggcgatcagtgcattcaacccgccggtctcggcgatgaacggcacgatcggtcccgcgcgctcggcaagcatgcggttgatcacatgcccggtgtcggtaccaccggtgaaaacaacgcccgtggtcgccggatgtctcaccatcgccgtgccgataacgcgcccgctgcccggcagaaaatggagcacctcacccggcacgcctgcttcgtgcatcagttgtatcgcggtataggcggcgagtgaggtgcgctcggcgggtttcgccaacacgctgttacccgccgcgagtgcacccgcgacctggcctgtgaagatcgcaaccggaaagttccacgggctgatcgctacgaacacaccgcgtccgtgtaaactgagctcgttgcgctcgccggtcggacccggcatcacctttggttcggcgaagtcggcgcgcgcgagccccgcatagtaacgcaggaagtcgattgcctcgcgcacgtcggcgagcgcgtttgacactgtcttgccggcttcgcgtacgcaaagtgcaatcagcaccgccatgtcgcgctcgaacaggtcggccgcgcgttcaagaatctctgcgcgcctgacaccgccgaggcgatcccatgcgccttgcgcagcagctgccgtggatgccgcccgcgtgaccatatcaggcgtggcgttcaacactgtgccgacctggcgcgaatggagcgcaggatcaaacacggccgcaccctcaccgggatacggctctccaccgatcaagggtcgcgcttcgaagccgtgttcaatcgcaaccgcgaccgcattcaatagtagcctggcctgcgccggatcgctgatgagaaggccgcgcgaattcttgcgatcggtgaacagatttttcggcaacggaatgtgcggatgcggttttgcgctcatggcttcgatctgatccacaggatccgcgatgatcgaggcgatcggcattttattatctgcgatccggttgacgaatgatgtactggcgccgttctcgagcaggcggcgcacgagataggcgaggaggtccttgtgtggaccgaccggggcatagatacggcattgcacaccagaatgatcagcgccgacggcctgatcgtagagttcctcgcccatgccgtgcaggcgttggaattcgtagtcggaacgattgccggcaagcactttgactgcggccagcgtatgcgcattgtgcgtcgcgaacatcggaaagaacgcgctccggtcggcgagcagcattcgcgcacaggcaagataggaaacatcggtcgaagctttgcgtgtaaacacgggaaacccatcgatgccgagttcctgcgcgcgcttgatctcgctgtcccaataggcacccttgacgagccgaaccggaatgcgccgcttgtgctcgcacgcgatggcagcgagccaatcgatcaccgccggcgcacgcttctgataggtctgcaccgcaaggcccagaccttcccagccggcaagttctcgcgtgcggctcaaagcctcgaagatatcgagctggagatcaagacgatccgcttcttccgcatcgatcgtaaagccgatcctggctttgcatgccgcctgacagagtggcatcagctgcggcaggatctcggccagcacccgttcagccttcacgtattcaagccgtggatgcagcgctgacagcttcaccgagatcgaattcctcgcaaaaatgtcgccgtgctgcgcctccttgcgtgcctcgtgcgatgtaatcgccgcgatcgcgccggcataaacgcgtgcatagcgctcggcgtcttcacgtgtgacggccgcctcacccaacatgtcgaacgagaagcggtagccacgccgtgccgcctccgttccgcgcctcagcgcctcctcaatcgtgcatccgagcacgaactgcctgcccatgatgcgcatggcggcgctcattgcttggcggataacaggcttgcccaagcgctgcaccatgcggctgaaaatattcgtccagtccgatctcccttcgccgagcctgaccacatgcccggtcagcatcaacgcccaggccgaggcgttcacgaacagcgacgatgattgcccgagatgcttctcccaatgcacgctgccgatcttgtccctgatcagcctgtcctgtgtttcggcgtccggcacccgtaacagagcttcggcgaggcacatcaacgcgacaccttcttcagtcgacagtgcgtattggtgaagaaacatgttgagcccgccgcgccaccactgcatccgcatccgctgcacgaggtcacgcgccagcgcctccgttgccgcccgttccattgcactcaaccgtgcacgcgggatgagcgcattcacggcttcggtttcgtcgcaaagatagaggtgtgccattgcggcacgcgcaggatgtatcctcatgcgcggataactctgtggccaacagtaaaagacaatgatcggcgaatttttgcagcgtgtctgcgcaaactcctgaactctttgcagtcgtatttcttcgcaactcggatcggggcgacattcccggagttgatggtgtaggcgtacacacacgaagcgaaattgaccgggaaaataggaactgaaagcattgctggagagaagataattttttccagggaaagtaagttcaattggcggctccgaggaaatttgccaggagattatccaaacaagttgagatatttacccgctgtcgcatcccgtctgtttccagctcatcttcagcgctattgaatcgatgtgttttgagtacgtcagcaatacacccgttgaaacgttcgaccatcccattggtttgcggagtgcgtggccgggtcaggcaatgttcgataccgagttcctggcacagctggtcaaaactgaaaagaccctgccataaccagctttcataagcatgtccagtaacaggcgaggcttgaggtgaggcgtatgaatcaaagggccgggtactctcgataggacggtcataccagatcaagagtccaaatataatgagtaaagctaaccccgcgaaggcaaggtccggctcttttatctcatttatctgaggcatcgttttactaacactaaccgcgtacaggaaaaataaacgcccttttttctaaaatttattatacataaatcggatggcgaggcagaaatactgctgaataatcgcaaaaatatctgattttgattaaaggcagaatagaaatcctggcaaggagaagcaacttgcctttcgggtgaagggtgtccagtcagtacgttcagttcattctggaatgagcgctgaagatgagccggaaacagacgggatgcgacatataagcgcaataactataccgacagacacaaatatccagaaataacccagtagaatacgtttattgtattgttgtttttggatgggtaatttcgcaaaagtattcagcaaatggccgatatcgtacttgtcattcattttctgttcgtactgtttgtcatcggcagtctcccgctgatttgggcaggcagctggatggggctgggctttgtgcgaaatcgaaggttccggttcgcgcatcttgccgccatcctgtacgttaccgccgagtcccttctcggcctgatatgtccactgacatggctggaggatgcgctgcgcggcacgccgaccgagacaggctttatcgagcgctggctgcatcgcattctgttctatgatcttccgggatgggtgtttctggtagcgtatgtgttatttgcgcttctggtggtcattactttccgattcattccaccgcagccgcgccgctcatcgcgctgagttctggtcgcaattgaccggattttctgcacggcgtaagacgcatgcatagaaagaagtttatgcacaaagaaggtgaagtaatttcatttctatttcagaagattaataatagggcacctctaaaaatgcctaagaacctgttcaatatctcgatcaagggaggcagtgcaagacaaaattgaacaagaaagcggagcatacttgaagtatgtgagcattttgagttcaatttcaacgtcgtaatgcgcccttcagtgagatattgaacaggttctaaaaccggtacctgatgaaaattaacaggagagaatatgtccaccacacgctttcccgcctcaatcgcaacacccgcaagaacaatcgacgacgttactcaccaattaaccgccattattgaatggtcaaagcagaataattcccgcacaggttattttgcagcgctctatcgcaaggtcatcatccaggccaaaaaaggaatcgaggaaggcttgttcgatgacgggccacgcatagaacgtctggatgtaatttttgccaatcgttatcttcaagcctgttatcagtaccagacgggacagacgccaacccaatcctgggtacgcgcctttgatgaaaccaggcattggtggcccatcgtcctgcagcatttattactgggcatgaatgcccatatcaaccttgatctgggtattgctgttgcagaaacggtgccacccgcagaattacccggcctgaaaagcgattttgacaaaatcaatcaaatcctggccagcctggtgggcggcgtgcaaaacgaactggccgagatatggccaacgctgcgattgttgaaccgttatctgggcagtgtggacacatccctgatcaatttcagtatggtaaaagcgcgtgatgctgcctggtcatttgctgagaccctgtcgcccttaactctggaacagcgtcaacaggaaattgcggacaaggataaagccatcgctctgttttccagcgtgatttctcaccctggttttaccgcttctttcctgaataaaataatccgtctgggcgaacggggaacaacccgccagcatatagagatactggagtaatcttgcaaaaccagaacatccatccaatacgggcaatatcgctttgcaatgttgtgtctaaatgttttttagacaaccctaaaacaatccaaataagttctgcaatatgatccattcgcaatcaggtattcatgatcattttcaccagattaggtatgcctttcccttgaatgtaaggatcacgggccagatcagtgcagtgctgcagtagcagcgccttgacacgatcgggatagccgataaattctcgccgggcggaaagaaaagctgccagcaaccccgagacatgcggagtggccatgctggtaccactcatttccacgtaagcattgcgcacggtgagcttgcccttcggccactgatgccttgctgaaagaatattttcgcccggtgcgaccagatctggcttcatgcgtccgtccgctgtcgggccacgtgaagaaaagtaggaaataccgtaggtatgaggattggttttatgcaccgagccgacggcgatggcttcctcaaggttagccggatcaccgatagaaagatccatgttggccgatatcacaccattgactgaatcgagcagcgcatagccttcgttgccagccgcaaggcataccagcactccctgacgccagagccgccgcagctcctggcacagcggggtatgaccacatccaaatacactgggatcgaaattaccacccaaactgagattcacaccgtgaattatcaatttaccggctcgttcattcagttctgcaatggtatcgagtgctttgatgataaaagcatcttccccgctgccgctgtccttgagtaccttgaaaccatacagctttgcctcgggtgccatgccctgctgatctatggaggtcgggtcttttgcgtcacgcggcagtgtcaatccaccggcgatgattgcagcgacgtgggtaccatggccattgccatccagcgtgccaaaaccgctatctcctggtttcagttgcctgggactgccactgcctgtgcaatcccactgtgcaatgacgttgctgtgtgccttgaaatgcgggtggttggcagcgattccggtatcgagcaccgcccaggcgatattccggccacaagcactataaccgagattagctggacgtacctgaatggtgtgtaccgactggtgaagcagtgcacgtttgacagcattgcgccagacgcggtcaattttcagtgtgccgcagtgtgaacgcaattgctcgatttcactgcgagtcaaatcagccgaaataaagcgctgcatgagctggatgcgcccatcttcacgtttggcaccattgaattccagcacttcattgatcagggtttcaaggcggctgcgtacctcgtctagcggcgtgccattgttatcatccgaaaccagttgaatcagcgttgggtgtctttgttcgcgacgactatcttcgatatcgtcaaccagatctttcatcaggatattgcggcccaccgggttactgaaggtgggcccggcggtctcgcgaacggtctggcgaacgatatcaagcgacagatagcctgtgcccgaatgcggattggattcccagtccgggttaatcatcagcccggcgtgatcttcaactttcacgtcacgactgttgggctgataatcgttttccagatgtgaatcgagtgcgaccggatcaagacgctcggcaacattcagccagtgatcaacacattccggcaccgcaagcggcttgccagggtcgattttgcccagcacatcctgcacctcctgaatgcccagcggcgagccaatagtgatgaacaagcgcacatcacagtcagccttcttcaactggcgcaatacgtggtaggcgatcattgaaccctggctgtggccaatcacaataaaggggccgccgcccacgtccagacgatcgcgcaacgattgttccatcaggccgcgcttgtgttcatcaaaaaagaaatcctgcacatccttgagaaataatttggtaatacgccgggcgatccacaaccgtacactttccggtaacggcagcaccttcacatcaactccgccgggttgtttttcccctttgcgcaatcgctcttccaaggctgtcatgatcttgcgctcagcagagctcagcttggcttccggttccagcccgatttcctgcagagcttgtgcactcattctgtccacactccccgagagcgtgtctttgtcggcacaactacctttctcaggttcgggataacgattacgatccacccaatacgccatgcgagtgcgatcccccattggtgcgccaaacaaggccgtatcccattggcacttcaggactgatgctatcggtttgttgtcaataccatggatatagaccaccgtaccgatttctggtgagttgccttccttgttcaatattgacggaaactctatggttgagttggccgcagagcgggaaagtaccgtgaaggggctggatgatttactaccggctgctttactggaacgggagcctcgtttttctgtggccatggtcttttctctctatctgaattgccctgattgctaccagagccgtctggtcgaaataatgccaatcaaataatacgccctgtccgtgacagacaggaatctaatttgcactggggaaggggatctcttatttttgcctgcaatgcgactcatagaggactcgaacagaggctccaagggatcaggttgctgctgtcagaacctgttcaatatctcgctaaaaggcgcattacggcgttgaaattgaactcgaaatgctcaacttcaattcaagtatgctccgctttctcgttcaattttgccttgcactatatcccttgatcgagatcttgagcaggttctcagcatcccgattatttgattgattgctttgccgattggctgatgcgcgtggtttcggcttcgatccatgcttccgcccgggccatcagttcgccagcttcgattccgtttggatcgatcggcttgccaatgctcagagtaatggtgccgggatatttgatgaaggaatttctgccccagaattgtccggcgttatgcgccaccggcacagccagtgcacccgtatgcaccgccagccaggcaccgccgatacggtatttgccctttttacccggcgggatgcgcgtcccttcaggaaagacgacgatccagaaattctgttgtaaccgctccctcccctgctccacgatctgctccaacgctgccttaccagcactgcggtcgattgcaatcgggctggtcatggccagcccccagccaaagaatggaatacgcaatagttcttttttgagcacccatacctgtggcggaaaaatctgctgcaaggctagtgtttcccaggcggattgatgtttggaaagaataattgacggctgctccggaatgttttctcgtcccagtacttcataacgtaggccacaaatggtgcgcagcatgaacaacatcagtctggtccagccataggtgacctgatagcggcgatgaggaggcagcggaaaacatgccaaggcaaatagtgcatacagtggcgtgatgatcgcctgcagcagcatataaatcagggaacgtaaaccggccattacagtgcctgtatttcgagactgtccaccactgccgaaagatccgggtaaatttgcgttcccgcaggcagatcgccgttcgccagtgtggcttggcccttgccggtcagtaccagtaccggtacagcacctgctttggctgcagcctgcagatcgcgcagggaatcgcccacgacgggcacatggctgagttcaacgctgtagcgttgccggatttccttaaacatgccgatacccggcttgcgacaaacacatttatcatgctgagtgtgcgggcagaaaaacagggcatccagccgcccgccttcctgctgcacagcgcgaaacatcttgtcattgattgcattgaaggaagtcatgttgagcaaaccacgcccaatgccggattgattggtggcagtcaccactcgataaccggcgtgagtcagccgcgcaatcgcttgcaagctgccagttatcggtttccactcatcaggcgtcttgataagcgtatcaccccgctgattgatgacaccgttctggtcgagaataatcaacttcatttatttgctatgtattctcaagccattcaggcagctagtcgagaaatatctgccacacgattcatcgttgcctgtaaggctgccagcagggccagacggttacgccgcaacacttcattttcatcattcaccatcacctggtcaaagaaagcatcaatcggcgcttttaaggcagcgagcatttgcagggcagtaacataatcacccttctggaaggcgtgacgggcatcggattctatttcagacaacgcacgatacagagcaatttcagccggcgcctgcaagcaggccttatcaatgctgaccgtggcatcaaattccgattttttgaggatgttgctgacccgcttgttggcagctgccagactggctgcttcaggcaaggcagtaaatgcccgtacagcagctagtctcctggggatttcacacaacagggagggccgcagattcaggacagattccacctcctgaactgtgtagccttgatcacgcagactgctggcgagacgatcgtaaaagaaatcctgcaactgttctgtcagctgtggtgttaccggacgggcatggcttgatcctgggctttgttccccgctgatttcatcccgcagtacaccagctgcgcgtgaaatcagcacatccagtccgatcggtagatctttctcgataaggatgcggattacacccagtgcatgtcgccgcagggcataaggatccttgtcccctgtcgggagttggccaatactgaacaggctgatcagcgtttccagtttgtcagccagtgccacacagatacccgtcatgctgcgtggtaatgcatccccggcaaagcgcggtttgtagtgatcctcaatagcgaaggcaatagtatcatccacaccttcgcgctgagcgtaataacgccccataatgccttgcagctcgggaaattctccaaccatatcagtcagtagatcggccttggccagcatcgcggcctgattcgcctgtgcagacaagtcgccgtcgcccagcaactgcccgataatttgcgccaaggcacgtacatatcgggtacgttcgccctgtgaaccgagttgatgatggtagatcaccttgtccagatcgggcagacgtgaggccaatgttcgtttgcgatcgtgatcaaagaaaaattttgcatccgccaatctggaacggatgacgcgctcgttacccgcaatgatctgccctggatcagccggcgtgatattggaaacaatcaaaaaacgattggtcagttttccatcagcatccagcagggggaaatatttctggttaattttcatggtggagatcagacattcctgcggcacttccagaaaatctgctgaaaatgttcccatcagaacattggggtgctctaccagcgccgtcacctcatccagcaaagctgcatcctcgatacactgcaattgtgctgcacgcgcggcagtctccaacccttccctgatgcggctgcgacgacgatcaaatcccggaataacggttccttctgtttccaggatgtgttcatagtgatccgcatgattaatcaccagttccgcttgctttgcttcaaaacgatgcccccgggtggtgttcccggcagagaaccctaaagcgctgatcggcacaatctgctgtccatgcagggcaatcaggccatgtgccggacggataaagtgtacattctcccagccatcatccagctgataggtcatcattttggcaaccggtaactggcgaatggcctcattcacggctttttgcaaccctgccgccagcaggattccggtaacgctctgctccaggaacaacatctctgccttgccttcttgtacccgtttgaacacggagacagcaacattttccactcccaatgcagccagttttttatgcagcgccggggtgggctgcccttgcgcatccagcccgactgccaccggcatcaatttgagggtgacgatctgatctggtgcctgggcagaaatagcagtcagatgcaccgccagtcgacggggtgaggcaaaaacagtcggcaccgtgtccggcgtggtcaaatactgttgttttagactatcagcaattaatatggcaaatgcattgcccagttttgcgagtgatttgggaggcagctcctcggtcagcaactcaattagcagactttcagtcgtcatgctgactccacctgatccagggtctgagcaacccattcacgtggtgccaatggaaatggcggctgcagacgcaagcgactgtcgtagtaggcttgtgccacccgacgcgacagattgcgaatacggccaatataggccgcgcgttcggtcactgaaatcgccccacgcgcatccagcagattgaaagtatgcgcagccttcagcacctgttcataagcaggcaacgccagttgtgcatcaatcaatcggttggtctgtgtttccagtttgccgaaggaaagtagcaaaaattcgatatcgctatgctcaaagttataagtggattgctccacctcgttttgatgatagacatcgccgtaagtcaacccctccgtccagagcagatcaaatacgttctccacaccttgcagatacatggcgatgcgctccaagccgtaggtaatttcacccgtgatcggacggcaattgatgccacctacctgttgaaaataggtgaactgggtaacttccatgccgttcagccatacttcccaacccagcccccaggcaccaagcgtgggattttcccagtcatcttctaccagacgcacatcatttttctgcaaatccagccccagcatctgcagtgagcggaaatacaactccagaatatcccgtggcgcgggtttcagaacaacctgaaactggtagtaatgctgtagacggttggggttgtcaccatagcgaccatccttgggacggcgggaaggctgcacgtaagcagcacgccacggctccggccccaaggctcgcagaaaagttgcagtatggctggtaccggcaccaacttccatatcatagggttgcagcaaagcgcatccctgctgtccccagtagtgttgaagggtaagaatgatttcctggaaagtgggggtaggcatgtcatagtagcttgataatgaatcggggcattttacagagttttgcgcctgccggaaaatgccgccaagcaaccggtaagtagcagcaaaccaattagccagaataagagactgttacctaggcgcacatagggtgtggccccgccaaagccctgcacggtgctgtgcaaaccggcagtggtgaacatctccagctgctccagtaccctgccccgctcattgatgatggcagtgactccggtattggtggcacgcagcatgtaacggccggtttccagcgcacgcatctgcgaaatctgcaaatgctgacgcgggccgatggaatggccgaaccaggcgtcattgctgacattgaccagtagactagcctgtggcaactgcatgatgatttcttcgccaaacacatcttcgtagcaaatattgacagccacgcgctgcccggccagattcagcggctgctgatccagcccgccgcgtgagaaatccgataacggaatatgcagcacgtcgatcacccagccaaatatcggcttcagcggaatgtattcaccaaatggaaccaaatgatatttacgataactttgctcgggtgaagcaccaaaactgaacatagtgttgtaataactatcatccgccggggaacgttccaccaggccgatcagtacatcgccctgacgggagcgagcgtgttcggtcagcaattccagataatcccgtggtgcctgttcgtaatacagaggaaacgaaatttccggggttacaatcaatctgctcggactttcctgcaccagccggacatacgtccgcatggtggcggctagatgctccggctcccatttcatgttctgtggaatgttgccttgcaacaagctgacggtcaccggctccccttccggttgagtccagtgtatttgttgcaagctgaaaccaatgatccagacactgcccagccatagccagaaacgacggttttgtctgttttccaaccagcaggccagccaggcggcgctcagcatcagcaacagcgatatgccatacacgcccacaatcggcgcaaagcctgccagaggactatccggtgcttgtgaataaccgactgccagccacggaaaaccggtgaacagagtaccgcgcagccattccatcaatgcccagagtgctgccaccactcccggccacgcccaggaggcacgaaaataccgcagcgctgcgatcccgccagccagtgcaggaaataatgaaagataggcacataacacgatcagcgccagcactgccagcgcgggcgccatatgaccaaaatcatgcagactgacgtaaagccaggtcactcctatgccaaacagacccatgccaaatgcaaacccggttgatgctgcttgcatgggtgttctgcttgtgcgccagagcaaggcaagcagcgccagtgtggcaacgggtgccggataaaaataaaaaggggcaaagccggttactgtcaccccacccagcaggaaggcagcaatcagcctgtaataaccgttcaatttattgacactccggttaaatcacgagaagaaaagggaaaacaaggcttgatttttactgttttcccagttcagagatgaatttgaaagggaggtataacaaggcgtacaccacaaaaagataggcaataaaggcaaaaggattttcccggaaactgtcaatgatcgttttatgcttgccttcccgtttgaggcgatcatattcctcacgcacccgcgcactgcgctcaacctggtaggtatccagcaactcccgtgcctgctcgtattgagattcttcacgcacccataacgctggcatggaaattccccagttaccggccgtggtttcataaaaatcaatctgatgctcgctcagcagcacccgcacctcttccgcctcatcatccggcacatttcttaatttaaatagcagttttgacatttgccaataaaattctacaagataaactcgaattctctatcagaatgaagccgctgtctgcagcaataatttgtatcatgcatatatcatcactgataaattctcttcccggttgataatccactttatatctagctatctgtcaaaaagataaagctcagtaagctggccagcatgaatctgttatttgcttgtcatgaaagtggcaggaggatgtgaaaattctgcgcacgttgtcaaggagctatgtagaaatattgccgggataagggtattctgcataactttcatttacctgaaaatataatgttgggaacgctcggcgaatctgttatttaggatgcaaccttgattagaaatcgccataagcttgcgtaaaactgaaaaaattaccatacggttcaagcaagagcgctcttttgttaaactccataaaggataaattgagagagacatgtctaattttattcgcactatcatagtaattgtttatctggtgtgtgcctctggcggtgcctatgcatcctcaaaattacctgaaacaatcagagttgaatccgctgcactcacatctgagccgccttgtgatcccaaaattccaccagcctggcgtgatgcgcaagttattgaaggcgtgaaaattgatgcagatccaagttgcagcccggataatcctgcctggattgccgttgctgttaaaggaaccaataatgtttccatggatacgcttatgcaaacgcacttttctccagacgccatcatcaagacagatgatctggatggagacggcgatcctgatcgtatcgttatcaagttggaaatcatggaattaaatggaaaatcccctgattttcccggccaggttcccacctttgatatcgctcctggcgtacaacccggcgcctgggtttttgcccccaaaaccagcggcatgtcaaccgaaaattttgaaagtgtgcgagccactccgctgatcagattgccatcaccggtaatccgggttgagcagggagatatcgtacagatcgtgctggaaaatacgcattactttccgcacagtctccatttacatggtgtggatcaccctttccattatgagtttaacggtaacgatggcgtacctcaaaccagtgaaatggagctgatgcctggtgaacgccgtatttatcaattccaggcacgtgaaaccggcaccatgttttatcactgtcacgtccaaacacatactcatttgtcaatgggtctggcgggaataatcattgttgaagaaaaccggcccaataactggctgcaaacattgaatattggcggtggccacgtacgacaccgatcagttgcgatcaaggaggattttgatcgggaatatgatttgcactaccattcaatggacaaggaactgggtgacattattaaggaatacaacgacccacgtttgactgcgcgcgacatgaaccgacgctaccaaatcaataatgctaccgaagattattttacaattaatggattatcatttccttattcactcagagaatcactgatcatagttgatccagacgagaaaattaaattacgtttactcaacagtggcagtgaatcaatcgcgattcacacacatgggcatcatgccatgattacgcactatgacggagtggagcacaatcctatagcacaaatcatgcgtgacgtgtttgatctagccccggcgcaacgtctggatctgaaactggaaaccatcaatgacggcagacacagttatggtgaaggtgactggctgatccatgatcaccgtgaaaaaggaattacgacaaacggtatggctgaaggtggcagcatgagttccattgtgtacacttcgtatcttggtgaaaacggcttgccggatacgagtcactttggtgttaatctcgaccattttttcaccaaggaatattgggaaagaaaggttcccgtttggcaagacctggatgaagccgctacttttggagctgccgcaggaagaacaatcaatcttgacaccgcaactcgtaacattttgctctatgctttaggaggattgctggctggattgctcctgtactcgatctttgtcggacgtagtcatatcaaacaatatgctgcagcattaattttacgaatcagagggaaaaaagggggtaaagcgtaatgaacgcaagattcaagatcatttttctgctggctgccactttgccattctgtttcgatgctatggcgcaacagcaggccacacccgatgaacacgatcaacatgctcagcacgaacagcatagtggtcatgaacagagtgaaccaaagcaggaagaggccacacagtccgagcatgatcacagtgggcacgacatgagtaccagcagcgaaacggcggctgaacatgaacatactcacaaggatcacagcattgatgccgaatcgcatcaggaaaagcctgttcaggatcatgcccataaggatcacagcattgatgctgaaacccacgaacacccgtcagagcatgaccatgacgtgcacctgggtggagcagctgatcatggcgatatgcatcaccaccaccatgtggatgatggccacatcatggatcatgaaggtacgatgatcatgggtcagaatcttgacaagctgcccagtggttgtaaaagcatttctgaagaagtggaaattaccgttcgtgcaggcagaaaatatgcaaaaaggtttcctggaaccgtttttgcctttgatcaacagcagtggcacgttaaaccttgttcaaaggttacttttcatttcaccaatgaagacaacatccgccatcaattcatgatgcatggtctgcctagatatatatatcaactcggcatgttccatctggaagtcacggggccgaaaactgtctccggcacaattatcgtaccgggatcggacgacaccttgctggtgcattgtgatattgcacagcacatggaaaaaggaatgaaagctcagctcgttattggtaagggtggccaggatatccctagcatccccggattgacgccttacaacatcaccgatgtttatgaagctgaagatctgccaaaaataagtgcatctgaaaataaacaagacaaaagcaaagtggtaagggaaattaccaagtcacttgccaaaagtgatacacaaaactacctgatacttctgattggagcactgatagggttattcagcattccactactcaggaaaatcattcccagaagaaaaaccagtaagaatgaggaataagtaaacaaaaatgtaagtcatgtcccttcgcatagccgtggggacatggcctcttcctccgtaacttgcaacacaggaaataatccatcctgagcaatcttccacctccacgaacttttcggtatgcccagcacgttataggataaagagtccgggtacaaaagaaaatcggcattcagaggatcatgcgcaagttacagctctgcaacgcaccatacacgcagcgcaggtcttcaagcgttacagtaacgggactgccagatggtgatctctcagatgagccgccgcagaaaccccttggctattgattcggcaatgtatcaatatataaatgacgccgtcccagagaaaatttctttgaaacactcaaggagttcaagcgcatcactttacacagcgacaaaaccgactatagcttctcgccagccatttacctgctatctgctgtcaccaactccagttgaatctcaacagaacctgatctggccaggcgccccatcccagacaataagctttagcagcaattggtaaagccataaacccgtgacaccggtaaaagctggtgtttttatcgatcccgtcttgcctggtactcgcccgtacagcccaaccctcaatcaataccgtacagtattcaaccaccattctttagtcacaggtgagctaaaagagcgcccaataggctgtaaatgtagtgtacacacgccaggcccttgtgctgcagcaacccggggagactcaatggcggcggcgtctgaagcgctgcgggccctcagccaaaccatttctgacccccctggtgcgggcagcatcttagtctggcaactgactccatcaaacaggtcatttcgcgttgttccatgatcctctctcctctcccggggcaaacgtttaagcgtcatagacaccaggagatgaataaacctgccactactgtttgctacaagaatttcttgaaacatcaataagggttgacatagatctttatcaaaggtaaattcgcgacccgattttaataaacggaaggggaaatataaaatgatctcaacagtttacgccattacactcgtagggataggcttggtcatggcagtcttttattttgtgataattaattccaaaaaaactgaagcggattatcaatccattacaaaaaaatggtacggcgtgcgcagtaaatggtttatttttttactggcactgggaatcatcgtcaccttcgcctcactgaatccatttccaattcctgatcaacacaaggaatattcaagcaatgattaccagaccgtcgcggtaaatggtcatcaatggtactggacaatgacacctgccaccgtaaaatcaggccagccggttgaattccaggtatctgccgcagacgtgaatcacgggttcggtatctatgatgaaaacctggtattgattgctcagacccaagctatgccaggctacaccaataaacttattcacacatttgacaaacctggaaaatttaagattctttgcctggaatattgcggcctggcgcatcatgtgatgatcaccgaattgatagttgaataaataaccctgcattaacaataacttattggagaatacaatgagtacaacagaagtaagcagcaagattgagtattccgattcagaaaatcggaatgcactaatcgccgttaaatctcacctgatagcggggttactggtatttttattgatgatgctcgcggggctggccatgcgggcggcacaaggcacttggttggaaattggcgctgatctgttttatcagataatgacagtgcatggcgcaggggttgtgggggccgcaatgataacctcgactggggtacagtggtactttctgcgccaatacgtacggctgagcaacggagttttctggaccaatttctttattttcttgacgggtgttgtgctgatccttggctctattttcttaggaaagtatggtggtgcatggacgtttctctttccgttacccgctatttcaatgggagcctggtccgcgggcgctgcagccgcctttcagctgggtttgctcatcatcggtgtggggttcttgattctctatctagatttcggccgcgctatcctagcacgctatggtagcctggcacgtgctctggggcttactcagctttttggtaaagaaccggtaaattacaagcacccggcagcagtggttgccagcacgatggtgcttattgtcaactttataggtattgctgcaggtgctgtagtactagtcatgggtctggttaatctgttttaccccgaattcaaaccagatgccctgttgatgaaaaatctgatctatttctttggtcacgttgtcatcaatgtcaccatatacgcatcagtcatagcggtttatgaactcctgccacgctataccggccgtccctggaagaccaataaaccattctatgcagcctggttcgctattgtatttctggtgatgggagtatatccgcaccatcttctaatggatttcccgatgccggcctggacgatggttgtcgcacaggtgctctcctttggtagcggtctccctgttttggtggttaccggttacggtgcgttgatgatcgtatatcgttcgggcatcaaatggagtacttctgctaaattgctattcctatcactgtttggttgggctgctggagtaatcccggctattctggatgcaatggttaccgtgaatcgtacattccacaacacgctgtgggtaccgggccactttcatttctacttgctgcttggattacttcccatgctcatcgggtttgcctactttttggcaggcgaaggtgacagtaaagaacgacctaaagcagttgatagccttggattctatgcctatctgatcggtgcattcatgacatccatggttttccttgccagtggcgcaaacagtatccctcgccgctgggccgtccatttaccggaatggatcggctttgctcaagcagggacaatcgccgcttcactggttgtgctgggaatgttgttattcatcacgcgcgctttaattagcctgccaggtgcaaacaacccccgctaaaacatagacaccccggcaatttctccaaataaaaatggagagttgctggggaatctgatagtagcactcgatacactgcacacggggaataagggatgaaaacttttctggcaacgtttctcgtagttatcgtgggatctctcgttctttgggtaagtaccgacgaaggacgtgcttttacagcagaagaagcgcgtcgccttgaaatccgtgaaacccctcgatctgtgcctgactggcgcctgcaaaatcaggacgctgaaactttcagaatccaggactggcacggacatttcattgtggtagattttatctacacaagctgtcctgatgtatgcctgatacttagcggcaatcttaaaaccctgcagaaagatttctccactgaggagaaatcagacaaacttcgcttcctcagcattagttttgatcctggaaaagatacccctcagcgactgaaagaatatttgcatcatttttctgccgacctcagatactggatagctgcccggccgatcaatccttcccagaaagcagccatcctggatttctttaaggtcatcgtaatccctgatgaatacggtggttacactcactccgccggctaccatatcatcaatccagatggaaaactggtcgccatatttgggattgaacagacagatgaacttcatacttacctgaatcaggttctggaggaaaaagaaaatgtatccaaaagctaaacaggcatggttactcctggcagcactggtcatactggctctccctccgatgcagcgatttctggaacaaagcatggtaatgcacatgcttgttcagattccggcactggcaatcataggatggatgatcggcaagatactgcctgaaaattggaaaaataatatagccccatggaaccaatggggaataacaggcatagcacttgctattattatcatgacctactggatgttgccacgcgtacaggatgctgctatatccgaatggcctgtcgaactgacaaaatttatcactgtaccaataatgggcatggcattgggaataagttggcctcaacttaaccctattgcacaaggggttctgaaactggaattttgggctacttttatgcgcttggggtggttgtatcttgatctgcctgatcgcctctgtgcaaattatcttttgagcgatcagcgtgtttttgggcaactattgttactggctggaagtatttgggcagttgcctgggcgcttagaatcacgtttggaataaaaattatcaacaactgaaacccgcggtgatctatcttcctgcagatcactgcgggtttcagttgcaggttcagatactatgtgtgcggtaccataaggttgagttaaatattaccgcccccagaatattgccgatcgttactggaatctgattccacagccaccactcagaaatcgtcacgtcagcgcctgacagtatcccaatcgggaagacaaacatattcaccaccgcgtgctcaaaaccgagcgcaaagaaggtggcaattggcagccagatcagcatgactttacctggcacactgcgcgatcccttagcaaaaaccggaccgagactgaccagccagttacacaggattcccataccaacggcggcaatccagccattcatcccataccctgcatacgaaacttttttctctgcaagatgggccaacgtagtaagaactcctggtggttctactgcccctcccttggtcagcgaaaaccagagcaaacaggcaaagaaaataccgccgaccagattggctacgaacgtccaaaaccagttgcgcaccacacttcccaatccgattcgccctgcaaacagtgccatgggcattacggaaaaactgccagtcgccatctccagacctagtatcgccagcatgacatagccaaccggaaagagcaggcctgctgctgccgtcggccatccttgcgcaaccagcaacgcacacaatgccgcaccataggcaagaaacggagtgcataagaatccccgcgtcagaatctgtgcaacattgaatttgcttttcttgactgcatcttcaacgagatcatgccccatctgcacaggcaggacactatcaataatcgcggtcggatcactacttgccttaaccggagtcatgctgcctgcataaccgccagccgacatactttctgcgatagcactggattgaatgacctgttcacttaaaataacagaaggtttttcagattctttcatattctctttaaggtagactaattgaggaaattaaaatagtgatgctgtgattgtatgcacagtgggcgggaattctgtcataactcaggatggccagcaagaaaaatagtgatgtatatttagcaggttacgggcatccttcgatgaagatgaagaaggcagtactttacgcaatcgttagctcgaatcatactaaaaagcatccggaaaattttcggctgactatcaataatctttacagaatcacggcctcctgcgctacctgctgcagagattgaattacacacctcaatgtcacccaaaaccactctggcatttacagtacaaaagcaaactgatctggtacgggtttatacatatccttccggattacatttctgccagcgccagtgatctcggcacatcgcagccagatcacgctgcgcattccaccccagtatcttttcagccagtgcaggatcagcataacaagtcgccacatcccctgcccgtctgggtgataactgatacggaacatgctggccacttgcattctcaaaagccttgaccacatccagcacgctgtaaccggtgccagtgccaagattgactgcaagacactgcggtgtggcaaggtgccccagcgcactgagatgccctagtgccaaatccaccacatgaatgtaatctcgcacgccggttccatcatgcgtcgggtaatcacttccccacacattcagatgttcacgccgccccaccgcaacttgtgcgacgaaaggcattagattattgggaatcccttgcggatcctcgccaatcaacccgctgtcgtgtgcacccacaggattgaaataacgcaggatggcaatgtgaaattgaggattggcccgatacacatcgcgcaacatttcttcaataataagtttgctgcggccatagggattggtggcagataacggatgatcttccgtcaaaggtaaacgttgtggttcgccataaacagttgccgaagagctgaaaaccagtgtgtatacagcacaattctgcattgcggccagcaaccggagagtactgacaacgttattgtcataatactcaagtggtttttctaccgactcccctaccgccttgagcccggcaaagtgaatgacagcctcacaatggtaatctttcagaaccttttcaatggtcgcctggtctcgcacatcccccctgactacagcaagtttcttaccggtgattttttctacccggcgcaatgcctccggatggctgttgcaaaaattatcaaacacgacaacctcatatccggctgtcagtaattcgacgcaggtgtgcgaaccaatgtaaccagctcctccagtaacaagaaccttcatatcaataccttatcagatctaaataaataccagattaagcaatcactgctgccgccgcgcaagcaaagcttgttttcatctaaatacgttttccctaagtattttaagcagatactggccataaccatttttggccagtggctgggccagcatttccagctgtgccgcatcaatccatcgttgccggtaagcgatttcctccgggcaggccactttaagtccttgtcggttttccagagtggcgatgaactggctggcatcgagcagagttgcatgtgttcctgtatccagccaggcgtaaccccggcccatgatttccacacttaactgatcttgttccagatataggcgattcaggtcggtaatttctagctctccacgtgccgagggcttaagcgttttagcaaaatcggtaacccggtcatcgtagaaatacagaccggttactgcatagttggatttaggctgcctgggtttttcttccaataacagcgccttcccgcgtgcatcaaactcaaccacgccatagcgctcaggatcaagcacatggtaagcaaacacactggctccctccgtgcgcgccatggcattggccagtaattgctgcaaatcatggccgtagaaaatattgtcgcccagcaccagtgcagaagggtgattgccaataaacgcttctccgatcaaaaaagcttgtgcgagaccatccggtgcaggctgtaccgcatattgcagattcaatccccattgctcaccactgcccagcaattgctgaaaacggggtgtatcctgcggcgtgctaatgatgagtatgtcgcgaatacctgccagcatcagggtgctgagcgggtaatagatcatcggtttatcaaataccggcaataattgtttgctcagcgcaagcgtggccgggtgcagccgcgtaccggaaccgccagcaagaataataccttttctatttgtcataatgattttctggcaatccgcagaaaaatgaaattgaagaatcaggggaacatgtgaattcttgcagatagaactagtccataaaatacggactgttatactacaagacttgcggcggatcgtgcggacatagacaaatccggatgaaccagccggcaagcagtttacctgttttgccggaatcacttaatcgcagataaagacccattttctcagtcacactgttcaacatgaaaaatatcggttttattggtctgggtatcatgggaaaacccatggtcagccatcttatccggggaggccacccggcttatctccattcccgcagtggcgtgcccgatgagttgacagccctgggtggaattgcctgccctacacccaaggctgtcgcagagcagacggatattattattctgatgttaccggatacgtcagatgtcgaaaaagtgctgtttgctgaaaacggtgtcatgtcgggcctttccacagattcagcccgatcgaaaattatcatcgacatgagtacgatttcaccaattagaacccgcgatttcgtcagacgaatcaaccaatccgggcatgattatgcagatgcccccgtatcaggcggcgatatcggcgcccggaacgccgcgctaaccatcatggtcggcgcaactgaaccggtttttgcaagaatcgaacccatcctggcgttaatgggaaaaaccgtcacccgcatcggcgagccaggtactggacagatctgcaaggcagccaatcagatcatttccgccctgacgcttgaagcagtggccgaagcgctggtatttgcttccaaggccggggcggatccaaacaaggtcagacaagcgttgctgggtggatttgctgcttcgcgcattctggaagtacacggggagcgtatgctcaaacacgccttcacacctggctttcgcgtcgatttgcacatgaaggatctggggattgcactggattgcgctacggagctaggcgtcagcctgccgggtactgcgctgactcaatcgctttataacgcctgcgttgcacaggaagacacgatgctggatagctcagtcatcgtgcgtatcctcgaaaaattggccggacatactatcaatccatccacagcaacctctcatgaatcgtaagcaactgattacagcctttctgaagtttctgcctgaagaagcgatactttacgaggaggaagatttaaggccgtatgaatgtgatgccctgtccgcctaccggcagatgcccatgattgtcgtgctgccgcgcacagaagctgaaattgccgctatcctgcaaatctgtcatgccggacaggttccggtcgtggcacgcggctccggcaccggtctgtccggtggggcactacctcacgcagaaggcattttactgtcattggccagactgaaccgcattctggatatcgatcctgctgcctgcactgcacgtgttcaacctggtgtgcgtaacctggccatcagcgaagccgctgcaagctatggaatgtattacgcacccgatccttcctcacagatcgcctgtagtattggcggaaatgtggcggaaaactccgggggggtgcactgcctcaagtatggactcaccgttcataacattttacgcttgcgtgtactgacaattgaaggtgacacgctggaaatcggtgctgacgcactcgatagccccggttttgatttgcttgcactgatgacaggcagcgaaggcatgctgggcattgtcaccgaaatcacggtaaaactgcttcccaaaccggaaacagtgaaattggccatggccgtgttcgacgatatcagcaaagccggggatgctgtcgccaacgtcattcaggcaggtattattccggccggtatggagatgatggataaaattaccatccacgccgtcgaggatttcgtacacgcaggctacgatcttgaaggtgcagcgattttgctgtgcgaatctgacggcatggcggaagaagtagccgatgaaatcaaacagatccagaccattctgcaagccagtggcgctgtccggatcagccttgcgcgagatgaagccgaacggcagcttttctgggccggacggaaagccgcctttccggcagccggccgggtttcaccggattactactgtatggacggcaccattccacgtaagcatttggcacatgtgctggaacagattgagcaactttcagctgaatatgatctgcgctgcatgaatgtgtttcacgcgggagacggtaatctgcacccgctgattctgtacgacgccaatcagccgggcgaactggagaaagcagaagcctttggcgcacgcatactggaaatctgcattcaatccggcggatcattgaccggcgaacacggtgtaggcatcgaaaaactcaaccagatgtgcctacaattcaatgatgccgaacgtgatctgttccatgcggtcaaggcggcattcgatccgcaatcgctactcaatccaggcaaagccattcccgaactgcaccgttgcgccgaactcggggcgatgcatgtccatcgaggcactgaaaaatttccagacatacccaggttctaattagacatacccaagttctaatttatgcaagatcaaaccattctcgatcagctcatccagaccgttacagaagcagccgaatataaacaggcgttatgcatccggggaggcggcagcaaggatttttacggcaacccgcaggcgttgcaacctcccgcgctcaacacggctacctggcagggaatcgtcgattatgaacccagtgagttggtcatcactgctcgcgccggaacaccgctggccgagctggaaaagctgctgcatgatcatggtcagatgctggcttttgaacctccttgcttcaatacatccgctacgctgggcggctgtgtcgctgccggattatccggccccagacgcgcctacaccggcgcagtacgcgactatgtattaggtatcggattgctggatggccagggcagaaccctgtcttttgggggacgtgtcatgaagaacgtggccggttatgatgtctcccgcctgatgacaggcgccatgggcacgctgggggtattactcgaagtgtcacttaaggtacttcctaagccggctgtagaacgcaccttgtgcattcagaccaacatgccccaagcgatcggaatcatgcgccgctgtgcagctgaaccgctgccggtttccgctacctgttttcatgagaatcagctttatgtccggctttccggtgctgaatccgccgtgcacacggcacatgccagactgggtggagatgaaatcaaagataagggaagttgcgaggaaaatttctggaaatccgtcagggatcacacccatccgtttttccagcaaggaaaatcgaatggcaaatcgctgtggcggctgtcgatccaatcgaccacccctccgctttcgctgccaggtgaacaactgatcgaatggggcggtgcactgcgctggctggtgacagacgaagataccgatgctgccaagatccgcaaccttgcttccggtgccggcggccatgccactctattccatggcaataaaaccgcaatccccgtatttcacccgctttcccctgccctgcttaaaatccaccagagactgaagcagcagtttgatccggcaggtattctgaatccgcaacgactgtatgccgagttttaaaccatgcaaacccgtctgactgatctgattaaagacaccccggaaggcaaggaagccgatgccattctgcgcagttgtgtgcattgtggcttctgccttgctacctgccccacctaccaactgctgggaaacgagctggatagcccgcgcgggcgaatttatctgatcaagcagatgttggaaggccaggaggtaacagaaaaaacgcagctgcatctcgatcgctgcctgacctgccgcgcctgcgaaaccacctgtccatccggggtacagtacggacgtctgcttgatatcggccggggcatggtcgaacagcaaatccagcgcacgccttatgcaacattcaagcgctataccttgcgcaaactgttgcccaaccgtactctctccagctttttcatgggcgctgcccgcttaagtcgcccgttgctccccgcccggctgaaaagaacgatcttaccgaaaccggtaactgcacgcagcctctccggcaaaacccacacacgctccatgctgatacttgctggttgcgtacagccagccatgacgcccaacaccaaccacgctaccacacgcgtgctggacaggctcggcatctcggtcatcaccgcggaacaggccggctgctgcggtgcactggcttatcaccttaatgcgcaggaagaagggttgaacgccatgcgccgcaatattgatgcctggtggccttttatcactcgggctgaacatccggcagaggctattatcgtcacagccagcggctgtggcgtcaccgtcaaggattacagacatctgctgcaacacgacccagtttatgccgagaaagcggaacgaatttccagcctgacccgcgacatcagtgaaatcatcacggccgaaacctccacactgattccgttgttggaagcagcaaaaaccgcatcgacatcctcctcgttcccacgcaaccttgcctttcatgccccctgcaccttacaacatggcatgaaactaaaaggaaaagtcgaaccgattctgcaagcagcaggctttaacctcaccaaagtcgctgacccccatctctgctgcggttcagcgggcacctattccatcctgcaacccaaactttctcgtcagctacgtgataacaagattactgcattgaccatggaaaaccccgatctggtggttaccgccaatatcggctgccagatgcacctgcaaggcggcacccggctgcctgtacgtcactggattgaactgctggatgaaactctgggcggattaggataatccccaaacatcagggaaacactctttatccgcgcggccgcaccgccgtcagcggcaattgattcagctccgccgtggcctcgcgccagactggataatactgatccatcaatgcaacaaaccgtttgttatgtgatgcttcaagtaaatgaaccatctcgtgcacgacaacatactcaagtaaatttttcggcctggtgaccagatcggtattcagccggatatggcgggtacgcgggttacaactaccccaacgggttttcattcgctgcaaaaaataggcagacacactcacatccagccgatcctgccattgctcgatcaaaccgggcaccacgccatgcagcaaggatttgtaccaggcatgcatcaccgcagcacgcctggataaatcactgcccggacgcacctgcaggatgatggactgctgatccagcaacacacaaggtttggcttgtttctccaccacctgcagcacataatgataaccccatacggtatggctttcatacgcaaccaactgctggggcgcttccctgacctgcaccaacagctttgcctgctgcttgcgaatccaggataattttgaaacagcaaaggcatggatcctctccaacctggctccaaaaggcgcaaccagtgtcacccggccatccggcgggtgcacccgcaggtaaacatgcttcactaccctgcgttgtatgaaaaccgtaagatctcccagcttgatctgctcgctcaccagtcactccgctcatctttgattctatgcagccccgaccgactgtcgctgcaaaaagcctgcgatgatgtgatctgcataaggccgtgcaacctcacggataaaatgcgggaagtcgatgtgggcgttgtcatcggcgcagtcagaaatggtgcgaacggcagcgaacggtttgccgaagtcactgcatacctgcgccaccgcagcgccttccatctcgacagcgagtgcctggtggccagctgcggcaagcgcggtacgcagcgcagtcgattcggccagcgtgctgacaaagcgatcaccactaacgatcaaaccctggtgaacccgcaccgcatgggtgcgcgtgacaccactgttttgagggttaaaactgacttcaacactcgccagataagcactagcagcttcaaataatggagcagacagttccggatcgcaggcaaatcgcgtgcacccataacctggtacttcccaacgcaggaaaatgggcgatgcatccatatcgtgctgcagaaattgcgtagcgacgaccacatcacccacctgcacaccttcccccataccaccagccacacccgtaaacacgatacgctgcgcacccaatcgttcaaacagcacaacagctgttgtcgccgctgccaccttgccaatgccagataaccccagcaccaccgtctggccatgcagccgaccgcgccaaaatacacgccccacatactgaaactgctcccgatcctccagcgcctgtaccaaaccgccctgttcttctggcaaagcactcaaaattgctgtagtcattggtaggtattaaaaaatccggaaatttttgatgtaacccaatttcgcatcggcattgctcatagaagaacagttaatcgggccagagcagatcattttcctgcgccagcgccctgccccatgcttccagttcattcagaatttcctgctgcgcctgttgcggacaatcggtacgcagttgtatcagcttctgatgatattcgtttaatgtcagactgtcgttgatggcatcttcaccaagctgtctgcggcaatgaacttgccagcggtgtttttcctgggccgacaaggtatcgggaaagttgcgggcacgatagcgaaacagcagttcagcataacgtccatcctgaaattcttctgagagatcaatcaatctctccggttctgaatcgcgcacgagcgggaacaggttacggtcgtgatcgtttgcaaaaccatcgtacaacgccagatcggcatcattttctggaaaaatcttgccattcgcgtacgcttgcctgatccgctgcatgaaatcagggttttgctgcaacaattgccaatgctgctggcactgttcaatattcaatccaattcgattggcgacttcatcattcagaactttctgtggcgccagtgccgggcatttattcagcctaatcgtcttgaccggcaggcgctgctgcccttccgccagttccaatttgggcgtgaacagacgttccaccagcgcatcaacattcagctgcataaattcaacaggatcatgccgcaagtcgtaaaccagaatactgttggtattgcctgtttcgggcagcagcggcatcaccagcgtagtgcaaccttgttcggatggatacatacgcgaggtatgcaataccggggcatgtgctgtcagatcgagcagacgagatacttcacgcttatcccgcaaacggaacagccagtcatacaaacgcggctgccggtcacgtagcaagcgagccagtgcgatggtggcgcggacatcagacaacgcatcatgcgcgctgtcatgcgtcaacccgttggctgcggcgatgtcctccagcctgaaactcggttttccttcatcattacgtggccagagaatgccttccggccgcagagcaaaggtcatgcgggcaaggtcgatcacatcccagcgcgaattaccggattgccattcgcgtgcatacggatcatagaaattgcggtacagcgtaaatcgggtgacttcatcatcaaaccgtagcgtgttatagcccaccccgcaggtacccggttgtaccagctgcgcatgaatcagtgcgatgaattccggttccggcaatcctcgggctgctgccatttgtggggtgatgccagtaagcaaacaggcttccggatgcggcagacgatcgcgtgccggcttgcaataaatcaccaacggatcaccgatttcattgagcgcttcatccgtcctcaacccggcaaactggaatggccgatcccagcgagggttcgcaccagaggtttcataatcgtgccagtatagtgttgaggtatccattcgcataatggtggttagtccgtaacaggttggaaaacgcggatttattttcccgatccattcctgaataatcggggcttaacaaaaatctcgaatcaatcctgatctgcccagagaacatatatcgcttgtttcaaagctgctttcctaccctttagcgtatgggtacagaaaaatatctataaatgtctattctggttaaagctttgcaccaaacccccgttaaataggctatcaacagatctattttatcagcctgaaccgggcatttgatgtcgtatagattacattaatatcttcattaaattattcattcatggatctacaatggtaaagttcctcaacacaagtgcgacaaattacttcctcgaagaactcataaaaagtgcaaaggatcggctcatcctcatcagcccattccttcgcctgaatgacagaatcaaagaattgctggaagataaaaatcgcctgaaaattgacgtaagagtcgtctacggaaaaagtgaactccagccagaagaaattagctggcttactgaactcttctatttacggactagtttttgcaagaacctgcacgcaaaatgctatctcaatgaagaattatgcattatcaccagcttgaatctctacgaattcagtcaagttaacaacaacgaaatgggtgtgctcattcagcgctctgaagatgccgagctttatcaggaagcttacgaagaagcacaacgcatcatccgtatcagtgatgaagtacgcatttcagtcgagaccatcggaaaggaatcggaatcaacagctgaaaccgatgagcagtccacagacaagctaacaacttccaagctggcgcaaaaaatcggaatcaaaactatcgatcttatagagcaattgacgcacgctggttatctcgaagtacgggacggtaaaaattacatcacattcaaagggaaaaatgccgggggtgaattccgcatgagtccaaagtatggcccttatttcctttggcctgaaagcttccgactgtaataattatcagccattcgtataccacatccagaatattcttcaggagccaccctcaaacatgagacaaatgatttgtaaagtatttgttagccacccccatataacaattcattcaggccaatactgttttgacgtggtttcattaaaccacatcaaagtgttggatctgttcacccctgaggagtatgccaactaccttgcttcatgtggatatataaacaagtaaattcaaaatgatctaatctttctctttggctaccaaataatgatccgcagaaagccgttacgtttttttcaatgccccgttagccccaaccgctgccagatttttgtgggtagtacggccgagttaagcgtgtagaaatgcaggccgggtgctccggcttccagcaggcgcgcacaaagtgcggtgaccacatccagcccgaatgcctggatggaaggggtgtcatcaccaaagctctccagttttttgcgaatccagcggggtatctccgctccacagccatcggaaaatcttgccagttgggaaaatttgctgatcggcatgatgccgggaacgatcgggacactgatattcgcagcttcgcacatctctacgaaatgcagataggcatcgacgttatagaaaaactgggtaatcgctgcattggcacctgcctcaacttttcgtctgaagttggtgaaatcctccagtgcggaacgtgcctgtggatgatattccggataagccgctacttcgatccagaaagtatcgccaaactccttgcggataaatgccaccagctcattggcatagcggaattcacccgcctgcgccatgcccgaaggcagatcaccacgcaacgcgataatgtggcggatatcgtggctgtgatatttttcaagaatggagcggatattgtcgcgggtggaaccgatacaggatagatgcggcgctaccggggaaccttctgcctggatttccagcacggtttccagcgtccgctcccgagtggagccacctgcaccaaatgttaccgaaaagaacttcgggttgaagcgggcaagttgtatgcgcgttgcccgcagtttttccatgccttccggcgtctgtggcgggaaaaactcaaaactgaatgtaggcataaaatttttctgggataacatctggacttacttccattggccacttccctttaaaggaagcagtagtgagaatctatgaaataaaacccaaattttccatcagatccttgcagcagcgaaaaacaacctttcaaaatctgctggattgcttgacacctacagtgctcgcaaagtcggtattttgtcacctgttgaatttcgcatcttctgccctgatgaaaaacccgggataaagccggaggaatacaactgtcgctttgacagcgatttctccggcttcaatcagttcaaccactcaaactcaataacggtacatctcgggtttataaggtccgtttttatcgagattgaggtagtgcgcctgctcgtcggtcagttcggtcagcttcacacccagtttacccagatgcagacgtgcgaccatttcatcgagatgtttaggaagtacatacaccttcttctggtaatctttaccgttttgccagagttccatctgcgccagcacctgattggtgaaggagctggacatgacaaaagacggatggccggtagcacaccccagattaacgagacgcccttgtgccagcacgatgatgcggcggccagttgggaagatgacatgatcaacctgtggcttgatgttttcccactggtacttctgaactgaggcaatatcgatttcagaatcgaagtggccgatgttgcatacgatcgcttgattcttcattttcagcatgtggtcatgggtgatcacacgcagattgccggtggcggtgacgaaaatatctgctttatcacaggcatcgtccatggtcaccacacgatatccttccatcgccgcctgcaatgcacagattggatcaatctcggtaatccagacagttgctcccaggccgcgcaatgactgcgcacagcctttgccgacatcgccataaccacaaatcacagctatttttccggcaatcatcacatcggttgcgcgtttgatgccatccaccaatgattcacggcaaccataaagattatcgaatttggatttggtgactgaatcattgacattgatcgccgggaatggaagttcacctttcttttccatttcgtacaggcgatgcacaccggttgtggtttcttctgtcacaccgcgaattccggcaaggttacgcgagtaccagccaggatggctggtaagacggctacggatggaagcaaacagtacctgttcttcctcattggacggattggcaatcacggaaggatcgcgttcagccctgctgccaaggatgagcagtaaggtggcatccccgccatcatccagaatcatattggcggcatgcgagccatcactggtccattcaaatatctggtgagcgtagtcccaatattccttcagtgattctcccttgtaggcaaatactggaatatcgcgggcggcaatcgccgcagcagcatgatcctgggtggagaaaatattgcaggaagcccagcggacttctgcacccagtgccaccagtgtttcaattaacacggcggtctggatagtcatgtgcagggaaccggcaattctggcccctgccagcggcttcttgccggcatactgttcgcgcagcgccatcaaaccgggcatttcagtttcggcaatggcaatttcctttctgccccaatctgccaatgacaaatcagccaccttgcagtcggtaaaaacagagttgtccactacggggttgattgttgcactcataacacatctcctgagaagtgaaagagcgccgttgttgggttgttcatttgtccgagcctcacgagatagaccgttgcagcgctcctcggtacaaatggaacatcattcacgctgaatgatgttgatgaaaaatattcaaatacctgcatccgctttaagctgctctgcaatgtcggttttctcccaggtgaagctgggctcttcccgaccaaaatggccatacgcagccgttttgctataaatcggacgcagcaggttcagttcatgaatgatcgctctggggcgcagatcaaaattccgggtgatcagctcggcgagtttttcatctgaaactttaccggtaccaaaagtttccaccattaatgaaaccggcttagccacgccaattgcataagccacctgaacttcacatttgcgtgccaggccggcagctacaatatttttggcgacataacgggcagcataagctgctgagcgatccaccttggaaggatccttaccggaaaaagcaccgccaccatgatgggctgtgccaccgtaagtatccacgatgatcttgcgcccggttagtccgcaatcgcccatcggcccgcccaccacgaaacgaccggtaggattgaccagataccgaatatcactactcagcatttctgcaggcaacacaggtttgatgatttcctcgacaactccttcaaacaaatcgccattggaaatatccggatcatgctgggttgaaataacaactgtttctatgtttttcggttgtccgtcaatataacgtactgaaacctgggatttggcatccggacgcagccatgacagctggccgctttttctcaattttgcctgctgttcaaccagacgatgtgcatagtaaatcggcagcggcatcagttgcggtgtttcatcacaggcataaccgaacatcagtccctgatctcccgccccctgatccatctcctcttccttgctgcgattcacccccagagcaatatcgggagactgtttgttaaaagcggtcagcaccgcgcaggtgcttgcatcaaagccaatctcggaactggtatagccgatttcacgtaccgtatctcgtgggatgacgttgtaatcaatggtagcatgggtcgttatttcacctgacaaaacgatcagccctgtactgcacatggtttcacaggctacacgcgcatgaggatcctgttgcagaattgcatcaaggattgcatccgatatctggtcggccaccttatcagggtggccttcagatacggattcagacgtaaaaagatagttactcatagtttgttttgttaattaaatttggatatgaatgagataatactcaggcaagagtaaaaccaattccggatttgaggccaaagactgcagttatttattaaggtacagtgcaaaactaccttaaagcactgcttgttgagcaaccggattattccagaaatccgtatgaaaatcattgttctttttactgaccctgcctagatcaggtaatgcggatgcaataatctgtcattttttcatctcaatgctcccggaaaatgccgattatcttaaccatctacaggagttttccatgaatactgttttgattaccggtgccaatcggggaatcggattggaatttgccacacaatatgcggcagacgggtggcaggtagtcgcctgctgccggcaaccgcaacaggccatggcactcaatcagctggctgagcagtacaaagatcatttttccatttaccagcttgatgtacgtgagcttgccgaaatagatcagttgtcacaaaagctgcatgatttgtccattgatgtgctgattaataacgcaggcgtttatccacctgcacaaaatggggagtttggtcatatcaactatgatgactggatggaggccttcagggtcaatacattcgcccccctcagaatggcagaagccctggtgaaacaggttgctcgcagcaaattgaaagttatcgccaccatcaccagcaaaatggccagtatcgacgataaccagcgtggcggcagttatatttaccgatccagcaaaactgccgtaaacatggtggcaaaaagtcttgccattgatctgcagcctcgcggtattatttcagtgctgctacatccaggctgggtgcagaccgatatgggtggacgtggcgcgttaatcacggcaaagcagagtgtgaccggcatgaaaggcatcctggataaaatcacccatacggatacaggcaaatttcttgcctacgatggacagcacatcccttggtagtcttttttacctgcctttcaagcaacaaactttcactggtaaccaaatgcgctcatcttatgttgtgcaactcgacgatgaagcagcaactttgttcctgggagagcagcttgcagccatacttcgccctggtttgaccgtattcctttatggtgatctgggagccggcaaaactacactcgcacgtggaatattgaaagggctggggcatcatgacaaggtgagaagtcccacctataacctggttgaaatctacaaactttcagagttatacttgtatcactttgatttttatagattcaatgacccattggagtgggaagaagcaggcttccgggagtatttcaaccagaattccatctgtctggtcgaatggcctgaaaaagcaggggaatttctgcacgcagctgatctgaaaatatggatcagttattctggaacaggaagaatcgccgaactcaaggcggaaacggaggcaggagaacaatgcttatcacgctggcaaaaacaggtatccgaatgaatcaacccggaaccaggcagtgctctccatttctacttttcgttatagctatccttctgcaactggctttgtatagcaacgatacatcagctggtactcaaatcacggcagcacgctactgggcgggacccgagtatacccggttgacactggaatcgagtaagccggttaaatactcggtcagcacactccaatcacccaaaagaatcgtgatggacatggagaacatttcattgtccgatgtactgaagagcttgccagcaaagaccgaatcacgggatcccctggttggtgcattaagagtcggcaatttcaattcgcggactgtcaggctggtcgtggaattaaaaacagatgctgtacccaaagcattcgcgcttgatcctgtagaccaatttgggcatcggctggtgctggatctttacccatcgaaaaaactgataacagaaccgtatgaacaggacccactcatagcattaatacaaaaaaacaagaaacctgcgccagctgctcatacccgcaatgtaaccctcgctgcgacttcgaaggctgtcctgacagcagccagccgcaaacctgaaaagaaccggattattactatcgcgattgacgccggacatggcggcaaggatccgggagcaattggtccgcaaggctccatggaaaaaaatataaccctttccatcgctagaaaactcaaggccagaattgacaaggaacccggtatgcgttccgtactaattcgtgacggagattacttcatatcgctggctgaacggcgtatcaaggcaagacaagccaatgccgatttatttgtatctattcatgctgatgctgctccacggagagaagcacatggtgcatcaatttacgcattatcagaaaatggtgccacttccaccacagcgagctggctggccaaaaaggaaaatgcggttgatctgatcggcggagtcaaactggatgacaaagatcgatacctaaagcaaacactgattgatctgtccatgaatgccacgattaatgacagtatccggctggccaatcacatattaaatgaaatcgggacaatcagccatctgcacaaaaaaaatgtggagcaggctggttttgcggtactcaaatcacctgatattccatctgttctggttgaaaccgcattcatcagcaaccagactgaagaagccaaacttaattcagagattcaccagaataaattggttgatgcgatatcagtcggacttaaacgctatttcaacagcggatcctggcagacacggatggatgttgctgataccagataagagatatcagcctctaccggttctcagactacactgttttaagagatgtctgcttatgggtaaaacagctccagtttgtagcccatagcattgagctgattcgtattcaagaaacattgaacctgtatttcactttcctccgcaaatattgactgatcagctgctgaatccagataatcctttgccgtaaaaatacgatttgcaagcagtttttcatcagcatctgttagcgttagcagtaatgccggtaacgcttgcgggaaaggcgcatgattgcggataattgcagaaagctccaccacatcaggatcagcggaagaactgacacgcaagtctgatgattccaggctcaataaatggagatgacgcggtaaatcaaccttacattgcatcagggtgcaatattcattcagtacaggtcgaaatgcagggaaagcaataaatatttctgtacgataggcatgcataatctgccccagcagcaataccagcaatactgcattgggcaccagccaaagccgggaaatttttggtgcagacggttgaatgtcaaaataatcaacaggaggcggtgtttcagcaaccggcattacagtagcattatcagggtcggattgatccggatccggttggggcaacatcacaagcggttgaatacacgcccccggaacagctatcagtgctgtaaaaccgttgaatacttgcttacactgtccgcagcgcacatcaccgttatgcgaatgcagctgcccacccgtcaggcgaaaaatcgcatgacagccaggacagcgtgtcaccagtgtcatgatgtcctattgactgatttccgacctgcaagtagtacccatccctgatcttttgcagcaatctgcatatcaaaccactcgctgtaaatctgcagcacttcatcagcctgggtttccagtattcctgaaagcacgatacgtccgcctggttgcaaagcactcatcagaacaggggccagcatgatcagaggattagccagaatgttcgcgaccactacggaaacaggacgctgcctggtatcagcaggatcgccacctccagaaaaggatagcgcagtggtaaatgataatttatccagatcacagagattgttccgggcattttcgaggctggcagtaatggcattcggatcaatatccacgcccatcacccggtcagcccccagttttaacgctgcgattgccagaatcccggagccgcagccataatcaagcacgctgtcaccaggttgaagaaatttatccagccagcccaggcacaactgtgtggtcggatgactgcccgtaccaaaagccagtcccggatccagtcgcagattaattgctgcaggatcgggtaaatcatgccaagatggaacgacccacaatcgcgaggaaattttgattggctcgaattgcgcctgtgtcaatctgacccaatcttgttccactacttgcgtcaattgatagtctggcagcgcagatatccccatcacccgagctactgcctgcacaatttcatcaacattcgtattttcttcgagcaatactgttatctctgcctgttgccagaattgctccgggagagcacctggttcaccaaacaagggttgttcgtgatcagtcccttcacccgcatcatgtacatcaactgacagtgcgttttgctccagcaactgatcacttaccgaatcaacgtaatcggatccaactttaaaagtcagagagagccaggacatagctgatctgtgtaacaggttttctcacgatcacatcaagtcgtttttttgttatacagtgcaagcttgttttcaagatagtgaatagagacagaatcggatacaaagttacagtccgccaaaagatccagatgtaacggaatattggttttgattccttcaatgatcatttcggtaagcgcaatacgcatacgcgcaatagcgagatcacgattgtcaccataggcaattaccttggcgatcatggaatcatagtaaggtggcacgcgataattatgataaatatgggaatcgactcggatcccgggaccgcctggagcatggtactgtgtaatacgtccggctgagggagtcagcttatagggatcttccgcattgatacggcattctatggcatgtcctctggtcacaatatctttttgctgcactgacagtttttcccctgccgccacacgaatctgtgcttgaaccaggtcaataccagtaacggcttctgtcaccggatgctcaacctgaagccgggtattcatttcaatgaaataaaattcattgttctcataaagaaactcgaaagttcctacccctctgtaattaatacgcttgcaagcctcgacacatcgctcaccaatttgattgcgcaacttgatcgaaatacctcgcgccggcgcctcttcaatgatcttctggtgacggcgctgcatggagcaatccctctcccccagatgaacggtattgccgtattcgtcagccagtatctggaattcaatatgacgcggattttccaggtatttttctgcgtaaaccaccgggttaccaaatgccgcctgcgcttcattacgcgttgtaatcaccgcattcgagagcgccgcttcagtgtacacgacgcgcatcccgcgccccccacctcctccggctgccttgataatgactgggtaaccgatctccttgataattttccttacttcatcaagtgaatccggcaacgcaccctctgagcctggtacacagggaacacctgcctgcagcatcgcgtgttttgcagagaccttatctcccatcaaccggattgtatccggtcgggggccgataaagaaaaaaccgctcttttccaccctctctgcaaaatccgcattctcggataaaaaaccgtaacccggatgaatggcttccgcatccgttacttcagcagcactaatgatagcggggatattcaagtaactttgcgcagaagctgccgggccgatacagactgattcatcggctagcttgacatatttagcttcggcatccgcttccgaatgaaccactacggtcttgatacccatagtccggcacgctcgctggacgcgcaatgctatttctccacgatttgcgattaatattttttcaaacatataaattaaacgatgaaaaccagatccggatagattcctgaaaattcagagcattatttctcgaaagattattattcgataataaataacggctcgccatattcaactggctgaccattctccggcaaaatggctttgattttgcccccccgatcggtttcgatctcattaagcagcttcatggcctcaatgatacatagtgtatctccggactttacttgctgacctacttcagcaaatggtttggcccccggggccgaagcgcgataaaaagtacctaccatgggagacttgacaatatgtccttccggcaaccctggcttctcttgtacatcgctctcactggctatgggggctgccggctctaccggaacagggatctgatattgtggcataaccgttgccgccgattgtgtcatggttacggatttgctgatacggaccttctcttccccctctgttacttccagctctgtaatactgtattcctctactaattcaattaatttcttgagttttctcaaatccattttatcctccggggcagattcctttcataagtgccctgatctatcttcagggatagcagttttacgtcttttgatgatggctggtaactgatttgcttgtaaatcaattgatcaagtctgctttgtcatttgtattgatcaccgggtaaaaaaataatttaactgatttaggacaaatatatttgagtcatgccccgttttacactactgcctggccaaagcaaattgcagagccagctcataccccgcagcacccaatccactgataaccccaacagcaatatccgagaaataggatgtgtggcgaaaatgttcgcgagcatagatattggaaagatgaatttctacaaaaggcagatttgtggcagccagggcatcacgcagggctatactagtatgtgttaaagcggcgggattgatgataataaagccagtgccgtcattcatggcttcttgtacacgatcgatcaattcatgctcggcattgctttgaaaggtatccaacaccacagaagctgcctgcgccttcgcgaccagattcctgttaatatcttccagtgttgtatgcccataaatggacggctctcttctacctaaaagattcaaattaggaccgtgaacaaccaggattttcgcaaccattacactatattaactatccgcttccatgaattaattatggcgtgttatcgtattattgtacagttttttatgtattttcgccgaagttaaagaatgtttaacctcattaaatcacaaaacaagcaattcaggggtcacgttattcatctctcataaaacaacatctgacaataggaataatgagtgattttatagtgattggagctgggattatcggtcttgccactgcgctccgattacttgaagaaggggcatcagtcacgctccttgaacgtcacaaagctggctgcgaggcatcatgggcaggcgggggcattctgtcccctctgtgcccctggaactatccggacaccgtaaaccgactcgttgctttcagcacatcactctatccagagtggactgctgcacttagcgcggccacaggaattaatccggaatatcacgtatgcggacttctcgctcttccaccctatgacttggatgaagctgttagctggtgcgctgctcatgcggcaccgttgacataccagatatttccacttccaacccatgctagaaccccgggaatctacgattgcacccagcagcaagctgatcaggcactattgcttcctgacgtcgcccaagttcgaaatccacgtctgtcacaagcgttatgcaagcgcgtcaaacagcttggtggaaatataattgaacactgcgaggtccagaaactgaatgcaaccagacaggaagttagatccatccgagtcccacataaaaacctctcagccgatcgatacatcctgtcagccggtgcatggagcaggaatattcttggagaatatgcgttgaatgttgaaataaaaccaatccgaggacagatactgttatacaaattcccggaaaaacctttgcattctgtcgtattgcaacaagacctttatctcattccccggcgtgatggacatttactcgtcggcagcacaaccgaagatgtcggattcgataagcgcattacactggaagcgaaagacaaattatccaaatgggcaggaaaaatattaccaaagctgagtaatatgttgccgctaagacactggtcaggcttgcgccccgccacacctggcaatatccccgttatcggggcacatccattccttaaaaacctttatgtcaacagcggacattttcgctatggcgtcacgatggcccttggcagcgcagaaatattaacaaacgagatcatgcaacgagctcaaccttttgataccacaccctatcagcaaggatggaatctgtctgggtaatttcaatcagatatgcttgttgaaaccgactggctcagcctttggcaatgggaatgttacggattcaaggactcccgccagctcttccaccaccacaccctgattcgactgttttgtcgcaatctgctcaagacgctccagtacctgctgaaccagtatctccggagcagacgcacctgcagtaattccaatacactgcttgttggccagccagctctcctgcaactgtgccgcctgatcgaccatatatgcttctacattttcgtttctggccacctcacaaaggcgatttgaattcgaactgtttggcgaacccaccacaatcaccagatcacagagcttgaccaactttttgacagcatcctgtcgattttgcgtagcgtagcaaatatcatcttttttcgggccaacaatctttggaaaacgtcgtttcagtgcctcaatcacgcgcgccgcatcatcaacagacaatgttgtctgggtgacatatgctagattatcttcatccttgacctgtagtccggatacgtcttccgctgtttccacaaggtacatcgtcccttttttcttctcgatctgccccatggttccctcaacctcagggtgaccctgatggccgatcatgacgatctccttgccctctcggtccattttggccacttccacgtgtaccttggtaacaagcggacaggtagcatcaaatatctgcagcttacgagcggctgcatctcttcttacttcgtgggaaacaccatgagcactgaagataagcatgctcccttccggcacttcctccaaattttctacaaataccgctccttttttctccagatcttcaaccacgaaacgattgtggacaacctcatgcctcacatagatgggggcgccatacatcgtcaatgcacgttcaacgatttcaatagctcggtcaacaccagcacagaaccctctcgggtttgcaagcaacaccttgatcatcagcctatttctccatgatttatgcacaggtttgattataaaataatcctgaaggggttttcagttttcatctctgaagcctatcctattaacacatactcgtcattcatctttatcccgtttcacccgatttgataaggctataaacagaatgataattaaatcttaagcctccgttatatataaacttcttaaaatcctttctctctggctgtatactttcaaaatatttcacgacatacgtgtttaaccagcttcaaaacttgatggttttatttgagtactcctgatgggcgcactgattttttatacttttatttatttcgtcgggcatttcgctgcgctcgggctaaacataattacaaacaaaaaactgctcaaccaccgcttggtcggcttgattggcgtaatccttgtggcagtaatgcatggctacaaaattatcaacagcactggccacgatgaagacacgctgtatgcgataagttatttcgtcgttttcccggtggtggtcatcagcgcagttctcttttattttggtggaaaagataaagatgataacaatcccaagtaaatgacaggattgtacgacatctctccttctttttgatacatgacttctttgtcacctgaccagattatccgccaggaaattcttgcactatcagcctaccacgtcccgcccgcgaaggacatgatcaagctggacgcaatggaaaatccctatcggctcccctcctttttgggtgaagagattacccggattacagcaggcgcgcatatcaaccgctaccctgatccgcatgccgcggcactcaaagaaacgcttcgaacatcgctatctattccagatggaatggaaatcatgctgggaaatggttcagatgaaatcattcaaatcatcatgctggcagctgcaaaaccaggagcaaagctactgactgttgaacccggatttgccatgttcaaaatgattgctacatttacaaatatggaatatgtcggcattccgttaagaccagatttctcgctggatcttgacatgatgctcacggcaatttcacaccaccagccagctattctgtttttggcctacccgaacaaccccagcggcaatctgtttgacgaggccgccctgaataaaataattcaaatatccaaaggtctggttgtaatagacgaagcttatcatccatttgcagggaaaagttttattgaaaaactcccaaattatccgaatttactggttatgcgaacgctttcgaaattgggattggccgggcttcgcctcgggttcctggtcggcaggccgagctggctgtatcatctggagaaattgcgcctgccttacaatgtcaatgtaattacccagcttatggcagaaaaaatcatgcaacattacgatacgctacaacatcaggctgacataattaaacaaacccgaaccaaattaagaatctttcttgaaagcctgaaaggtgttgaagcctatccctctgatgccaatttcattttattccggctcaacaacgccagccatgttttcaagcaacttcagcagcgtcgtattttggtgaagaaccttgacaacagccaccccttattaaaaaattgcctccgtgtaacagttggcacgcccgaagaaaacgattatttctgcaatacactgcaagatttgatcgctgaaaattaaccggaagactaaacaaaacactccgttcaaatttaaatactcatgcgcaaagcccaagttactcgcaacactcaggaaacacaaattaccgtagcaatcaacctggacggccagggcaaagcggaattggatagcggcgttccttttcttgatcacatgctggatcagattgcccgccatggcatgattgacttgaatgttgcagccaaaggcgaccttcatatcgatgcccaccatactgtggaagatattggcattgcactgggtcaggcactgaatcgtgccattggtgacaaaaaaggaatatttcgctacggtcatgcatatgtgcctctggacgaaaccttgtcaagagtagtcatcgatttgtccggaaggcctggcttgcagttcaacaccacatttacacgtgcggttatcggctctttcgatgttgatctgatccaggaattctttcagggctttgtcaatcatgccatgatgacactgcacatagataacctcgccggtaaaaacgcacatcaccaggctgaatctattttcaaggcattcggccgtgcgctgcgtatggctgtaacaattgatccacgctgcgatgaccttattccatccaccaaaggcgtgctgtaggtaaaaaaacgctcagaacatctgatacgaacatgaactcgattgccgttgtagattatgggatgggcaacctaagatcggtatccaaagcactggaatatgtcgattcatctgcggttgtcacggttaccaatgatccggaggttatccgatctgcctcacgcgttgttgttccgggccagggtgcgatgcctcattgcatggaggctctggatgatcagggtttgcgtgaagtagtcgtcgaagcagctcaaaataaaccttttctcggcatttgcctcggactgcaaatgttgttcaaggaaagtgaggaaggcgatacctcagcactgggtattttgccaggcagtgtgaaaaaattagacgtgcgtgagaccgccggtaacaacaccccaaaactcaagattcctcacatgggctggaaccaggttcaccaggttatggcgcatccactgtgggatagaattgataccggcacacgcttttactttgttcacagctattacgtagctacagatgaaccaggaatcgtggcgggtagtaccaactatccaaccccattcacatgtgcagttgccagagacaatatttttgccacccagtttcacccggagaaaagtcattctgcaggattggcattattgagtaatttcctaaaatggataccataacaacattccagcattatcctatccagcatttccattgtattatcaatttttttcaagtctgatcattaaccccgataacttcgtatgctgattattcctgctatagatctgaaagacggacaatgcgtccgcctgaagcaaggcatcatggaagatgccacagtattttcagaaacccctgaaacagttgcactgcactggctggataacggagcccgtcagctgcatctggttgaccttaatggtgcttttgccggaaaacctaaaaatggtgaagctatccgcgcgatagtcgaagccattgatggaagaattccaatccagctgggcggaggaatccgcgatctggaaactgtcgagtactatctggataacggcatcagctacgtaatcattggaacggctgcggtcaagatacctggcttcctgcacgatgcctgctatgcgtttccaggtcagattatggtcgggctggatgccaaaggtggaaaagtggctgttgacggctggtccaaagtaaccggccatgacgttattgatcttgcaaaaaaattccaggattacggtgccgaagcaattattcacaccgatatcggtcgtgatggcatgctcaacggcctcaatatcgaagctactgtggaactcgctcaagcgctgacaattcccgtcattgcaagtggcggtgtgaccaacctggatgacatcaggaaattgtgccaagtccagtccgaaggaatcaccggtgtcatcaccggccgggcaatttatcagggctcccttgatttcaaggaagcacaagccttggcagatcagctggattcagcaaagtgattgacatcactcacagaaacttactggctttgtgctttttatccccttctttttttatctaatttatttctgataactttgaccaatgggattagccaaacgtattattccctgccttgatattaaggacgggcgcgtcgtcaaaggtgtcaattttgtctctctgcgggatgcaggagatccggttgaaattgctcgcagctataatgagcagggagcggatgaactcgtctttctcgatattactgcaagcgtggagaatcgcgatttaatcctgcatattgtggaaaaggtcgcctcgcaggttttcatcccactaacggtgggaggaggcgtctgcaaggccgaggatgtgcgccggctgctgaacgcgggggctgacaaggtcagcatcaacacttccgcagtattgaatccggaactgatcaaggaatcagcagatcattacggttctcagtgtatcgtaatcgccattgatgccaggcaaacacctgacggaaaccctgaatctccgcgctgggaagtattcacccatggcgggcgcaagccaaccgggcttgatgcgattgaatgggctcaaaagatacaatccttgggtgccggagaaattctgctgaccagcatggatcgtgatggcactcgttccggatttgatcttgttctgacacgcacaatctccgatgcagtagacttacccgttattgccagcggtggtgtaggtaacctggatcatctggtggatggtattttgcaaggccatgctgatgcagtgctggcagccagtatttttcattatggcgaattcagtatccgtcaggccaaggaatatctgttatcacacggcatagaagtccgcctataagaaagtggaacacgatctttacttctgagtcgccacaattaccatggaagccgcttttcctacggtattcccacattttgcaagtattcctgaaactgttaagatcgccctgaaagcagcagcacacaaggagcagctaatgacagatgaatggcttgatacaataaactggtcagttgacggcctcatcccggtaatcgcacaggatgaaaacggcggcaagattttgatggtggcctggatgaaccgcgacgcgctcaaacgtactgtcgaaactggtgaagcagtttactggtcgcgctccagaaagaagctgtggcacaaaggtgaggaatccggccatacccagatagtccaggcaatccatctggattgtgataaagatgttctcctcctcagtgtggaacaaaaaggggggattgcttgccatacaggcaggcaaagctgctttttccgccaattgaaaaatggggaatgggtaatcacagagcccgttatcaaagacccatcacaaatttatacccaatgacctcctcttcaacgatattacagcgactgactcagacgattgaagcacgtaagagcgccgaccctgctcattcctacatcgcaaaactgctaagcagcaacgaagataaggtgctaaaaaaaatagctgaagaagccgctgaaaccatcatggcttgcaaggacaatgacagagaacagattatttatgaaacagcggacttgtggtttcattgcttgatcatgcttgccaggcacgacatctcgccggaagctatactgtcggaactggagcgaagagaaggagtatccggtatcgaagagaaattgtcacgatctcaaaaccaacctgggccaactaaggctgaatgatatggaagattgtatattctgcaaaatcgtacgtggtgaaattccagccactaaaatccatgaagatgatgaaacaatagcgttttatgatattcatccggcagcgcctgtgcattttatgctgatacccaaacaacatatcgaatcattaaatgaagttgatttgagccatcagcagctactcggaaaaatgttatggttagttccccgtctggcggcgggccaaggatgtacagatgggtttcgaaccattatcaacaccgggcgggtaggaggacaggaaattttccatcttcatcttcatgttattggagggaaagaccgcctacccgccatgattcaccacggctaatccgcttaaggagcaaataatgggaagttttagtatttggcactggctggttgttctggcgatcgttgtactggtattcggaaccaaaaaactccgcaaccttggcagcgatctggggggagccgttcgtggattcaaagagggtatgaagggtgctgaagaggaatcttcgcaaccacctccttcacagcaacaggtaaccagccattcaatcaaaaatgaaatagaagaaaaagatcacacaaaggtgtgatctggcaatatggctctgtacaatcacgggaacaggattttccggataatctcgaagcagcattcaatgctatccgagcctgcaaatgtttgatatcagcttcactgaacttatcgtcgttggaattgtagcccttattgtcatcgggccagaacgattgccggcagttgcacgcacagcaggttattttctgggacgggctcggcgttatgtcgaacaggtaaagcgtgatttgaacgaagaaatggagttggacagcctgaggaagctcagggattccatgcatgaaaccgtcgattcatttgagaattcggtgcgcagcgaaataaacaaaatatcggagatagcagatacccagcccacagccatacccgaaaaaaaatctcatgcagttgaatcagggggaaaaacagaacccgagaataccgagacagccgcctcatcaacccctaaagaaccccggcaactgggcagttagtttttgcagtgattcaaccactgcaaactgccagtaatctcctctttattaagcgactcaatttaacaacaggataaaccacagcaacagatggatgatgacaatacttttatttcgcatctggtggaattacgtgcccggctgattcgagcactgctggcattatttctgggttttctcccctgcgcctttttcgcgcgagagctatacagtttcctggcctttcctttgctggaaaaattgccgcaaggtggtcaaatgattgctacagaggtggtgactccgttcttcatcccaatgaaagttgcgttaatggtggcatttctcgtcaccctaccacacacgttttatcaagtttgggcatttgtcgcacccggcctatacagccacgaaaaacgcttgtttttgccgctggtattcgtcagcagcctcctgttcttcacaggcatggcattcgcctacttcgccgtactaccattggtatttgaattcatcgtctatttcgcgccagaaggtgtcgctgtcatgactgacatcagcgaatacctcaacttcgtattatcaatgttcctggctttcggcatcacatttgaagtaccgattttcgtactgatcctcatccgtaccggtctcgtttcaatagaaaaaatgagatccgtccgccgctttgttctggttggtgcatttatcatcggcgcgattttcaccccacctgatgtcatgtcgcagatcttgctggcaattcctttatatctgctttatgaactgggtatcctccttgctgccctgtcgatgaaacaatccgctcgggaatcagcgccacccgccatgcagcatcagcgtgacaatactggaaaaaacgaataacaagaaccaatttaccaaccacataccaacagcaaaattctccctgcaccacagaagaattaccagccagtttcggaaccatcctcccggaccattcttgacatggtcatagcgctgctatagtctccactcccttgcttgaggtgtcccagatgcatttgcacgagggatgaaacgggaagtcggtgcgcactggaatcaaacaatgcaatgccgacactgcccccgcaacggtaaatgagtcaatattctgcacacgccactgtgccatccggcacgggaaggcgcagaatcaggaaataaatctactcacaagtccggagaccggcctgaagcaatatcatgttattgcggagggcaatacacggcaccggatcttattcctggcatttaattatgtcaggttccctgctgtttctccgcaatctgtttataacccgatcatcgcgcgggtgtgcgcggaggaaacaatgtccagaaatcatgcttcatctgtactggctctatggctgggaatcaatctttctgccgtctcatgggcggaagaaatcaactatctcgaaaacccggttgtcgttaccgctagccgtactgatcaagccgcggaagatacacttgcctcagttaccgtcattacacgaactgatattgagcgtcagcaggcacgttcagtgcaagatctgctgcacggtatcgcaggtatcaatgtcgctaataccggtggccctggaaaattgaccacactttttctgcgaggtacagaatccgaccacgtactggttctggttgatggcatcagaatgggctctgccacctccggttttagtgaaatccagaactacccggtagagttgattgatcgtattgagatcgtccggggaccacgttccagcttatacggcccggaagcggtaggtggcgtcatccagatcttcacacgtaaaggcggaaaaaagggattaaaacccactctcagttttggggggggcagctatgggaccatcaatggctcagctactctctccggtagcagcgaacacgcctggtttaatctcggcatcagcggatcagacaccaatggctttaatgcctgcaaaggttcttttagtgcgggatgcttcaccgttgaaccggacaaggatggctaccgtaatatctccggctcggcccgtgccggctaccacttcaatagcggattggatgtcgaagccagttttttacacactgatggacattacgaatacgacggcggctttatcaaccgaaccaaactggcacaacagatgttcggaggaactgcgcgttattcgccttttgagccttggcgcatcaccttaacaatggggcgcagtaatgaagattccgataatttcaaggagaaaatgttcatgacgcgctaccacgcccggcgcgatacgatctcctggcaaaatgatatcactgtcaccccgaatcagcttttgaccatcggcacagattatctgtatgatcatgtcaacagcacggaaaaattcaccactacctcacgctataattggggcgtatttgcacaacaccagatttcactcgcagcgcacaaactgcagctttctttacgtcatgatgataatcagcaattcggcagccaggtaaccggtggtgcttcctggggctattcactgactgaacgggtcaggctgactgctggcttcggtagcgcgtttaaagcccctaccttcaatgagctgtatttccctggatttggcaaccctcatctcaagccggaggatgcccacacggtagaactgggtgcaactggccggttcgaccgaggtaattggtcactcaacctgtatgaaacctggattgataacctgatctcatataatgcggcaacattcgctccagataatatagacaaagcgcgcatacaaggattggaagctatcctcaacactgaaatcaaaggctggctgattcaaaccaacctcacttttctcaatccagaaaatcgctccaaaggtgctaatcgaggcaatatcctaccacgacgcagcaaacaggccttccggattgatgccagtcgccagcttggtaattttgtggtaggggcactgtttcttgcggaagccaatcgttacgatgatctggcaaataagcagcagctggatgattacgtcaaagtcgatttacgggcagaatatctgatcaattcacagtggcgcatacaaggacgagttgaaaacctgtttgacaaggactatgaaaccgctgcattcttcaaccaacccgggcgcagcttctttgctaccctgcgctatcaaccataggataaaaccatgaagccattaccattacactatcaatacctgatcgggttcatcctgatcgccctgatgattgccacccgcgaatatcacttcgcctcattgcacagcctgccaggagcttcctgggccgtcttctttctggccggcctctatcttcgttcaagctggtcattacctggttttctcgcattaacctggatactcgactcttcagcttacttcactgttgcagaaagcgaattctgtctgactacagcctacgccttcctgctgcctgcctatagcgccctctgggctgctggtcgctggtttgctacacactatcaattctcatggcgggcatggatgccactatccttcagccttctgatcggtgcaatgctatgtgaattattctccagtggcggattctatttcttctccggtcagtttacagaaaccaattttgctgaattctggcagcgtgaactgtactatttcccgctttatctccagtctttactgttttacgtcagcatggcagcagcaatacacatccctcttgcgttgatccatcaatcgcgttacccccggaataatgcaatcagccaataccaataatgaacgctgaagcagatcgggcgcagcgccaccgtgcccgaatgcaacgccaaaagacagttgtcgatgccgcgattgcccgtgctgataaaagtaaaggcttgctgctggtattgaccggcaacggcaagggtaaatcaagctccgctttcggcatggctgcccgcgcactgggtcatagtatgcgcgttggcgtcgcgcagttcatcaaggggcgctccgacaccggcgaagaagctttcttccaacagcagaaaaatatcatctggcatgtgctgggggaaggctttacctgggatacacaagatcttgaacgcgacaaggaaactgccagacgtggatgggcagttgtacaaaccatgctgcatgatccctccattgacctgctgatactggatgagctcacctacccgctcaagtttggctggctggacatcaataccgtattagctgatctgcagaaccgcccggcgatgcaacatgttgtcattaccggccgtgccgcaccggatgctttatgccagacagccgataccgtcaccgaaatgcgtgatatcaaacacgccttccagtctgggatccaggcacaaatagggattgattactgacaacgctactccgaagcttgtcagtagaagaaaccttacaactgcccaggatccatcagtaaaacgctgatttatccgccactaagaggcttgcaaggccgtagcatccagaatctattgattttgaaaaacctctggaggctcatcacgctcgcagttatggtttcaataacgcttattgatttgatcaatatcctcttaaataataaaatttttgtccagaatacataaaaacagtaaaatttccaggatatatacacgtcaggctgtttaacgatacaaatggtatatagagaaaagacaagtacaaaacgatattgcaacaggctatcgatcatcatgaagtggccgaacatatcggtatgtcacatgagacgatattgcagaaactggaaaatatggcagtgtagtttcgcacgcagtacgatctgaacagaaactcaactacatgtaaacactcccatagaacacacatgaattcctggaatcattgaaaataatcatgcttaaacttatacgagataaagggccgaaagagacgataaatacgctcatagttgctgaaaaagccagaatcaatcatcaagatattgaagaactgctactaaagtatcaaagaagctacccagaagacgccaccagaagcataacagaggttacgaatccaactcaggagaagcatgaaggcctgagagtgttcgtaatccagacacgaatagcgcttatgctggcaaattcctacggacttgaagcgtatcagactttaaaaacgtttatggagaggcagggttacaagacgcagcctgactccatgtccgtggtaacagaacagaaagactaaatcccaatatcaaatagccgctttccccttgtgtcaggctagttgtcgcaagcgttgattctgctgtggtgctggcgcaatgctatggcgtcaccgaacagacgaccggttgcagactacgcttacaccagtacaagaagccattgtgatttatctgtatcgctcactgctgctgcctttggataatctgctagccatcacccgtgaatttttgtgtcgagtgccgacaggcccggtcttggcttggctgatcagataaattgccaggaaccagatgcttagcgacaagtgggggctttggaacaaggcgcctacaatcagagattgtctgcagacggcagcgcttgcttgcattggaagttcttgtattttcctgccttaagcaagtagtaatttgcgttgccgcagcctgagcagctaaatccttacggccaacgagattcttccaatgcatccgcacattgctcatccgtgccaaactgtgtaagaaatcaagtaaagacaagcctacttagaattgaatacagttcatggccatgataattcctctttgataggtttgtttgggccgctatgcgccttatcatagaaaaaatcgagtctggctgaacaatctttctaatcaggtaaagttatggtgtatgggattgtaacgaagaaaaattacagtaattgctatagatctcaagtttcacggaatatataaattccaggcacaaagatcgggtatttattcactggtacttgtcgcatgcgacaatatgtcacattgtttattccaatggcttatttgatacttggtacccaggctatgcaagacagggagtttccgagcatagcctcttttaccaatcactcaaatattaagaaaaaatttagatgaacaagacgatcaaatgcgcattacttttcgctgctagtataacctcgctacccgccgttgctcatatcagctatagcagccgtgattttggaatctacgattcgaccactggcggctcaaacaccattcttcatcagttcgtaacaggtaactacggttggatagatggaactgattccgaccaggggaacagccacggagtactgcctttccgatttacgcttaccagctcggctagcgtaaatctcagttttcgggaagatagcgcgatgactaccaactacaaaggtgaagcagccctttcaatgctgggattggcgcctggattctcgctatatcgaggattagctcacgtttcacctcacgaacttgatcatgacaacactgacggttctaaactcctgcgccccgaaggcagcgaaggctcattcgtggcactggctgactggagcatcaccaacgaagatgatccgcaggcattggatccaagctacctcagctatatcgggcacgcttatgatggtgccatgaactatggtactggactcattccaggtggagatggtgtggctgataatttcgtatcaaaaacatttcaacttgatccaggtgactactctgtcttcgcaggaggatcaagttattgggaccaactggaggacaatccaaaccttgcagcccgctatggtttgaacgcttcctttagcataatgcaacaagttcccgaaccagggacatacactctactgctgatcggcctggggttactgagcatcgtcaaacgccgcagacaagtgtattaacaacagtacaatcgttggtatctctcagaaacgcttacttcacccgcatgcctggttgtgcgccgctgtccggggcgagcaagaatgggccgccgctttcaccgcttgcagccagcaccatgccttctgagagtccaaatttcattttgcgcggagcaaggttagcgaccatcacagtcagccgtcctttgagttgttccgggtcataggcagatttgatgcctgcgaagacggaacgctgttcagagccgatatccagtgtcagttgcagcagtttgtcggcaccgggaacatgttgtgcgtcgagaatccgggcaatgcgcagatcgatcttgctgaaatcctcgattgaaattgtttcggcaatgggagcaatgacacgttgttgtgcttcagcatgccgcgtgagtgaatgagtgtcgttactggtcgtcatggtttgtcggttggcctctgtcagtgcagcaatttgtttgggatcaatacgggtgataaggtgttgataagtattaatagtgtgacctgccggcagcagcatagtggataaaggttgtcctgcttgctgtctgggccaactcagcgccgtccaattgagaaaatgctcgatgcgttcagcggtatagggcaaaaccggtttcagataacaagagagtagataaaacatctggatacccaagctgcaggcacggtgtaattcgcgctctcgtgtctcatccttagcaatttcccagggtgcaagcgcgtggatcagttcgttgatctcatccgttcgcttcatgatatggcgtatcgcggcagaaaaatcgcgcgcctcgtaggctgcttcgatgacgcccggctgccagctggagaaatgttcatccaccgtttgttgcagcagttgataatcttcccccgccaccagcttgccgtcgaaacgtttgctgataaatccggcacaacggctggcaatgttgatgtacttgccgaccagatccgcattaacacgcgcaacaaaatcttccaggttaagatcgatatcttccatgctgccgttgagcttggcggcatagtagtagcgtaaccattccggattcagcccctgttgcaaatagctttccgccgtaataaacgtgccgcgtgatttactcattttttcgccattcacggtcagaaaaccatgagcaaaaatctgtgtgggggtacgataacccgcgttctccagcattgccggccagaatagtgcatgaaaataaagaatatccttgccgatgaaatgatacaactccgtggtggcaccctttttccagtattgatcaaaatcaatcccttgctcggcgcaaagctttttgaagctgcccatgtagccgatcggtgcatccagccacacataaaaatacttgtctgtttcaccgggaatttcaaagccaaaataaggtgcatcgcgtgaaatatcccaatcggataatttattctcaccctcttcccccagccattccgccattttgttggctgcctctgcctgcaaatggttgcctgagcgtgtccatttacgtaaaaaatcactgcaacgcggatcagatagcttaaagaagaaatgctccgatgcttttcggatgggcgttgcaccggaaacagcggaatagggattcttcagctctgttggtgtataggccgcgccacaggcttcacaggaatctccatattgatcagccgccccgcatttcgggcattcacctttcacaaagcgatccggcagaaacaggtttttgactgggtcatacagttgttctatcgaacggattgcaatcagcccggctgctttcagtttttggtaaatatcctcggcgtagtggcgcgtttcatcggaatgtgtgctgtaatactggtcaaacgcgatatgaaaaccggtaaaatcacgcagatgttctgtatagacccgcgcaatcaatgcttccggtgaaataccctccctttcagcacgcagcatgatgggcgtgccatgcgcatcatccgcacagacataatagacggtatgcccctgcattttttggaaacgtacccagatatcggtctggatatattcaaccagatgccccagatgaatgctgccattggcataaggcagcgcggaagttaccagaatattacgtacagtcatcggttactcatcaattcaaaatatataataagagaagattgtagcaaaccagctggcgcgatatttgctaacatcaatacttttgtggcgggagcacgctcatcaatgatcacacaacaacaaattgaaacggtgctgggtcagactattgatcccacgaccggtaaaaattaccttaccagcaaaactgtcaacaacattcagatcaatcagaccagcgttgtaatagatatcgaacttggctacccggctaaaagcgtgctggaaaccgtccgtcagcagattgaacacgccttgcgtaccctgcccggaatcgaatcggtcacagtcaatgtcaccagtaatatcattgcccatggtgcacagcgcaaactcaaacttttacccggtgtcaagaatgtgattgcaatcgcttccggtaaggggggtgtaggtaagtctgctactgcagtcaatctggcactggcactggcagctgaaggggcaacagtaggtattctggatgcagatatctacggcccgtcacaaccacaaatgcttggcgtcagcggacagccgaattcaccggatggcaaaactatcgagccgatgcgggcgcacggtattcaaatgatgtcgattggtctgctgattgatgtggaaaccccaatggtctggcgtggtccgatggtaacgcaagctttgcaacagctactgaatgacaccctctggcaagatttggattatctgcttattgatctgccacctggcacgggtgatattcaactgacactcgcccagaaaattccggtgaccggcgcggtcatcgtcactacgccacaggatattgccctgctggatgcccgcaagggtctgaaaatgtttgagaaggtcggcattcctattttgggaatcgtggaaaacatgagcctgcacacctgttcgaactgcggacataccgagccgatttttggaacggggggcggtgaaaaaatgagcaaggattacaacgtcgagctgctgggcgccctgccactggatatccgtatccgcgagcatactgatgccggcacacccagtgtcgtggccgaaccagacgggcaaatcgccaccatctaccgcacgattgcacgccgcgtagcagcgaaaatctccgatatggcgcgtgattacacggatgtatttacacaaattatcatggaagacgattaattaaggccgcgcatgtcgatcaaatcagataaatggatccgcaggatggccgccgaatacggcatgattgagccattcgagcctggtcaggttaaacagaaagatgggcacagcatcgtctcctacggtacttccagctatggttacgacatccgctgttcggatgaattcaagctgttcaccaatctgaattcaaccatcgttgacccgaaacgtttcgattcaaactcgtttgttgatttaaaaaatgatatctgcatcatcccgcccaattccttcgcgctggcacgcacagttgaatatttccgcatcccgcgcaatgtgctgaccatctgcctcgggaaatccacttatgctcgctgtggcatcatagtcaatgtcacaccatttgagccagagtgggagggttacgtcacactggagttctccaacacgacccccctgcctgccaagatttatgccaatgaaggcgttgcccaggttatcttttttgaagcggatgaagtatgtgaaacatcctacaaggatcgcaagggtaaataccagtttcagcaaggagtgacgttgccaaaaatatagatttgagaaataccaaaaggtatttctcaccagctcctcctgccccacttctaatacttcataacaagaaacagagccaactacccactattcggttttttgattggtatattcggccggagcaaaaaacaccagcacgctcagatcctctgttatgtcataaaaacagtgatcaacattggctgctacaaaaacaatacttcccgctgaaatctgccgatggccgctacccacccgcatactcgcctggccctgcgccacataataaacttcatcctcggcatgcggttcctgcaaatcagacgatcccgcaagcagggtgtaaatccccatacttagtgatggcgtccgcaagaactccagataggtatctcccgattccttttgccgggtgattaaatccagtagtttgtatatatccataccttccattctcctgatcaaatcaaaaaacaataatggctcattcagactggttctgtctgccgtgctgccggatcctgacgataaaactgggccagctgctgatataccgctggaaaatggtgcttcacctgatgtggtctgataaaaaaaacttcactcaataccgcaaaaaattctgccggatccgttgctgcataaggattgatacccgttccttcaccctgctccacctgtctacagaaaatctcataagcctggctgaaaacctcagcccagctgcgcggatccatcccattatgcaggggcggataaccgttggcagaaccattcagcatatccagcttgtgtgcaaattcgtgtatcaccacgttatgctcatgatgaacatgagccacatcctcccatgacagaatcaccggcccggtcagccaggattcacccgaagccaccatccgcctggtatgtacaatccctatttcatcccgatagacgcgattgagaataaacttgccggggtagacgattacttctacccagtcatcgtaatattccgggtccagcttcaaaatcagcaagcaggcctgcgccgcgatcattacacacatcgcttctgtcatgatcagaccctgcactccattaatttttttgtcatgcaaaaaaattgtcgaccattcccgcaaccgatggagttcattccgagtcaatccatacaagaacggtaattgatccactaccggttgccagatagattcgggaataagtttacgtttgagaattcggcgacgccgccatttttccagaagccagatcattcaatcacctgaaagcatcatgttgcatgagaaaaagagtaccgtttgtttgttccaagagttagatttacgattttcatggagaaaatctgttacccgtctacagattgcaaggcacaggagactatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactatagacatgatgacaactataatttctagcatcccagtacacttgcccattctgctgatctgccctttctcttccgtgccatgacaaatcaacttgcagataagaataccgaagcgctgcgacaaacgaagtggcatacactgactcaatctgagattgagcaaattctgcaaaccgggcctaatggcctgaaaactgctgaaatccaggatcgtcttgcccgattcggatcgaaccgcctgcctccacccaaacgacgcgggccattgattcgtctgctgatgcaattccacaatatcctgctgtatatcatgactgctgcagcgctcatcaccgctctactggatcactgggtggatagcggcgtactgctggctgtaatcatggttaatgtctttattggtttcattcaggaaggaaaagccgaaacggcgcttgattctatccgggccatgctgtcgccccgcgcaaccgtcatcagggatgattcccgccatgaaatagacgctgctgaactagtaccaggtgatgtggtattactggtttccggcgatcgagtgccggcggatattcgcctgacttcaatcagggaattacagattgatgaagctacactgactggggaatccataccagtaaagaaacacattgaaacaagcctgcccgatacctcgctgggtgatcgctccggcatgatctattccggcacccttgtcgtattcggccaggccagtggaattgtcgtctctaccggcagcacaaccgagctgggcaaaatcaaccagatgctcacggatataaagagtctgtccactccattattacgtcagattgataactttggccgcatactggccatcgccattcttgcagcttctgtcgcaactttcgtactgggcaccatttggcgcggccatgctccagaagagatgttcatgatggcgatcgcgttgatcgcttcggcgataccagaagggttaccggccatcatgaccgtgacactagcgctgggggttcaacgtatggcacgacgcaacgccatcatccggcaactgcccgctgtcgaggcactgggatcggtgactgtcatctgctctgacaagacaggtacgttgacccgcaatgaaatgaccgtgcagcatgtgatctgcgccgaccatgtatttaatatcagcggcgttggctatacaccagcaggtgaatgcaacattgacggacatgtcattgatcccgcccattatccggcgcttaccctggcaatacgcacgggcgtgctgtgcaatgatgcacggttgcaaaaggagcacggtcagtggcatgtggaaggagatcctaccgaaggcgctctgctggtgctgggtgagaaaaccagtttctccagccaccttgccaatactgcctggccgcgcctagatgtcattccgtttgaatcacaatattccttcatggccacctatcaccgcgacagtgatgataagccctggatcttcgtcaaaggagcgccggaacgtattctagagatgtgtacaacccagttgcgccagaataatgaacagccgcttgatgccggctactggcagcgaatggcaaccaccacggcggctcaaggattacgcttgctggcattggcttgcaaacgtacggcaccacaggaaaacaatctaaaaatgaccgacatggaaacaggattcacgctactagctctggttggcatcatcgatccgccccgtgaggaagtcatccgggcagtagcggaatgccatcgcgccggaatccgggtcaaaatgattaccggtgatcatgcggaaacggcttgcgccatcggggcacaactggctatcggcaccggcaaaccggctcttaccggggtagaaatcgctgccatggacgataatgccttgcgtaatgtagtcatgaatatcgacatattcgcccgcgccagcccggaacacaaactgcgcctggtagaagctttgcaggccagtggacaggtagtggccatgaccggcgacggtgtgaacgatgcaccggcgcttaaacgcgcggatgtcggcgtggcaatgggtatgaaggggactgaagttgccaaggaagcatccgatatcgtgctggcggatgacaactttgccaccattgtttctgctgtacgtgaaggtcgggctgtttacgacaatctgaaaaaattcgtactattcatgttaccggtcagcggtggcctaacgttgataatcattgccgccattttgttcgaactcacactgccacttacaccagcacaggcattgtggatcaacatggtaacagccagcaccctgggactggcgctggctttcgaaccggcagaacgcaatatcatgaatcgccacccacgcccaccggctgaggcatttctgtctggtttttttgtgtggcgcattctaatggtatctgtgctgatgatgatcagtgcacttggcttgtttctgtgggagctgggtaatggcacccggattgaaacagcgcatacgatcgctgttaacacgatcgtaatggcagaaatgttctatttgcttaacagccgtcatatttttgccccgattacgcttatcaaaggcctaaccggtaatcgttatatcctgctgaccattgttgtctgcacgctgctacagattgtttatacccacctacccgccatgcaggccatattcaaatcaactgatttgtcagtgctggaatggtgtaaatccattgctgctggattgatggtgttctacgcgatcgaactggaaaaattcattatccggtgcactcactttgtttcattgacagccaaaggttagaaactcactcatcgcaagaagtgaacccttagtagcggttatgatggcgagcagagtacactagaaaacaaacagtgaacgacagaatttttatagataaaagagtatgtcaaacattacaatctggtaatcatgacaagaactgtattcacaacattctaaagaaataagttaagaatctgattactacgattgtagataaggaagctgcaaaaattatcaaaagtaatttcagcaaatatctttttgctctttttggcaaaatcaacagtagcattaatattactgatccaaccgcaattaatgttagcacttctaaaaattcctgaaataacactgtttatccacgtgaaagaaagtattcaaacatacacatccagattctcgcacaaaagacaggcacgatacgccaagaaagcgatcgagaagattgcggatccttgcccattattaaacctatttcaagcttttcagcacgctatcagaacagataaatcttcaagatttcctggtctttccttttcccacagccatagtaaattcggcaaggataaagctatccatacaggcagaaacgggagaggctggatcaccgctcgccatgttctatttgcgaccaaatgactaaatcttctgatgaaagagaattattgatcctgggatgataagaaatatcatctttacgaacaccggtggtgtgaagcaattcaatgagcgggaaaattattccacggccaatatttccagcgcagacggtcccttcacaatcttcattatccccagactcaccgtcaccgcacgcatgaacaatctgcgattatgtagctactccctcctcaagtaataattcagccggtttgtcatacaccaaaacggttttcttgaagtgctcagcatactggtaaatatctgaaagatctgttacggacactatcctttcctctttttcttcaaatagccccagcgtcatcctggaaggattattgaatcgcaagcgacagatcggcttgcgattattgtcatcaagcaatatcgcacagtagcttttagaatctcgcataaccactcgcttcggatcgacagtttcccgaagaattgcacggacaatacgatacccctcaaattcttcttcagttgtaatgatcccatctgaatcctgatcagagattatattgtctttcttcaactcttctgatggttccatagccagcttgagtctctcattgattttgtccgaaataagttgttgaaatgcattcttggttatcaaagtaaattgctcctttattgcaggagttatacgttttccattaatgacttcggagcataccaatctgacaaaatcctcagatggggcaaccatccaatcagctagaacattgcggatcgctcttgtatatttcagatcacttgccgtatttaatatcaactcaacattgaacgcaggcttggaaaattttttaagctcctctacatactgatccttgaagtcaagaatattgaattcaagaaatggcttttcatccatcttatttgcttgttccaggtcagtgaagaagcggtacaaaataccatttgtaagcactccaaaacgtgcttccgtcgcatgaaaatatctgaataattgcgatgcatgatcaatattcagatcactcccgcttttcttacattcaaaaagcataatcggcttgccatccatcagaatagcataatcaactttttctccttttttcatccctacgtcagctactaattctggcgtcacttcatttgggtcaaacacgttgtagccaagtatttgtatgaatggcatgattaatgcattttttgttgcttcttcagtttgtaccgtatcttttacctttcggacgcgaactgacagctctttaagttgatcaatcaaatccatattattttctccataaaagtaattacttccttttcttctacggaacaaacctcaaaaacttgatcatagagcaggtacagcaatcagcttatgggcacctcgaaaaacctatatccggttcaggtaagagtgcgctgcttaaatgccgcggtgcggtgatcgatcctacatccggacgcatgatcctctgtggaggatgaaatcatcttcgatgacggctggaaactgcacgatctacgcgctttgcgtcgcgacaaattggcttcgtgttccaggcaccctatttgatcccgtttctggatgcaactgacaatgtcgcgcttttgccgatgctagccggtgtggacaatgatgaggcacgtaaacgcgtactgaaactgttcactgcgctggacgacgtacagcatcgtgcccatgccagcacaactgtctgcggtgagcaacagcgcgtagctattgcacgagatctggtcaatcgcccgcttgtcattctggctgatgcagctcaccgccccctggattcacaacgtgcactggcaataatccgcatacttaacacaatagccaagcgatttgagatcgccgttattgttgtgacacacgatgaaagaattatcccgaccttcaagcgtatctaccatattcgcgatggcgtgacccatgaggaagcaggagaagggcgcagtactgacaatccttcacatattaaaaatatgatgtgcagttgtcttgccaaaaaagtacgcaaatggattttctgtaccgtgaatcaatcaatcagcatgtgaccaaaccaggcaaaaataccgattgcgatgccggtgacgaactgggcatgtactagatatgaaaatttcttaagttctgtgggcgaatagcgcaaggtgtttacacaaaaagctttacaggtatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtggcggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactataaggctcacaagcacgctgcgccagttttccctcacctaatgtcagtttgagtagcgtacggctataaatgaagattagtaatcccatgcctactttcttccccaatctctgcaagaaacgtttcacgctcttcgggaatctcctgtgtagtataggcataaatgtaatacaccacagacaccagcaaaataacagccgtgtaaaccaatatactacgaatgttttttgtcgtcggttgcatgtcaacgatcagcgagcgattacccgttacattggtttacagattcaggaatacatcaagcagcgttgctgtctatttactacgtatgcggtctgggcagtcttttttgatgcagtccgcatacaatgacaaagaatgatcctgcagcacaaacccccgctccttggcaattttcacctgacgtttttcgatttctggatcgaagaattcctcaacgtgaccacattgcaggcataccaggtggtcatgatgattaccactggctagctcaaaaaccgccttaccactttcaaaatggtgacgctcaagcaatccggcttgctcaaactgagtcagaacacgataaaccgttgccagaccgatatcctctccttcacctagcaattctttatagacgtcttctgctgagagatgccgaatcgagctgttctcaaacaaatttaatatcttcaaacgcgggagtgttgtcttcaatcccatcgtcttaagatctatacctttcaaattttctgatttactcattaagttatttacctcaagaaattactgcatttatgagacaattgaaaagcgtaaaccttcataataatttctttttagtcaggactaattccctgacgcgctacaaaaatacatattgcagtcactttttgtttacactttacgttactccgggggagctaactattcatagtatcctatcccggatggattgaaaaatattggcctggtatgtacgcattattcccacgactgttattgttattattgcttcccttcctgccacactgcacttatcttccttcattcccttacaaaattgatattcagcaaggtaatgttatcaccgaggaaatggtagccagactaaaaccagggatgacccgttcacaggttcggttcatattgggtacgccgctggtagtagatgtatttcatagtgatcgttgggattacatctatcgtctcgcgccaggtggccgcataaccgaagaacggaaactgattgttttttttaagaatgaccggctatcccatattcagggagattttccgcaaccccctgccttcagcgagtcttctccggtttttcccgttcccgaaaaaacatctggatcccctcctggtgttgatggcactgaaaacgagggatctgacaaaacaatcgatttcctcaaagaaaatcagacaaatttttacagggataatcaatgacactgttaaatatagccgttgccggaagtgccggccgtatgggtcggactatcatggaaactattgctgatgcgcaagatctgcggttatctgcagcacttgaacaacccgacagcccatatctgtcgcaagatgcaggcggtttaaccggaacaccctgcggagttatcattaacagtgattatgcctccgcactgacaggcagcgatgtgctgatcgactttactcgccccgccggaacactgacgcatcttgccgtgtgtcgtcaatcaggcatccacatggtgatcggcactaccggattttcagcagaagaaaaagaaatcattcatgatgcagcaaaagacatcgccatcgtgttcgctcccaatatgagcgtgggtgttaatatactgttcaggttgcttgaagtcgccgcaaaggcgttacctgctggttacgatgtggaaatcattgaggcacatcaccgccacaaagtggacgcaccttctggaaccgctctgcgtatgggagaagtgattgcccagactcagggaaaaaatcttgagaaagtagcaatttatggacgtgaaggccacaccggggaacgtgcggtagatactattggattttcaaccatacgtggtggagatattgtgggcgaccacacggcgttatttgccggaatcggcgagcggctggaaattacacataaagccagcagccgcaaaacatttgcaacaggtgcattgcatgccgcgcgttttcttgctactaaaaaatccggattatttgatatgcaggatgtgctggggctacgctgatttataccagcctcatatattgatagtttgcgtccaaggaatcgctaaggaacctctgaaaaacgtcaacgaggtagaagttggcaaaaaggcagcgtttatacgtgataaatgagcattttcagccgacttttaacggggaaaggcaacgcggatagtttttcagaggttcctaaaacatcagcaaggcgcagtccgttcaaggcacaagtatcagcgacgcttactgccacccagcaaactgcccagtgcaccacgcaataattcccgccctatacgacgcacctcacttttaacgacattttgcaccaaaccatcgtacagcccacctcgtggaccagtacgaccaaagagcacttctttaactaccgaacctacctccccaagcaagctattatctgcgccctgcgaaccagacttggcacgaatatcagtcgatgattgctcatgatgctgagcaactaacaactcatgggcggattcacgatctactgatatgtcgtaggaatcagccaccagcgaatctttgattaacgcatagcgttgtttatcggcaatgggtccaagctgactccccggtaacaacacatacacacgttccgtttcactggggcgtcccttggcatccagaaaactgaccagtgcttcgcctacggccaattcagtaatcgcagtttcgatattcaaccctgttttaggtcgcatggtgctggccgcagctttcacggccttctgatcgcgcggggtaaatgcgcgcaatgcatgctgcacacggttacctagctgtgccaataccgaatcaggaatatccaatggattttgcgtgacaaaatagacaccgactcccttggagcgtatcaggcgcactactaattcaatgcgctcaatcagcgccttaggtgcaccagaaaacaacagatgtgcttcatcgaaaaagaataccaacttgggtttttccggatcaccaatttcgggtaaacgctcaaacaaatccgaaagcatccataatagaaagctagcgtacaagcgtggggcagtcatcaactgatcagcaaccagaatattgatgactccctgaccgctcaccgtttgcatgaaatcttcaatatcgagcacgggttcaccaaaaaactgagttcccccttgcgtctccagttggatcaactcgcgctggatcacgccaatactggcggtgctaatgttgccatactgtgtagtaaagctctttgcgttgtcacctacgtattgcaacatggcacgcaaatcttttagatcaagcaacagcaggccgttatcatccgcaattttaaacaccaggttgagcacccctgcctgggtaacattgagatcaagcatgcgtgccagcagtagcggccccatatcggaaatggttacccgtatcggatggccctgtttaccaaacacatcccacagtgtggcaggacaagctatcggctccggcaacggcaaaccgcgttctttgagcacagcagccaatttattattgatttgtcttttttggctaattccagtcaggtcacccttgacgtcagccataaaaaccgacacaccaatacgcgagaattgctcagctaatagctgcagcgtaacagtcttgcccgtaccagtagcgccagtaataagcccgtgacgattagcaaactcaggcaataattggcattgtgtagcgtcacgttgcgctattagaagcggatcagccataaaatataaaaaatggatttaaaaacagctgattaattatatcaatgggtgaaataatcaaatactaagctgagaattaagataacgtcatcacacaatcttgataaaaaccacagataatctacaaatagcctatgctgagagtgctattagttggtagcaaaaccacgaattaatcagcatcaaatgatttaacagcatccgaatatacaatcagggtaagagcatgtattaccctgattgtatattcggatgctgtccaaacacaaaactgacaccaccacccagtttatggatgccagcggcctgtttaaaaaagaaaccaataacaataaccctcaccgacgcgcacatcgaacagatcatgcaggtatttggcagcaaagcgaatgtagagcatgttgcccagtcggtaccgtttgagaaggttgctgccaacgactataacctgccagtatgcagctacgttgacgccaaagacaaccgcgaagtggtgggcattgccaagctcaatgcagagctgacaaccaccgttgccagaatcggccaactgcgccaagatattgacgcgatagtttcagaaatagagggggctgacgcatgatcctggaaaacaagctcaatatcaccgatcaaatcgaattggccaaagccgaagaaaagatcagcaaacaaaaagccaggcaactgtttgattctggcgatattcacaaggtagcggtgggtacattcgccggcctggcctatatccacgcctatttatttgacgatatttatgacttcgctggcaaaattcgcgacgtgaatatcgccaaaggcacaaccgcttttgcgcggatcatgtatctaaagccaccgttaaaaaacatcgatgccatgccgcaatgcacgtttgatgaaatcatcgaaaaatatatcgaaatgaatattgcccacccctttcgtgaagacaatggacgcgcagagcgtgaaaaatacggacacggcgagccagaagggttatgacgcaggcaaaaaggtatcgggcatcaaacgccatatcgcggtctatactcagggcttgccgcatgccattgtggtgacgacggcggaagtgactgaccgcaaaggtgcgttgcaagccttggagcactgcaggcctagcttggggcagatccaaaatctgctgtgcgacagcggctataccggagaaccatttgccgaaggcgtgcgagaaatgctggacaaacttgtcacggtgcagattgccaaacgcagtgaattgcataccttcaccgttatccccaagcgttgggtggtggagcgtagctttacctggctggagaagaatcggcggctgtggaaaaactgcgagcgtaaactccgtaccagcttgcaactcattcatctggtattcttggctcttttgcttaaaagattttgaacagattctaaaagaaactatttattgtgcactggcacttgatttttactttcagattactagtgctatttcttactggttgcgctgccgttgggccagattatgtgccaccagaaaaaatcactcccgaaaaatttaatgccgcactgagcgaagatcagaaagctaaattattgcttcctgaaactgggcaagaagcagatgaggccaaaacggaattcaccaaacaagtaactcccgcaatgttggttgactggtggaacactctggaagatccattattaacgcgcttaattgaatgggccatcaggggcaatcttgatcttcagcttgcgcagtcacgactgagagaagaacgcgcttcgcggggaattgccagatcaggcctgtttccaaccatagagggagatgcagcatttacgcgaagaaaaaccaatctacaatcaggtggcatcagtgaaattgacctctattcctcgagctttgatgctagttgggaaattgatatgtttggcggcatcagacgctcaattgaatcggcacaagcctccgttgaagcacgtcaagaagaattaaacgacacgctggtgactttggtggctgaagtcgctatcaattatattgaaattcgtgcctttcaagcccggcttgaagcggctgttaacaacctggaatctcaagaagggacgttacaaattgttcaggatcggttagatgcaggtctgacaacaacactgtcactagagcaggcgaaatataatctggaaaatagtaaatcagaaattccaatgttacaaaccggtatcgaacaaggtaaaaatggtcttgcagtgctgcttggagagttccctgggtcattggcagaagaattggagcagtaccaaaaagtcccaacggtgtcaattgaagtggctgttggcgttcccgctgatttgttgcgtcgcaggccggacgtccggcgtgcggagcgcgaattagcagcgcaaacggcacgggttggtgtggctactgcagacctttatccaagactcttcttatttggttctgtaggactggaatacatttctgctgccagcttttttacaggacccgcagccgccttccaaattggaccgcaaatcagatggccagtttttaatgctggtcgtatccgacaaaatataaaaatagaagatgagcgacaaagtcaggcactgattcaatacgaggcttcggtattaaccgcagttaaagatgtagaaaatgctttaatcgattttgcgaatgaacaagttcgcagacaagctttgataaagtccacacaatcagcaaaatcagcagttagcctgtcgcgtgaattgtacactgcgggcctaactgattttattggtgtgctggatgcagagagagccttattttcctttcaagatcagctggcagtgagtgaaggaaaggttacttccaatttgattcgtctgtataaatcattgggcggcggatggaaaccactgatgcaagatgcaccgtaggcagttctaggtcaacagcaaacacaatttgaggaacgttgacttgaaaaaagtaaaactgcttacttctcttctaggtctttctttgttggtcattatttctggctgtcaaaatgatgatagtaattctgcaagccaactacaacagccagccccggcagtaatggttacgccggttattcaggaaaaagtcgccaaaattcatgaactggtgggtcgtaccgctgcactcagaacggtaaatctagtggctcgtgtacaaggctttctggaaaaacggaatttcatagaaggagatagcgttaaagagggcgatattttatacgtgatagagcaagcgccttatcaaatcgaagttaaggctgcacaagcgaaagtagccgaagctaaagctactctacagaatgctaaatcttatttgcaacgcttaaaaacggtgcgccaaggcggggtgtcacaaatggaccttgataaagccagcagtgattttcttagcgcacaagcgctgttaaccagtgcccaggccatgttggaccgagccaaattgaatctcagttacactgaaatacgttctccgatcaatgggcgtatcggtcgtaattctatcagcccgggaaaccttgtctcaccaaactccggcattttagcaacaattgtgctaatcgaccccctgtatgtactttttacggtgagcgaagttgatttccttaccgagcttcaaaaccagctggagaagggagagtcaactatatttgttcctaaaattcaacttgccaatggaaccatttatccttttgaaggaaaatcggattttatcagccccatcgtggatgaaaagaccggaactatcacgattcgagcaattttcccaaaccccgatacaaaagaattactcggtcagacaaatacgccacaaagccgccgcttactgatgccgggacaatttgttaaagttttggtaagacgagatgatgtagaggaagaacatgttattccccagtcggctatgcaggaagatcaaagtgggaaatatgtgctggttgttgatactgacaaccgcgtgcaaaaacgctcagtgacagtcggtgacaaaatcggcgtaaattggatcattaagcgaggtttgcaggtgggcgaattagtgatatctgagggtgcgcaaaaggttcgccccggcattactgtacaaactaccatagcgattccttctcaaccgatcgagaaataaccagtgtttagtaatttttttatcgagcgtccccgcttcgctttcgtcatttctattgtcattgtacttgctggcctgatatccctgttaaaactgcctgtttctctatttccccaaatcacaccaccgcaaatacaagtcagtgcttcatacccgggcgcaaatgcccaagttgtagaagaaaccgttgctgcaccgattgaatctgtagttaatggtgtcgagggcatgctttatatgtcttcagaaagtgccaataatgggacatacacgctagacataacgtttgaaatcggaactgacgttgatatggcaatggtcaatgtccagaaccgattgtctctggccacgccaagattgcccgaggatgtcactcgctcaggaattacagtacgaaagcaatctcctgaatttttacaaatggtatcttttacatcgccaaatggaacctacgatcaattgtttcttagcaatttcatcagtttaaatgtaaacgatgtactttccagggtcccaggtgtcagccaggtttctatttttggcgcccaagattattcgatccggatttggctaaatccagacaaaatggtggatttagccatcaccactgaagatgtgaccgctgctatccgcgatcaaaatatacaagctgcagccgggcaagttgggcaaccacccttggctcccgatcaacaattccaatacaccattcaagccaaaggacggctttctgaagtatcagaatttcaagatattattatccgggcacaagcagatggctctactgtaaaaatggaagacatcgcacgcgtagagctgggttcccaaacgtttaatgttctttctcgtttgaatggatccccagctgttaatttcgctgtatatcagctgccagaagccaacgcactggaagttgcacagggtatcgagacgacgctgaaacagctggcagaacgattccctgaggatgttgagtatgccttgccttacgattccactcgatttatcaataactctttgacagagctcgttcaaacgctgtttattgctttgagtttggtcatattggtggtttacgcttttattcaagactggcgtgccaccttgatcccagcactggcaattcctgtatcactgatcggaacctttgctgttttgctggtgatgggttattccatcaacactttgtcattgtttgcattggtgttggcgattggcatcgtcgtagatgatgcaattgtagtggtggaaaatgtccagcgtcatctacaggaaggattacccccccaggatgcaaccaaaaaaacaatgaccgaagtcactggtcctgttattgccactacattggttttattagcggtattcgtgccaatcgcttttctagaaggtatttcaggccagctctatcggcagttttctgtaacgattgctatagctgtttctatttcatcgctcacagctttaaccttgagtcccgctttatgcgccatgatgcttagaaagcaacaggcacgtccgtggtttgcgctacgctggtttgaaaagatttttggaaaagtctccgaaggttatctattttgcgtaaaaattgttgtaaggcgattaatactgacagcactacttttactcatcattacaggcggtgcatattgggtattcaaaaacacgccgacaggatttattcctcaggaagatcagggcattatttttgtcgacattcagctgcctgatggcgcttctttgaacagaaccgacaacgtggttaaacaagttgatgcgttactctccaaccttccaggcgtagaggatatcgtttctttagcagggattggattgctgagtggtgtcaaatcaaactcaggaatggtgatcagtattctcaagccttgggatgaacgcacatcacccgagttatccagtgatgcacttgtcgcacaaatatggggcatgatggcacaaattcccggcgccaatttgatcgccttcactcctccacctatcagtggcttaggcagtaccggggggtttgaatttcaacttcaggataaaagaggcggcgaccctcaagatctttctgcagcaatgcgtggctttttaatggaagccaatcaagatgctcatttgcaaaatgtgtacagtacgtttcgcgcggatgttccacagataaagctggaaatagatcgcctgcaagcaaaagcgctgggcatccccgtgcgagagatattttcaagcttacagacacaattgggctctctctatgtcaacgattttagtaagtttggtcgggtttatcgggtaatcctacaggccgaagcaccttatcgggacaatgctgatgatatcgggcgtatttatgtgcgaagttcagaaggcgttatggttcctcttcggacattaacaaaaacatcctcgatgttgggtcctgatagcctcacacgtttcaatatgtatcgttccgcacaaatcaatggaagccctgctcctggattaagttccgggcagggcatatccgcaatggaacaacttgcaaagcgagtgcttccagatggaacagagtttgaatggtctggtatgtcatttcaagaagttcagacaggctctcaattacccatcatatttggcctggctttaatatttgttttcttgtttttagtagcccaatatgaaagctggtctatcccttggggagtcatactttccgttccaatcgccttggcaggcgcgctcattatgatgtgggggatggggaatgttttggatatttacgcccagattggtctcgtcatgttggtcggtatggcttcaaaaaacgcaatccttatcgtcgagtttgctaaagtgcaaagagagagtgggttgtcgatagctgaagcagccatccaatccgcccaactccgttttagagcagtcatgatgactgcgatttccttcattctcggtgtgctcccattagtcgtcgcatcaggcgcaggtgcagcaagtcgtcaatcacttggaactgttgtttttggaggaatgctggtttcagcaatcattggaacaattttaattccggctttttacgtgatcattcaatctatgacggaaaacatgcgacaaccaaaaactcgcctttaagcgtattaatttgcaaaatggcaactggtaattgtcttcttaaaataggactgaccaggtcacggttgattatgagttacatgctgtagcaaaagaacctatcgcagtgtctgaaattacttgtccactacactcaacactgttctgcccaagatgagcccgcttaatccgcaatacctgagtaaaaagcaaagcgtgtttcagaaaatcacggcgtttgtagggaagtttaaaggcgtgggtggaaaaatttagcttaattttaatcaagtacaatacagcactgctaattaatctatattttcctgatcttaatggcaacttatgcaattggtgacctacaaggctgtcaccgacattttcttgacctacttgacctgactggcttcaattccacccgggacaggttgtggctggtgggcgatatcgttaaccgtggccctgactccctctcattactgcgtactttgatggcactgggagatgccgtcacaatggtactcggcaaccatgatcttcatcttttggcagtcgctgccggttctgcccaactgaaacacggggacaccttgcaaccacttctggatgctcaggatagcaaagttctgcttgactggctgaagtgccagcgattgttctatcacgaagatgaatatgccctagtccatgccgggctattacccgcctggcacactgaacaagcggcgatgctggcacaagaggttgaagcaatcatccacagtgatcaatttcaaatgttttctcaatcaatgtatggcaatgcacctgattgctggcaggatacattacggggagaaagccgctggcgagtcatcattaacgctatgacacgcatgcgcgtctgttcactcgaaggcagaatgaatttttcctacaaggaaggattgtccgctattccccagggtttgctgccctggttcgagattccctggcgtgccagcaaagatacaacgattgtatttgggcattggtctgcgctgggattacatctgacgcccaatctgattgctctggatacgggatgcgtctggcaaggctgcctgacagctattcgactggaagacaggaaggtatttcaggtaccgtgtgcataatcttcagtgataacgcttgagcaatggccttttccgccagacgtgcaagttcgcggcggtttttatcatctcctggaatggggctcatgaaatttaattctgcctgaatttccggttcattcaatatcaacatcagggattgcaatatcgttacggtaacatagaccacgcttgtattccgcgaaccatcgcggttgctgtaacgaatcgcaatcggacaaagcagtgcttttgctgttacaactggctgcaacaaggaggcgtgaaagtgcaggagcacatcgccgttacaggtcgcaccttcaggaaatatagccacagagcatccggccttcagcataccgtctattttctgattgacccgtaacgtatccccacgttttttacgttcaataaacaatgtcccggcactccggcataaccagcccagcactggccaggtgctgatttctgcctttgcaacgaagcgcacgggatacaaagccagaataacgatgatatccagccacgaggtgtgattcgccacaaagagcaccccttgctgattgcaggcaggcagagaaccaccggaagacaacttcacattaaggatatgaagaaatttctgtgcccatttacagatcatgtgattctgccgggccgtactggtatacggaagcaatagcgattgcagtaatccggaagcaatatgcaacatcaacctgataaaccggatgcttttgaccagcttgtttaccctggttacggccatggcgaacagcaagtcaaagtgatcagggaagaaccaggttgataaatgtatttttcagccttgggcaggccaccactaaaatatacgactgccaaaagattcaaaatagcgctgaccgatctcatcccgctcataacgatgattctggccgccacgataagcgattttcagcgtgcccatgagtgaggcaagttgcccggtttcctgccaatccatgccctgagcaatgccgtagagcagtccggcgcgataggcatccccgcagcctgttggatcaaccacttttttcggtcgaacagccggtatctggaattgcttgccctgcgcataaatcaccgagccttctgctccttttgtctcgataagtgcgttgacccgggtagccagcttattcaatgtataaccagtaagtgattgcagcagctgagcttcataatcattaaccgcaatgtaatccgccttttcaatgaaatcgagcaactcatctccattgaacatcggcatcccctggccgggatcaaacatgaatggaataccagcctcatgaaactctcgggcatgagccaacattccttctcggccatccggagcgacaatacccagacttatatctgcagcgtccttcacactgttccggtgtgaaaaattcattgctcccggatgaaaggccgtaatctgattatcatccaggtcagtggtaatgaacgcctgcgctgtaaaagtatcctgcacctggcggatatgggtttgcgccaatccaagcttttccagcctgtaggcgtagggttgaaaatcatctccaaccgtcgccatgatcagcattttgccatccagcatctgcaggttataggcaatgtttgtcgcacatccgccaaactcccgacgcatctcgggcaccaggaatgctacattcaaaacatggattttgtccggaagaatatggcgtttgaaacggtcttcaaacaccatgattgtgtcataggcgatggaaccacagatcagtgtatgcatatcagctcaaatatcatgtgcatgaggtgaatcagcccgctggattccataccagatcaagttcacgagcagccttgacatcatctattctccgcaacggcatgttatgaggcgccgtcttgaccatttccggttgtgtgtctatctcatccagaatctccttcatcgcaacaacaaagcgatccagcgtttctttggattcggtttcagccggctcgatcagcaaacattccggcaccagcagcggaaaatagacggttggcgcgtgaaaacccttgtccaacaggcgctttgccaggtgcattgcagtcactccggttttatccttgatttccttcatagtgacaatgaattcgtgactggctcgccggctgggataggcaatctcaaagcccagtttgcgtaactcggccagcagatagttagcattgagtgttgcatattctgcaatccggaacattccttctgcacccagcaatctgacatagatgtaagcacgcaacagtactcctgcattacccatgtgcgcggataagcgtccgatagattgaggacgatctttctccgtcaaccagcgataaacaccctgttcatgcgccacgatagggatcggcaaataaggcaacaaacagtctgccacgcctaccggagccgcacccggcccaccaccgccatgaggggtcgagaaagttttatgcagattcatgtggatcacatcaaatcccatgtcacccggtttgactttacccagtactgcattaagattggccccatcgtagtacagtaaaccaccggcctcatgcacgactcggctcatttctgccacttttttctcgaatacgcccagagtggaagggttagtcagcattaaaccagctgttctgggactaactgccgctttcaaggcttccatatccacgtcaccatcgcgatccgtaggaatctcgatcaccttataaccgcacatgacagcggtcgccgggttggtaccatgcgcagcatccgggatgatgatctcggtgcgctcggtatctccacgcgcttcatgataggcacgaatcatcgtaataccgatcagttcgccctgtgcacccgccatggaagtcaggctaactgcagacatacccgtaacgtctttcaggatttcctgcagctcatacatacaagccaagaagccctgacccgtatcttctggtgccagcgggtggcgtgataaaaattgtggcagcatggccagtgcattacaggcacgcgggttgtatttcatggtgcaggaaccaagtgggtaaaactccgtatctatcgagaaatttttctgggataggcgagtatagtggcgcaccgtatccatttcggaaacctcaggcaacaagggagcggatttgcgcttcagattatccggaatattgttcttggctggccgggttgccggagcctgggaataattcaggcgatttttgcgggaatgttcaaatatcagcatgttttatcttaggttggtgagatttattcaatacagaacaagtaacgcggctctcttccggtttactcctgatttcaggctttcagtacctgccgcaacatttcagtatatttatccagatcttctgctattttggtttctgttgcgcagaccagtagcgtgttcttcagatccgggtagtaattctcaagcagtacacctccaagtacgccttgcgccttgagcttgttcaagacttcatcagccggaacagataactgaagcacagcttcgtggaagaacgggctgtggaatgctttcttcacgccgggaagtgtttccagttgttccaccagcgccaaagtgtttgcatgagattgggcggcaacccgatacaatccttcaggccccagtaacgacatgtaaattgtcgccgctgttaccatcaatccctgattggtacaaatattggaagttgctttcgaacgacggatatgttgctcccttgcctgcaatgtcaaggcaaaaccttctttgccttccagatcggtagtccgtccaatgatccgccccggcatttgccgaaccagttcttgtttgcaggccatgaagccaaagtatggcccgccactggaaagtggaattcccagaggttgtccttctccgacagcgatatctgctccctgacgcccccattctcctggtggtttcaacatggcaagtgcagttgggttaaccactgcaatagccagagattgcttgtcgtgcgcccaatcagccagcgtatcgacctgttcgagcacaccaaaaaaattgggttgaggaataatcagcgcagcaaattcttcctgtgcaaactggtcaagctgatcaatggccacctgcccagtggcaggatcgtatggaacctcaaccacctcgatcgcctgatttctgacaatggtacgaactacactgcgataaattgggtgcacagtctgcggaaccagaatacgtctggatgatttgtgctggcgcacagccatcagagcagcctcggccagagcagatgccccatcatacaaactggcattggacacatccattccggccaacgacgccatcatagtctggtattcgtacaacaattgcaatgtcccctggctggcctctgcctgataaggggtgtaggaagaataaaattctccccgggttgttatttgccagactgctgctggaatatgatgttcataagcacctgcgccgataaagctgagatagaacccatctttctgcgcacgttcgtacatgaggcgcgaaatttccatttcgctcatgccggtcggtacctgggttagtttcccgttttttagctcggcgggaatttcgtcgaataattcatcgatagatgtagcgccaatgctggcaagcatttctgttacatcttcttctgtatggggaataaatggcataattaactgtattatccaaaaaacttaaaggttatgtctgcttgtctatttactgcaaacagctttaacaaagcggtgaaaaacttctgcgttgccatcgttgtgttaacaacaagctcaaagctcatttaccatatacataaactgcgcttttttgcctgttttgccttgctccgacggcatcttcatcaatgtttctcaccatcctgttaatgtgcatcactttccagcagtttttcatatccgttggcatcaagtaattcatcaatttcagcagtattggctggcttcagtttaaacaaccaggctgaataactgtcttcatttattttttcgggggatgattccacctcagcattgatagcagtaacttctccgctgagtggagcataaatatctgaagccgccttgacagattccactaccgcacaatcttcctgctgcgccagaatgcgccctaccttgggcaattcaacgaacaccatatctcccagtaattcctgggcatgttgagtgatacctactgttaccgtaccatctgcctccaacttgatccattcgtgtgattttgcatatttcagctctgctggaacgctcatttatccgtcactcccctaaatttaggtttaaaaattcaaaacgctttatctgctgatacttttacaaaaatcagatcagtgcctggccattgcgtacaaacgggtatttaacgacccttgccgcaagctgtttatcccgcacgacaacatgtacctgctctcctgcagcgattcccaccggaatacgagccagtgcaattgactgatttaaagtgggcgaaaatccaccactggtgatttctccctcaccagcgataccctcatgctgtgtaataattttttgatggttgcgtaatacgcccttatccagcagaaccagtcctaccaattgttgattaaccggcttttcaagcaaggcctgtttgccaataaaatcccgctcactttttaggtctacggtccacgccaatccggattcgagcggattggcggtttcatccatatcctgaccataaagattcatacctgcttccagacgcagggtgtcgcgtgaacccaggccagccggggtcacacccgccgcgtgcagcttttgccaaaaagctgcagcctcatcggctggtaatgtaatttcaaagccatcctcaccggtatagccggtacgcgcaatgaaatagttgccaaatgctactgactggaatggtttcagatcttctgaagctgctttggaatctggaataacagcccatacttttgcacgagcattcggcccttgcacagcgatcatggcaaggtcacgacgcggagtgatggttaaatcaggtgcatgttgactggattgcaaggtaatccagtcaacatccttatccgccgtaccggcattcaccaccagacgaaaccaggattcggacaggaaataaatgatcagatcatcgataatcccaccagcaggattcaacatacaggtatagagcgccttaccaggaacggtaagcttatcgatattatttgctaccaatcctcgcagaaattgacgaacattttcgccgcgaagatcgactgtcagcatatgggagacatcaaacatgccggcatcacgtctgacagcatgatgctcatccaactgggagccatagtgtaagggcatatcccaaccaccaaaatccaccatttttgcgtgcatgccacggtgtgccgcattcagaggggttgtcttcagcatttattctctctcaaaagtaaaaggaaagttttatctgtgctatttctgcatccacgcaatactactcatgatcgcagcggccaacagatatcaactaccccctctgtccttttacctgagagttttacggataactttccgcatgccccttcggtggctgaaattgtttcagcgctctccagattgccgatcacaagcagttattcaagctttacacagccacacctgagcgattccggggggttacgccttcggtgacgctgtgttttattcagacacagcgcactctcctgcctggatgaaatgttagcaggtcgaactatactctagcttgggatattaagacaaggtgagaccgcagcgttgcgccagcaccacagcagaatcaacgcttgcggcaatttcagcccgtatcgctgatgtagcacgagcatatatgtaaagctattatcatttcatggttctcccggctagcttgatggattctatcagcgctctcatgacagctcgcgccatgagcagcggataacaaattttgtctatacaatcatccgggactaaacaggtgataacagacagcaaacacaatcagcctgttgctgacaacaaactgaacagagatttctctcccaaacagcctaaccgcctgaggggattcaaagaatgcgcccgcgccaagcgcacatcaataataaatccagcttgtactcagatctgctatttttgaagttgtctcatcaatcaagcggcagccagtccttgccaatcaggaaatcagtatagagctttgcttccgggctacctgctgcgggtgaccaatcgtaacgccatttgacgataggcggcagtgacatcaggatagattcggtacgcccccctgactgtaggccgaacagcgttccgcgatcccataccaggttaaattccacataacgaccgcggcgataggcttgaaaatcccgttcgcgttcgccataaggaagattgcagcgtttttgcaggatggggacatacgccgccagaaactgatcccctacacttttggtcaggttgaaacaggtgacaaaatccggctggttgaggtcgtcaaaaaatacaccacctattccacgcggctctttgcggtgtttcaggtaaaagtattcatcacaccatttcttgaaacgtgggtaatattcactacccgaaggctgaagtgcatgcttgcagatctgatgaaaatgaatagcatcctcttcgaaaccatagtaaggcgtaagatccatacccccgccaaaccaccagaccggttcagctccttctttgatggcggcaaaaaaacggacgttcatgtggacagtcggtgcatagggattgcgcggatgcagcaccagtgaaacccctgctgcttcaaacgccctgcctgcaagttctggccgggctgctgtagccgaggcaggcaaacctttcccatatacatgggaaaaattgacaccaccgcgctccaatacattgccttcttcgatcacacaactggttcctcccccaccttccgggcgatcccatgaatcgcgacgaaatgaaccaccatcagcctgctccaatccggccacaatgttattctgtaaattaaccaggtaatccttgacttgtgcaaagtccatatcctctcccaatatgtgatgctgatatttgtcaatcagccttttcgggcaattctaccttcacacattcaaattagcacgctgataccacgccaccactcaattgtcatctcatctctccgttttggcttgtgttagactccatgattttcccgtttaaccaaggatctgtaatgtctggcaataccatcggaaagctgttttgcgtcacttcatttggtgaatcccacggcccggcgatcggctgtatcgtggacggatgcccccccgggctagtgttatctgccatggatattcagctggagctggatcgacgcaaacctggcacttcccgacatgtcacccaacggcatgagggagatcgggtggaaatactctcgggcgtatttgacaacatcacaacggggacaccaattgctctgctgattcgtaatgaagatcagcgcagcaaggattacagtaagatcatggatgtgttccgtcctggccatgcagattacacctactggcaaaaatacggcattcgcgattatcgtggtggcggtcgttcatccgcacgggaaacggctgtgcgggtagcagctggcgctattgccaaaaaatggctgcatgaacgctatggcattgtcattcggggctatatggcgcagcttggcccaatcgccattccctttaaaaactgggaagtcatcaaccagaatcctttttttgtcgcggatgatgactacgttcccaaactggaagcatttatggatgccttgcgcaaatcaggcgattcagcgggtgcccggatcaatgtaatagcggaaggtgtgcctgttggctggggtgaaccggtttacgaccggctggatgctgatattgcttacgccatgatgagtatcaacgcagccaagggggtagaaatcggtgcaggattcaatagtgtgacgcaaaaaggaacagaacactcggatgaaatcacacccgaaggatttctgagcaacaatgccggtggaattctgggaggcatttccagcagccagccgattaccgtcagcgtagcgatcaagcccacctcgagcatccggctcgggcgacgttctatcgacaaggccggcaatcccgtgattgttgaaacccacggcaggcacgacccctgcgtcggcatccgggcaacacctatcgtggaagcgatgctggctatcgtcttgatggatcatgccctgcgtcatcgaggacagaatgaagatgtggtttgtaccactcccaaagttcccggaaatatcatcaacccgacaaatccggtaacaacacagcccgacgtacgccgggctgaagatccggaaccggatgaaaattcgtaaagagattatttgccccagaaaaaccggtaattctcaactctgcctctctcacatcagctcgtcgttgagaactaaaaaaaccactgatcaagcaacaacaactgcataattcgtacttgaaaaatccatattcgatatgccagaaagtcagaatcgtttaagaacctgaaacaggttccgttttaaggacaactttatgtaaggagatagcagagtgggcacaagacgatcaaattttgctgtttacgcgggattgctgtttctcttgaccagcagtactgcaggatggacgcaggacatcagtgaaattcaacgacaattcaacactgaaattctcaataagccatttagtgttcccagcgatgcagaactgacctccgcattgaaagaggccacactaaagggcaaatccagcatcgcgcccagccatacaccggcttgcgtcggacctgggtgtacgacaggtggaaattacggttacggaagctactttggaggatacgcccgaccctattatggcggctattacggccttaatcgctaccttcccttttattacggctggtaaattgttcaattgcaaagtatatgcaagcggcaatcacatatctcagctatataaaaacagtttattcgtttgatctttaatttttcacacaaatactaaaactaaataccaggaggtgaaatgggttattccatcagtaaaccagcccgggctctggccgggatcatagttctctctttgacattgggcggttgtgctgcagttcatacatccattgcaaaaaaggatttggatgtgcaaaccaagatgagtgacactatttttctggatccagttgagccagggcaaaaagttgtctacctgaacattcgcaatgcttctgacaaaaccaatttcgatatttccccgtctgtcatcaattcattacaaagcaaaggttaccgcattacagaaaacccgaaagcggcgcattactggttgcaggtcaacgtgctaagcgttgagaaagccagcccgaccgcagccgaatccgctttgagagcgggttatggtgggctgggcagtgcagcaatgggcgctgcagtaggctcggcaactggcgcagctattagtggctggagcggcgccgggattggtgggctcgccggcgcggcggcatttggcctggtggataccatcgccggggctgcagtaaaagatgttacctttatggccatcaccgatgttgagatcgctgagcgtgctgaagatggcatcatcgtgcgcgaagatcgtcaacaggatctgaaacagggggttggaggctctaaaagacagacttcttccaaagtcagcgaaatgaacaagtatcgcacccgcgtcgttagcatcgccaacaaggccaatcttgaatatgaagaagccgcacctgaattaacgaatggcctggcacgcactatttccggattattctgacattctgcctgccgcctggcacaacatctgggagcgactcatcaaaggggatccacaatgaccataaacaccatgatcatcacgctcgcttcagtggctttgttatcatccacaactatattggcaacacagcccgctgacagccattcagtggtcaatcgtatggcaaaagagctggagctcagtgacacgcagcgctcccaggttgaaactattctcaacaatgagaaaaagaaagttgaagcagtgttcaacgaggagaagatgaaattacaggcaattcaggaagaaacccataccaacttgcaagcggtgctcacgcctgagcaaatgcagaaactggatagaaaaatgcgccagaaaagcagctctggcagaaaatagattttagatgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacatttagaacctgtttgtgatcttataaaattggtgatcatgttggggcatgagaacctgttcaagatctcgatcaagggatgcagtgcaaggcaaaattgaacgagaaagcggagcatacttgaagtatgtgagcattttgagttcaatttcaacgccgtaatgcgcccttcagtgagatattgaacaggttatgagaaaaagttatccaggcgctctatccatccaggcgctctatccaatttgctgccattcagccgatcctggaaagagttcgcaaagtcaccaatctgcgtcaccaaaccgcgcattgttgacctgttcgatgtattttacacagtggtgtacatgcttaaaacggactgccaatggcgagtgcttctcggtgactaccccaaacgggaaatggtttgcgcatatttctccaaatggaaaaaacctgacgtcggtggcatgagtgcgttggagtgcgcattaaaaaatcagatataaaagagctgcatacgggtaataaaatgtccggaatcaaacgagacatattgctgcattgacgccagtagcatcccgactgtcccgcgtattaagtatgcttgccgtctagctagctacacagcccaaccatttactgaggcagtcagattgtgtttgggtgaggtgatctcacggtgcagatcgccaggagaaatgaaccgcacatttttcctgccattcccaggcgttggattgtgaaacgaactttttaatggcaggaaaaatgccggcgattatggaagaactgtgagcgtaaactcaataccaacctgcaatttatccacctggccttcctggctctactactcaaaagaagatgccgatggatacattttgtctggtctcctgaatacactctcttgcgcctggcaatcagaattcgacccgagacgcaattttgaacataacaggtgcgccaacgcctagtaatccgttacctgcagtactccaataattactgttggttacgttatccacgactgcctgaatcgtggcgcgcttgcctgcaatgcgggtcgtgtaacgtgcgcccagagaaagtattgcataatcatctacaaaggcctgattggcactgttcacgggccgcctccctacgtaatacacgccactgctgagcgctaatccaggtatgctggtcggacggtattctgcgaagaggctggcagtacgtttcggtgtgttatccggtattttgccaaatgtctcggcattggctttgttcaattgttccgattccataaacagcgcggatccgatgagcgacaattgtttcgtcacctcgccagaggctgataactcaaagccgctgtattgggccatgccgttaagaacgaaacgattggccgcatctacggttgtcgaagcgcgtttgatgtcaaagtatgcaacttggagcaatataccttgcgcgacaagtgccttgacacccacttccttttgctttgatactgctggcgccaggatttccccgttattggcgcgattggcgggtgcttgtccgctttcctctacgccttcaatatagcttgcgtacattgatacgttgggaatgggcttatacatcaaggataacgacggattaatcctgtcggccttataatgagtagtcttggcaacactcttatagaaactaccgcgtgcccccagcatgatttgcaacttgctaccaatcaagatccgatcagatatatacacgcccagatccgttatttttgatcggtttgcactaaatggagtggtaggagattgacgtgcaatatcaatgggattgtatagattctgcgcggtatcgaatgtggatgaagtgcgaggattctgtctacgttcgttgccggtaaaccccacagaaacctcatgggtaatgaattgaccaggaaatcgtccaaatacttcggtgcgaatgttctgattatcccaattttggccacggttgaagaaggtacgcaaggtacccgcgccggtaacaagattgtaatcctgaaactgggagaaattgcgatcccgcctggtttccgccctaccgatctcgaatagcaatccccaattgtcgcttatggcataatctgcacgaagcagcaggttagttgcctcggcatcatacttctgccattttccagcgagattgcggcgggcatccggaacaggtggtaaggttatgacgccgttgattgctgcaggagctcgaattgctgcctgttcagaaacctccttacggtaatgctctacatccaatttaagggaaagtttatccgtgacccgccagtcaaaagcgcccgaaacaagggcgcggtgaccggaaaagttgcggatgccgatatcctcgcgcccggcaagaagattgatgcgtgccccgaactgttgttcgctgccgaagcgccgccccagatcaatatgcgaattggcgccaccatacatattcaccatcaacgaaacgtttgaaacaggatccttactcgcgcgtttagttaccaggttgacgataccggatggtgggacgaaaccataatatagtgatgaagcgcctttgagtacttcaacacgctccttgttctccatcgggatatcaatcaggttaatgatcggcaaagatccgttgagccgataattactgcggttttccacaagaatgccgcgaatcgcaatattgtcgtaagtcgaaccgtttaattgcgaacgtgtaacccccgccgtattacgtaatgcaccaaatatgccggttgtggcctgtgcgtcaagcacttctcgtgtgatcacattactggtctgtggtacatcgattggtgccatatcccgaaatgttccaacctggacaaaatcggagttgaaacttcctatccgttcgccagtcaccgttacagcggggagtttttgtcctgcctcagcttgatcggcttcagtttcagtttcagcttccgccagctgaatccagaatatcaataaagatgcagcgattactgagcataaattaattttcataattaccaatagctctcttcacgttaaatccttattcatagtctaaatattgcttaccagttgttgccgtacatggtttcatgttggggattaaacacatggcgggtacagacaaagcagatatgattgtctcgccctgtaacatcgacaccgatatgttgcaaatgggaaccggtgatgagtggttttcgacggatataactctccgctcctggcgcaacgtacgatttcatgcggattgaccaaatagccttggtgtggtgatgagtatgttgcttcttgcgccatatgagtcaggttcacgcgaagcagaatatccgccacttcgcgacagcactgcgcaatccagttgggacgcaacgatacttggaatactataattgatattgctcatagccaatattcccgatatatcgggtaaaagttagctggcttgcccaagacgggctggcgagctatagaattgttaatgcggaagaatacctggaaaaccattcagacctctgctgccagcgaagagaaataaatgtatcgctctcataaattaaccgtctggcagataggctattacttaccagcagtagtttttgcaatcaatagtgagaatgattcttattgtatttattaaaatacaataatacaagtttttatcagttacccgtattgaattatcccaagttgttttaagaatctgttcaaagtctcaggaagtgtgagaaggttgggtgatgaggtgatcacggcgcagatcgccaggagaaatgaactgcacacttttgcggccattcccaagcgttggattatgaaacgaactttttaatggctgggaaaatgccggcaattatggaagcgctgcgagcacaaactcaataccagcctgcaatttatccacccggcacttttaacgctatagcccagaagagcataaacaggttcttacaaagaacgattgctgagatagcaacgtatagagtgagcacataagaaatctttcgtcatcccgacccagaatacaaatctattcacccggtttagccgtgtccccataatatttctctccgatccggatgcgttccctgccatttttttcccgccagctattagtatcgcgcagtgaataagcacagccacagtattcctgcatataaaatttctcccgtttactaatttccagcatgcgtgcggagcctccttgcttgcgccagttataagtccagtaggtaacgccgggatactgcgcagcggcccttacgccgctgtcgttaatctgctccatattcttccagcgggaaatacccagtgaactggaaataacatcaaatccattttcataggcatacagcgctgtgcgtacaaaccgcatgtcaaaacacatagtgcagcggatgccccgctccggttccatttccataccttttgctcgcttgaaccactcatccctgtcgtaatcaacatcgataaatgggatgctatgctcttccgcaaaacggatattctcatccttgcgtaaatcgtattctttgcgcggatggatgtttggattataaaaaaagatggaaaaatcaatcccggaagccatgatggcctccatcacctcacccgaacagggtgcacagcaggaatgcagcagcaattttttaccattttccggcaattccagttttctacgttccatttttcaattcacctgtacgctgttattcaattgttgcattatagacccggctaatactttactgaatcactcgacagttttataaacttcaaaaacagtaccataaacaggctttgcaggatccgatagaatcaacagaatatgacgacaggaaataaatccaatctatgttcacttctttaaggttaatcaatttcaaagcctgggaagacaccgggacgatcgcactaaaaccggtgactgtattactgggcaccaattcatccggaaaatcttcacttattcagagtctgctgctattgaagcaaacggtgcagtccccggatcgctcgattcacctcaacctggggggcgatgaaactaatgatttgtttaattttggcagcttcgatgatgtattgaaacgtggcacacaatctccacgcgaattttcaattacatttgcttttgaggcatatgaacagtcacgggtaaacgaagggcgattttcctgcagctatcgacaaactgcagcgggtgccgccgtcattcaagaactggcactctccaccggcgcgcaccgttttcgtgcggtacggagggaaaaagaaaactatgccatctttattgctgatgaaacccggccatgcgctaaagacaggaatctcgcacctgaacgctccattgcacttcctgccgaggcgatcgccacactgggcagcaatagtgctatcgctgaagatctgagccttgtcatccggcgtgagctggaaaatatctgctatcttggcccgttccggcgcaaaccagaacgggattacgtctggaacaaaaccacgcccggccaaattggaagtgatggccatcgcactatcgatgtcctactgtccggtgcattgagcaaagatgggaaacagaatgaaattctggatgggatttcttactggctggcacggatgaaagtggcagaaaaactaaccatcaaacagcttggccgttcgtcccgttacgaaattatagtgcataaggatggcattgccgccaatctgcgcgatgtcggcattggcatcccgctaatcctgcctgtgctgactgcaggttattttgcacctccaggtagcaccgtgattctggaagagcctgaagtccacctgcacccgctggcacaatcggtgctagcagaattctttgtaaggctgaatcggtcacgccatattcaattcatcgtggaaacacactcagaacatctgtttcgtcgaatgcaaacactgattgcacggaaagaaacatcggcagaacagattgccatgttgtttgtggaaagagtggcagataacgcaatattacggaaactgaaagtggatgaatttggccgagtaaataattggccacaacacttctttggcgacgcactgggcgaaacacgcgaacaagcccggctaatgcttgcccgccagcaagaacaaaattaatcagtgaagcaacgatatgtggtcgataccaatgtcttgatccttgccagtgtagtgaatcccgttatgccgaaagatatcgacacaacaccggaagaccccgcactgcagttccaggtatggcaatggctagttgaatttgaaaatagcccggcaaggctggtgctggattcagccggaaagatcaaggaagaatatgacaacaagctcggattcaacgattacgggattcaggttgtcatccataaatggagcactttggccgtggataatgtggagattcaatacgatgctgacggccatgccatattacaagcaccgctggatttagtggtacacgatctggccgatcgcaaaatggtcgccgccgcactggaagctatgaagcactatggagaaagcgctatcgccttcgccggtgataccgattggcatgactgggaacaagcattgctacaagcggggttatcactggaacctatcattgaagactggtctcgcgccaaacacgcggaaaaggccaatgggagataaccatgaccgaattcttccgtttccctaatacccctcacctgctttggttgggaaaaggccagccgagggatgacaagctgttatccgattccgaaattgccatgctgctgcaggatgaagtgctgattgaggaaaaactggatggtgctaatctgggtatttctctggatgaacatggtgagctgcgcgcgcaaaaccgaggtcaatatctgccacaacctttcgccggccaattttctcgtctgaacagctggcttggtcagcatggagaagctctcagacaaactctgacaccgaaactgatcctgtttggggaatggtgtgcggcccggcattcactcgattacaacaagctgtcggactggttcctgctgtttgatgtttatgatcgagaagcaggaaaattctggagcgttgaacgacgcaatcaattggctcgacagttgaatctcactactgtgccattgctgaaacgcacaaaagtaacactcgatcagctgattcaattactgaatgatgcagaaagccgctaccgtaacggtaaagttgaaggtattgtcattcgctgtgattcgcccctttggtgtgaaaaccgggccaaactggtcaaccgggaatttgtccagacaatcgaagatcactggcgcagccgggcaatcgaatggaacctggtaaataccggatcagcgaaatacacatcatgaatagctatgtgataaccggtaacagaatcaagctaccggggagaaaatcatgtcaaatctgaaagacccaagagtattatttgctgctgagcgcactttacttgcctggaaccgtaccagcctgtcactgattgcgtttggtttcgtggtggaacgcgcaggcaagcttacgctcgccatttcaccaggaattatcagcccaggccagctgacaggtatgttatggctgggcctggctttcattgttctgggtgcaattacctccgcccatgctgcccgccagtatgcaattgtccttcaaacgcttacgccggatgagttcccgccgggttatacggcgaaatgggggcttctggtgaatctggcagtcgccctactcggactgatactggcattggcgctctggctgtggcatttatattgagcagcacgagcatcctcgcagcgccaatcgtaaatctatttcagatctaccccacttcacccattggaatttccaacgccctggcaactccttcagcataagctctatctgcattcagacaatggataatatgccggagctggctttcacgggaggcttcaccgatagcacgcgcagtattgtcgaacagtatctgctgttgcgcggggctcatgagccggaacagattacccggctgggtataataatctccatcctcacgatgattccagtgagcggctgagccttctagtgccagagggggttctgcatacccgggctgttgctgccactcctgataactgttcggttcatatcccagcgtactgtcgtgattaccatcaacgcgcatagtgccatcacgatggtagttatgaaaagggcaacgtggtgcattaaccggaatctggtgatgattgacacccaagcgatagcgctgcgcatcaccataggaaaacagtcgtccctgcaacattttgtctggtgaaaaactgattcctggtatgacattcgccggattgaacgccgcttgttcaacttcggcaaaataatttcccggattacgattcaactccatcacaccaacctcaatcaatgggtaatccttgtgtagccaaactttggtcagatcaaacgggttataagaaagatcggccacatcactttccggcatgatttgtacaaataaggcccagcgtggaaattcgccgcgttcaatgctttcgtacagatcacgttgatgactttcccgatcctcgccgatcagtgtttccgcctcggcatcagtcagattcttgatgccctgctgtgttctgaaatgaaacttcacccagtatcgttctcgctgggcattgaggaagctgaaagtatggctgccaaaaccatgcatatgccggtacgtcgcaggaataccgcgatcgctcatgacaatagtaatctggtgcagagcttccggcagtaatgtccaaaaatcccagttattgcgtgcactgcgcagattagtacggggatcccgtttcacggcatggttgagatccggaaacttcagcggatcacgcagaaaaaatactggtgtattgttccccactaaatcccaattgccttcttcagtatagaacttgatggcaaagccgcgaatatcccgctctgcatcagcagcgccacgctcccccgccaccgtggaaaagcggacgaacaattcagtttttttaccgatttgcgaaaagatttttgcctgcgtgtaacgggtaatatcgtgtgtcacggtgaaggtgccgtaagcaccggaacccttggcatgcatccggcgctcgggaatcacttcacgatcaaaatgcgcaagtttttccagaaaccagacatcctgcagcaacatcgggccacgcggcccggcagtcataacattctgattatccggcaccggtgcaccggcactggtcgtcaatttccttttgctatcatccatttttctctccttccgtaagttttacatcaagcacctttttttccgctactggaagcagatcttgaggtagctttactcactatccggcgaaatctccggatagcaaaaaacacgattgtcaagacaattggaatcgcaataccggtcatcagctctatgtcaatatccaatcctgctgctttggcggctcgcagaccatatcccgtgatgccgagcagatagtagctcaacacaaccactgacagcccttccacagtttcctgcagccgcagttgcaggtaggcccgggcatccatcgatttgagcaaatcacgaatctgtgattccatcgaaatatccacccgtgtacgcagcatggaagtggcccgctccacacgcaatgacagtgtatcaagtttagatcgcaccagatcaaaggtgctcatggcagaggtgacccgctgctttctgaattcatacagcatttgcaggccttcaattcgttcctcacgcagctcggtaatccgctgctgcatgatgatgtgataggtatgtgatgcactgaaacgatgactggattgagctgatattctttcgatctctgtggccagcgcagtcagcttcaccaacgactgctgttcatcctcaatcgaattgggtgtggcgttggtcgtcatcaactctatcagctggtctccgtattgctccaactgaggaatgatttcgcgcgtcatggacaatggcaagatggtaagcatgcgataagtttcaatctccagcaaccgctgtaccagcctgccaacctggcgactgcgcaagttatcatcgtgcaccagaaaacgggtaaacccgtccggatggatctggttatcactccaaacactggcgctgcctgccgagactttagagccgatgacggtattggatgaaaacaaggtagccagttcactcatactgcggccggggcgcctgcgatcttccaacacaatatgcgttgcaaccagcaattctccaggtaatttcgccagccattcctgcggaacatacgcaatggctggctgggcaaagggctcatcaaacgggccttccctgtagaacgtataggtagagtattctgtatgccgttcccagcgcagatgaaaatcacccaactcaacacttaattgatcaaaagcgccattgagaatccggatatcgaaatgtttgcacaactcaataaccagcccacgctctctgttcacccactgcctatcagagagcaggaccagatgagaaagctgcaacggaatattaaccagctcatagacatccgcattcagttcatcatgcagcatcttccgctcgaaatattccggaatatccgttagcccgcttttcaacaaagtgtcagtcataatctgaaaaaattttctgatgattgaaaatctgttaattccagaaatccagtaaaagtttaacccccagcaaataaagcagacctgcaaaaattttccggagtgatgctgccggaagaatatatgctgttctggctcccagcggcgcagttactatactcgtcagcgccactataatcagcgcgggcagataaatatatcctaatgaataatccggcagttgctgattttgcaacaaaccattggcagcataacctgccgcactggctaacgctactggaaacccgactgcagcagccgttccaatggcatgatgtaaccttatctgacaagccgcaagaaaaggtaccgtcagcatcccgcccccgatagacaccaggccggatattgcgccaattacaccgcctgcaacaaacatgccgatttttcccggcaacgtataattttttcctggtttgaggttaaaccacattcgtgtggctgcaaaactgataaacaagacgagaataatactcaatatttggcttgaaagatggctggctaaagttgaaccggccagtgcgccagcgacaattccgggagaaatgtagcgcacaacccaccagttcactgcaccatgggcatgatgtgcacgcaaactggaaattgaggtcagggtaataattgctgttgtcgttcccagcgccatgtgcaaaacacggtcatccgggaagcccaaagatatgaaaatggaagccagcaccggcaccatcaccaggccaccgccaatacccagcaacccggcaagaaaaccgactattccacctgtcagcaggtaaaccagccatgcttccatgccagggatacctcgtcggtagttttaagcaagcctagaaatgtcgggaacaagcaaatatacggcagcatcactgctcacagctttgcctcgatgaacttccattccgccggatcaacaggggtaatggacagccgattgcccttttgcaggatgcgcatccctgccagttcagggtagcttcttaactcttttagggaaagcagccgagtttttctgacaaaccggatttcaacattgaaccagcgcggattttcgcgtgtagctttcggatcgaaatatttactgacgggatcgaactgtgtttcatcagggcaggcaagccgggaaacttccgcaacaccagcaatccccggctcggggcagcttgagtgatagaaaagaaccagatcacccacctgcatctggttacgcatgaaattacgtgcctgataattgcgtacgccatcccaggcaacggtttgttccggtctcgcagctaatccatcgatactcatttccgatggttcggatttcatcagccagaaacgcatgcttttacagataaaacttaaagagaatcaaaacttctgactaagaggatccccgcgagtgccgtcaggctgctatcttgaaccacaggttcaagagtggccgcccgccggccgcatcaggcgcgctctgtaaacagagtgcgcacaacagcaactattggctagcagccagatacaaagaattggttcaaagaacgcaagccttaacaaacaccgcagggaataaacttgttgcaactgccccggtataaacaaatcatttaattttgttttcagaatttgtccatcccgtacaattaaacttcaataacttgattttacgcttaaatcccggcatgtcaaaatcatgcttcttccaccttatctacagatagcagtgaaaaacataaattgaaaattatcagatcagtgatgatcggatttgataaggtcaattgcccgaagccaatgcaccgccaaatcatttgcatcaagattatggtgccgggattgcatcttgtgctggttgctccagcatacgtactccacatctcggccaggtttgccgaagattttatatacaacgggcatgattgggacatgatcgccataccaacacaaactagccgggcgctcgcattgttctaaccctcggcgcaagtcggcgaccattcgatcagcgttacgcatatggcgcaggtagatcgtcaaatcgtcgcaaccaggtggcggcggcacggaatacaactcgttgatatcggaaggcgccacgcgctcaagatgtagtggtccatgattttccatagtgatggcaaaaatgaataccggctcccgagcctttgtcagcacatccatgatctttgcagtcacggcagcgtcgctaatataagggccatagcgctgcatcctgtcaaaggtacgtatgtccataaattcgtcaaaatccaggcgcggatacactcgattgcgccgataaaaacttgccggataaggatgtatacaaattgtgcgataacccaaacatttcagatatgctgccagtgatgacacatcactggcagccgcaatcgctcgataagggttaaaacgatgaacgcccagcttgtcatcgccaattccggaaagaaaggcaaactcggtacgtaccgtattggctccccaggcgggaaccttcaattttccataggccacagcatcacccttaaggcgatcaaattcggcaagcattccagaaaaaattcccggataaagtggcctcggatcaaagaaagattcgctctgaactgctaccagatgcggcaagtcattatcggattttctgtgcacatgaaaaccaaaaggagataccgcagccaaaggtgcgcgctcctcttcagcataacgccaaagacttgccagcagacccagtgcacagacatcccactccggatcaaagctgaccggaagtttcttctgccttcccgccagcaagagcaacaagccaagaaaaaaaattacaacaattgcccccaattgcccggacaacatccatcgctgagccggggttgattcaccccagaatccgatagccacggccagaacaaaaccagtagctgaaccgagaaacttgccccagcccagaaacgggatatagagacgcgggtgacgaatcgcatcagtgaaatattcgtaatcctggaaaacaaaaggctcatacagtgcattgaccttggcattgttcaccagtaccagcatcagcaggaatgccgataccaccgccgctgaaaaccaggggcgccccagcagcaaaactatcagagcataagccaataaccacaagccgccatgtaatgcccaggcagcccagtgccgccgcaatggcggacggggtatcatgaattgttctatccccaccgacaacatcaggcccgtcagcaaagccgctaatatcgaaataaattccgactcaggcaccatagcccagccagcgtacaattcggtgcgataacgctgccggcagcacggccagccaccaggtaccccagttcaatggaaatgggaagctgatgcgtgcctggtcacgcgccagcccacgctgaattgccaaagccgcctgctgtggtgaccatacccagggtttaggccccggcatggcatcgcacatggaggattccacatacccgggcataatgacattgatatgaatgccctcgggggacaaccagccacgcaacgcttctccataagccttgatgcccgccttactggcgctgtaggcagggatcatgggcaacccgaaatatcccgccaaggagctcatgaacgcaatctgacccgtaccacgctcccgcatcgcaggtagaacagattgggcaatcagcatggatgctttcagattcacatctagcaaagcttccacctcaccccaaggttcgggctcgccttggctgccaacatgcgtattcatgccggcattaatgatcaccacatccagcgcacccagattcttcagccaatcatgcaaagctgacaaatcacacaaatccagtgattgcgtaatcacctgggcaccacatgcggcgcaatcagctgcaacctgaatcagacgatcctgtcggcggccgtgcagatacaaaataacaccagggcgagcataggtctgtgccagagcagctccaattgcactggtcgctcccgtaatcaatacccgtttatcacactgctccaggttaattgttctcctgaattcctgcggcatctctgtatcatttttaatctcagtcatttatttgattgaacgttcttcttgccaaaaaccaaccagcatcatgccaaaacccagacaagccgtcacgctgatcggaatcagaaagtaatttgccttctggattgccacccacaaagttattgcagaataaccaaatgaaaatccatctcccatccacaaaattttatggacgggtggtctgataacactttttttgcttccccccttgggtgtgcgatgaaaatcaccatgcactccaaacaacgcacgcattccaccagcaaagtaataccacgccatgggcaaaaacatagcaacgtaaagataggtttcccacaaggtacgcaaaataccccgttgttccccaatgcgagctcccttacgtgcggcaaatacattattcaacccccatatcgccacaaaaccaaaaaaaagccaagctacccaatggattcccaatccttcaaaatcaaccagataactcagtggcaaacacaacagcaacaatacataaatggacgccagcaacagcgatgaaaacatcatagcgatcgcatgcaaacgctgcatcaatggcatacgttgccggaacatctgtcgcacatgcttgaaagcgctgtgaatcaatcccctgccccagcgttcccgctgaacccggaaggcactggtcgtttcaggtaacaccgacattgacaccacgtcacgcacataagcatatttccagtttccaaactgagcccgatagcctaaatccacatcctcggtcactgttgatgcattccatcctcccagagattcaacacaggctctgcgccacacacaggaactgccggaaagagaagccatgtctccatcttcgctcaagcccaccgtaacatactgctggtgccccatctccatggcctgaaagcgggtcagaaaagaaacgtcacgattttcataaccgatcccggtttgcaaaaaccccaactgtggatcctggaagtaaggaataatcctgagcaaaaaatcttccggcggcacaaaatccgcatcaaaaatcacgtaaaactcgccggaagactggcgaataccattcagcagattgcctgccttgtagccctcattgctcgcgcgccggatgtaacgaatcgaaactccctgatctgcatggtagtcaatccgtgcctgggcaagcgctgaagtattatctgttgaatcatccaacaccagaatttcaagagaggaaattggatattgcagccgacaaactgcatcaatcagacgcaccaccactgctgcttcattgtagataggcagcaacacgctgacctgcggccagacaggcaacgcctgcataccaggtaattgggaagccagctccgtcagtttgtgacgttcaacacggcgcgatatccccagtacacgcaattccagcagtacgtacaaaataaaacaaagtaccaccagaaagaaaacagcctgggttgcataggaaagtacagtcagcatcagcatcctaaaacttcacgatactgccaagctcgcccaaccgatgcgcccaggtatgatgtttgcgtacatagcgtgcacctgcttcggcacgcgccatgtcatctaccgacgggccatggcgcagacgtgtaaacagctcacatgcctgttccagcgtactgactacatgacaaaaatcgcgaaaataccgatcaatcgaccgactggggttggtgactgcaattccgccgcaggccagaatctccagcaggcggcgcgacaccatggtatctgaaccggttactgaattcacatttagcgagatcacatggcttttataaacacgagctgtctcactatgaatcacatgaggatgcagctccagatgtttataccttggaaaacggaattccataaaacttgataaccggccatgattacgatcgaatatatgcatcttcatcccggattgctctgttgcaccgaacatcatgtcaagaaaacggcggcgctcattcaggatacgacggtaataactacccataaaacacgctgtatgatgattaaaatgaaaaccatcgaaggcatggaggcgtggctgatacggcatcatcagtacatttacgggtactcccgccggcaatgcacggcgatagcgcgcaaggcatgcttcatctgttgtaaacacaaaatcaaacgcactggccacatggatgaaggcatcgaagaaagcaccatcatccttgttccagaataccgtagggataccccgggaacgggcatgttccaccagtttaaaaatggcttgtggctgtttcaatcgcaaccaacgcggctgctttgccaactcataacgccagctacccttcgcaccatgaaaggcggattctacaaacaccagatcaggctgccaggtatcaagtatttcccgataatttgatggtgtcagactcataacccggcattccacggagagacagtctgtcgtgaaatgatctgctaccagcgcaatcttgagttttgcgaaaggcccctccagttcagcatcctctggcgccaccggatgattgtaataaagcgaaccaatcccgcgaatgacacggccaatcatgacgcttcaatcctgaagttattcaacaacaatcacctcggtagcgatgcaacaataggaggcataaatctctcccagttgcgctgcgatacagcgtagtcacgcgctcgcacacccaattttttcaagtgatccggccgggccaaggcttcatggatcactcgcgccaaatcttttacatcacccgatcggaaaaaccaacccgtcagatcagcccccatttcatcccgaaataccggcaaatccggcacaatcaccggtttacccatggccagcgcttccaccaacttgatcggtggcacgatttcacacacctcgtaaggtttgcgcgggatacagaccaaggcacagcgggcaatcatctcccttactttatcgggtgacatacgaccaagaaattgcacctgctgtctcagtcccaagcgttgcgccagcacttccagatcctggcgcgcctcaccatcgccagcgatgcgcacctggatcgctctgccctgtttcagcagatcggctgtggcttccagcaagatatccaggccctcatagccgatcaacgaaccagcataaccaatcgtatccggctccaccaataccggatcagccatctgaaatctttttggatctacgcaattaggcaacaacctgattcgccccggtgaaacatcccagtttttctgaacatagtggccaagttgctctgaaataacaaaaagctgatccgcatgacaggccaccagctcctccagtgccaatccctgccgataagcctgcgagcccttaaaatcaggttggcgtgatatacgagtcagctcccacaatccgcgcatttcgtagtgaaagggaatacccaattgccgggcagccagtaatgccggcaaagcactgacatgattggaggcagcatgaatcacagccacccgatgctgcctggccagttttaccactgtttttgcaccttgcagagcgtacagcagcacgggtcgattattcgcgggggttgttgcatggccataacgtatatcgtctatcactatctcattgcccatcgcatcacacagacgatccttacgatcccacggataacctggccttgtgtatgcatggacccgaacaccaacatcacgcagcgcacgcatcacctcgtgggtacgggtggtataaccgctgatgtgataaggcctggcactggcagcaacatacaatagactaccttgctccgctgcataattcggccgggctgccgccgcatgtaaccgccaaccaagggagcgacaagttacttgccgactgaatgccaaccagggctcaacaacacaggattgcaacaaatttggcatcatgcctaaccagctttcttttttacagatagcggcggcagccattctgccaaagacaaatccacctcatcaggtgtcgtgattatcccacgcgcatacaaatccagaaagtctgccgtagtgataatttcgtagtccttactcaatcgtttcaatagtttgcggtacccttcaatgcgcgcatcatccttgtacaccccgtgaccattttcatcccaatacaataaagaccaggaatgtaatagcaacacagcaaaatccgggttattactgaacatattgaacaataaccgcccccaccaagggctgaaatgaaaatagctggattcggggtacgtcaagcgcgcccaccactgatccttgcccaccttagggaaaatggccttctccgtcatgggaatttcaatcacaccattggaccaggcaaatggctgattggtcggcacgctatacacacactgtccagcacgtacagcacacatggagttattaaaggacaacgggatacccgccgagtgtaaggcgcggattgcatgagcattccagcgaaaagaaccagcccggtgagccagtacaggcttgctggtaatcttggaaatcagccccccaaaatgctgtatcacgaattccgcgcgtgcatcatcccggtactgattcatgtactggggtttgctgtcatagccatactcatcccagaaactcttgggcaagtattccggatgcgtatgcagctgcacatcctgccccatcgcatccagccaacgaaccacctccagagtttcgcccagataggaataggccccacacaaatctacgaaatagatatgtttagcaccgaattcatcaccgatggccgccatttcacggatccctgccgtaccattctcatgctcaccccacatcaaccgtttgacgtgatcctgcgaagctcgcctgggaagagcctccgtatccaccgtcaacatcaaatagcgatttttaccaagcattcattatccaaaattcaaatgtagtatttcctgccattcctgcggattcaataaccccgcagctactggtactactaaagcatcccgataccgccaggccaggtgacggtgttttctttcccgataagatgctccttcaccactcagttctgagaggtattccaccagccaccccaagcgtgaataaaaagcaaaatcggttacatctgtcactaatactggcgacaaatcttcacgccccgtcagcaagtgctgaaacccattgcaatactcgcgtatttgctgaggatcagcgccctcggcccatatcaacaaagtccgggcatctgacaaatcgcctgtatgtttcaaatccgtacgccaccgctgccgaagatagtaagaacggctcaatcccgatacgcgcagcaatcgccccattcgctggctaaatcgccggtgccacaccggggaaggattttgtggcaatagttcgtagcgcaccagtaatgcccattccgggttatcagccagctccgccaactggcgtctcaatctccgggtttcttcaatgagcgcatacataatcttaacgattcgccaatgcaagaatcgtatccgccgcgagtgcagcaccattcattggaaccaagcacttgcgatctatatgcatacctgccagttgcagcagctccctaacggaagcctccctctcactttcgtttccacacctggaaacaataataggtgcatgcctggccaccaaatacgcacgccgattctgatcatccagcttcgtatctgtattcggcaccaacagtgcaggtacttgagcctgaacaatctcgcagcacgtgttataacccgatgccccgataaacacatcgaaagcgcgtaaatagcgaaccagaggatatgctgaaaccggccgcacaccctccggcagtacaacatccttaaccgatatgggattattcacccaaataacttcaaaacccgcattctgtaactgctgtatcaaaccgaccccaacaccttcaacatcgttgatgttaccggcacccagggaaaataaggcgtagcgtccattctcgcttaaccccatggcttctctggcctgcactttatccagcagctcatcatcttttaatacacaaactggcgggacacgcacttgtggacagccaaaatcaccatcctcaaaaccgaattcatcacccacctcgcccggccgaataatcatgctaaacatgtctggatacaaaaatggcttaatcttatcggcctgatgtagcccccgatacgaccagataatttttgctttaccgtattctctacaagcgtgaataaatccctgatagggccaagtaccatcaaaaacaacagctgctggacgaacacgctccagcatcaggccaaggcgaagacacagctcacgattccattctgacgaacttgcacgagaccaattgtgtgaaacaaaataatctgctttgaatcccatctcttcgatgatttcaatagcagaactcaaagaaaagaaaacaggacaaacctgttcacgcaactggcgagcataggcgagacaacggttcaaatgccccataccggaaccgttcacattaaaaaaaagaatgcggggcagaaaagctgatccagatttatccatccgccacttcaccgcaattcatgcatgaagcactcaatttttcttgatcagacaatcttccagtttgccgccactggccatatattccttcaaccactttggcctggcgccaccaccccaggtttgatctggatcattcggattggcatacctcggctgacgttttttgctactacccgacaagcccaattcattcacggtaaaaccgtaaatctgaatagcccgtttgatttctttaagcacctctttacgcttattttcgagcagctcccttttcctagcttgcagcgctgcaatctgttcatcaataccctgaacttcctccagattattcatttgacttccatcactttactccatcatcatatcggcacaaaaacactactacagataagatctgaaagaaatgttcttttgcctaccctcataccaaccagtccagccatcctgaactgcctcactaccattcttagaacctgttcaagatctcgatcaagggatgcagtgcaaggcaaaattgaacgagaaagcggagcatacttgaagtatgtgagcattctaagttcaatttcaacgccgtaatgcgcccttcagtgagatattgaacaggttcttatatcgaaaagcttcaaaaatcagcttatatcaagattgtattcgcagcatatcgagatttagcctttgtatcagcagaaacttgctgcgctacgtccgcagtcacaaaggtgacgaagatgggctgcttcagcgctgaagattttacaaaataacgccacggtaacccaaaaaatgctcaccttactaattaatatatctggaagacatcagggcctgttgagattcacctggagttgatgacagcggataccagataaatggctgatgagaagctgcggtcgatcttgtcgctgcgcaaagcaatacgcttgaactctttgcgttttccaaagaaattttctatgaaatagcgccatttgcacatctccggatcaatggcgagaggatttttgcgtcgactcatctgagagatcaccacgcgacagtctcgctgctgtaacgtttgaatcaaccagttttgcatcaaacgttttgtctgctggcaaggcgtcagaatctacaccagtgatcagctccttgacgcctttgatgtcatggcgctgacctggtattgaattttctgcgacgaaaacagggaaacgaatccgtgtattcatgaactggataaataacctgcaatactgacgctatttcatactttgactattccgtccataccttattctcacttacgccagtttaaaaattattaaacccatctgcgttgtcacgtctgtttttaaaattgatcagccttttcgaggttcatattgaaatacgattcagcaactggttggcctcgaagttatttatggaaaacattatggcactttatatgactcaacctatggcctcccccaataccataaaaattacgtactatcgaaagcaaagccaacctcatccgagtcacgaagaatcaggggctttcactgcagctgccaaatcaaattatgcaacgtttaatcacattcctgagaacgacgtcgaagaaggtatctacaaaagctcgcagggtgttcctactggaggaaaaacttacgagatttaaggaggggattaggtaacgatgatctccaaattacgtatggacgtgtaccaactatcatggcgcattgttttagcatcacatggcaaataaatatctagtattttaaggaaaataaattatggcagcaattacaaaggcattaattggtgaagatgcgagcggggctctgagagatgagtgttcagctcatcttgattctcttatggctcttggacaggccaaatctcagtactatgcagaaaaaatcaatacgaatctactaggtgcggggcaagggactgatagaacattccctatctcatctatacaatccttcgtttaccagacaaaagcctacacgtcagataacgcacaaaacatcagcagtgttgttaatgactccattaaaggctttgtatcgggagacactacatcagccgttactacaatggtatctggctttgttgatattttatttggttcagctgagggttcagaaagtgagattttaagatactgtgcgattcttgaaggcgtgtctatgattcgccttgattttgctggctggtcgcgttcagttacatccaagcaattgaaaagtaaatgcgataaggtaagtgcttttgtactctacagatcaatcgtggatatgaaaaaggtatctctgaatgatttcatatcagtatatcaactcacggtaaaggcagagaacaaggatcttgacgcggctggtgtgttaaaaaaatgtcaagaattatactacctatttaacccacaagataagcctgcaaatatgcttaaagcatcgatccctcctttgagggaggagacgtttcaaccatcaataggacatgaatcactagacgttttcagaaagcagctagttacattatagggcacctcgaataacccgaggttttcagtaaatcttgccgcgaaatgatgaccacgaccaaattcggttctagtttcatgataaatcgccgcttttcccggtgatgttgcactgtttttatcccgaatcgtcctggatattggcgattcggcccatttcgggtatcaaagtgccttgattcctgtctccccaattcagattgtagcaagtcgccaccatcgtcatcgctgctgtgctgcttgggcgtcggcaccagcgtgggcgtcgatgatctgactgccgcgcgcgatgaaacccctgctggagaagctgcgcggagacgccgtcgaacaaggcgctatgtgattttatcgacaggagaagaacgggtttcaggacagcgtaattttaccaagtcgaccaagatagggcgagtcgagatttttcgaggcgcccaataatctatatttgtgtttgctacatcagcataaagaacttacaagaaatactataaacgacattttcattatatttctttcggtggaaaaataggacagtaacttttttactctcaatattttttaaacccgtgatgtgatttcaatagacaactgcacgaaatgtcagaattcagtaacactaattaccgttattagattattctaccgctcgccagacaattgatttccgaagctacatctagttatctcgtgtgtaagtgcagcatctcagacttatagatgatacttattaaaagtgtatgcctatcacgtaaaagcaatctgcgcaaccgactaaatatccttctttacgcggctattcatcaatgtaatatttttatattgattcactatatatctctgcgtttggctaattttagctactttgaaacctatttaaataacataaaaaagagcttataaatgatttcaagtaactggatcaaaggtgttttattaataatatgtacattctcattatcttcaacagtaatcctcgccgcaaaaaatcatccaaaaccattaccgacatatcagtatctcgatgtttacaacaattatctgcaacctatagcaaccgcaatagattatcactccgggttgatttatctctttaactacgataaagacaagctgattaccgtcgaaccaacaagtctcttcgggtggccaggaaatgttccattacagcatacgcttgtatttccagaaggtgataagattttaatcacaactgataacacagcagaacattctgcttacattgtcatactgaaagtaaaagatattaactgggatgcaggaacgactttacttgaagtagaagctacaatagctgtagataatccaggaacaccagcagagtttccgtttgttgaacctgtcaacaatgtccaaaatatccctcactggttggtagggaggggaacaacacagatacatggccccacaattctaccttactcagattttgtttatctaactgaacttacttcagatagagtgcgtgtcttcaaccataaaacaaatgaacttgtaagtggcgtggatcctattgtcatccctgattatacggaacaaacgcacggcatcatgtttaataaatcaggaacaattggtcttggaactggctatttctttgataacagtcttatcgacgtctataaacccaatagacaaacaggggagctgcaaacgataggacagatcaagctgggtgatgaagaacggcacgcggcatttacccactttgtatactggctggatgaacgatatgctgtgactgcttctatgcagcttgataagacctcacttacttctgttaatactaagcagattatcccccccagcgtgtggttacttgatacattagagggcaccgcaaagaagattattgatcatgctaataatgtaaatgggtcgggcattttccgttctccttctgatcttgcggtagtcaatggcaaactctatgttgcagaagaagattcacttgattacacgtttgccaatgatggatatatttctgtatttgatctaactgatcgtaacaagccacgattcctgaaaagacttaaacctggccgggagctacccaacggatatgcagtagctcacacaatcagcccgacaccggataatcgttttctgatagtcgcaagctgggtttcaggttatgtactcaaaatagatacagagacagatactgttgtcaaagcttggggaccgaatgatggcctaaccaaaccgcatggtatttgtactgccggtggtcttcgatagctgtagtaaagaaaactgattcatcttcttttatccaaaaacttatcagataaaaattaggatgaatcagtttaaaaataagtactgaatgcaaaacaattattaaggatgactaatgaaaaaaatagatggaatgaaattgagggcctttcggaactactattttcaagttattactatcttattccttactcttgtacaagctgatatcagagcagcaactattacattatcccgtccaataacattacagccagaaacaatcattcacctcgaacaagctagtacaactggtaccagtcagtggaagctcgttgtcttcggatttactcactgcaaagatgtctgcccgatgtcacttgttaatttatccatgatggttaaaacagcaattagtgaacagattgatatcaatggaatttttgtcacggttgatccggatagagacacagaagcaatcttgtccaattatacgaaaagctttggcaccgacatttcctatttacgttttgaaggagaagaactggagcgtttcaaaaacgcctttcaggtagaggctatcttttatacaaagaatgtgggtaaccaaacccattatcaggttgatcacagtaccacagcctttctggtcgatccagcaggaagaattagagtaatttttgatgctttaaaagatgccagagatatggcaagaatttttcatgaagacaaaaaattattcaaatcatgaataggatgatattagttgtaatcctattcatggcaacaaaatctgtttttagcatgacaatagatcctgatccccgaataattgtctcttttatggacaaaaccatttctcccgaattggacatattacgggtaatggcaggtatttcatctgataacaatcatctcatattcgaagttaaaacgagaggggagcgcttgcagggaagcaagcgtgattatctacttctacacattacacatggaaaaacgtatgtacttcttttacctatcaacaaagaaaaagagaatcaggtgatagtatatgaacgcttatctcaatccaatggcgattatcatgcttcccccatcctgggcagattcattagaaattcatccttgatgaattttaatatcatacctatttcccaaggaggagaatttagtataccgctcgattggatcgattttaatacaaatctcagtttcgacgcttatacagttcaggcaaaggtcaaagggaatactctggaaattgacaaggtatatgattgggcaagaaagggaagaacacatattaataaagaatcactttctgctattacattgctcaataaaatctgcactcccacaagtaacaagcagaggttctagttcttacgaaaaagaagaataccaaagaactgataggaagaaaacagaactgattgacatcctcccgcgcctaaaaggtggaggattcctacggcgctcaggcgcagcattgagctgcttcggcgggttcctgctgctggtgaggtgaccttgttgcatcgctcacttcacagacgaaccgggcgtgtcccgccattaaaatattgatcgcaccgaccacatcggtgtttccctcgaaactgcattccatgcactcaaactgcacttgcatctggcggttgtccgccgacacatggccgcaagctgggcaggtacgagcaatgagataactgtccggtttcattaaaccacatcatgacgccggcggaagtgactgaccgcaaaggggcattgcaagccctaaaacgctgcaagcagagtctggggcagatccaaagtctgctgtgcgatagagcggctataccagagaaccatttgaggcatgcgagaaattctgggcgaacttgtcacggtgcagattgccaagcgcagtgaactgcacactttagtccccgcagataatcttaattaaatctgtagattaagagcggagtctggaatcgaatgtaaaatcacgaacaatctcaatttctacttcttttatcgctggatgatttgggttgatcactatgtttctggcttccaggatcactgcagagggcacaattaggccaagatattttcctttgcgtaagaacgaatcaccataagctgctgctgttggtgatcctggaagggtattccaatcatctggcaaagcatcgagtggcgaagttttatagaaattattgtcatcaggtagagttattctgacgaccatgagatttaatggaagaatcgatcctgtatgtactagcttttctagtgctgcaatttccagcgagagccctgcataaattgtaggtataccagcactattccaacgttgcccttttatgctagctccgtatccggcacggtcgagagcaaattctttcctggaaatcctccaggcaaacactaagcaacaccgccataagcaatggaagccaaaactttcctgacttcatcggcgcccatatccgtgtcaagtaatgatagaggggattcgcctaaagccagattaaattcgagcatccagcgtcttgccagatctgatgaatcaaaaacctttcctgcttcagcctcaatgagtgcaattcgtgccaatctttcggattccaaaggaccaagctttccacccgatttaatctttcgggtaatagtcgcatcagagatgccaattaattttgaaagctttgcttgagatatattgtagtagcaacccgcttcaactaaatggactacttttactccgcctcgtaccatttcaattctctttgccggagacatcttccggatcatcgctccccattcctggaaagaatgtccggttggctctttcttttgtttggcttgctttaattcaatgcccattatttaataccatcaaatgaataaaattttataatcatttgaccataatcttgatagagattcaagcaagcggccccgttgcaaatgttcttaacgtgcaaagccacccttatctgcgaacacagtcatccggctaaagccataaactgcttacaaactacgggcaacagggatcgccttctttggcaactgtttgatgagctggtagctcatttcagctcccgggcaaattagaccactacagattggtagatacttgagcgatgacaatccaccattgggctcatacggaattcttcttgttacgcgcgagccctgcctgcacagcggtgatcgcgacagtatttacgatatcctcgaccgtggcaccacgcgagagatcattcacgggacggttcaggccctgcagcacagggccgaccgcaatggcaccggccgagcgttgcacagccttataggtattattgcccgtattcaggtcggggaagatgaaaacggtggcgcgaccagcaacaggtgatccaggcagtttcgcagccccgatcactgggtcgctcgctgcatcgtattgaatcggaccgtcgacaagcaacgtgggctggcgctcgcgaacgagctgagtggcccggcgcaccaaatcgacctcggcgccgctgcccgacccacccgtcgaatacgagagcatcgcaatgcgaggctcgaccccgaactgggcggctgtctcggccgatgagatcgcaatgtcggcgagctgctcggcgttcggattgggattcaccgcgcagtcaccataaacgagcacccgatcctcaagcaacatgaagaagacgcttgacacaactgagacgccagggcgcgcgcggatgatctcgaagcttggcttgattgtgtgagcggtggtgtgcgcgacacccgagaccataccgtcggcgaggccaaagtgcaccatcatcgtgccaaagtagctgacatcggtgacccggtgacgggcctcctcaatcttgacgcccttatgcgcgcgcaaccgcgtgtactcttcggcgaactgctcgcataacggcgactctgctggatcaatgacatcggcacgatcgaggtcaagccccaactcggctgcacgctgccttaccgaagcgggctggccaagaatcgtgagtcgcaccacaccgcgcaaaagtagcgtgctcgcagcacgcaggatccggtcgtcactgccctccggcagcacaatatgcgactgaaatgtcgctgctcgctcgaacaactcgtacgcaaacatgagtggggtgacgacgccaccagtgtgcaccttcagccgcgagcgcaggtcaaacacatcgacgtgctcccggaacagagcaaggactgtatcgattttgcgacgcgagtcgggcgtcagaacaccgcgggcgcggacaatgcgttgcgccgtgtcgaacgtgccaagggaagtgcgaatgatgggcaaccgcgaatcaatgccatcgagcaatcgctcgatatcgggtgagagcgcgaagtcgccattgagcaccaccgccgcaagggttggaaaagttacagcctcgtgcgccattacaacagcaagcagagtctcggcccggtcggcagcaaccacgatggctgcgccctcgatgagtcgcggcagcacgtgctccatcgccataccagcaataacaaggccgggcacctcgcgactcagcagttcctcgctaccgcgcaccaaagttccctcgaccgcctcaagcactgacgcaaccgttggagccacaagcaacacctcctccgggatcgcccagaccggggtcattggcggcaacacaacggcgaccgcgctgcgaatgtcatcaagcgcgtcaggatccgcccgattgaccagggtggcaagcagtgagacgtgcgcagcctggagctgctgcagactcagttgagcaagctgcgcgagctctgcggcagtccgcgccgcagactggccgaggatctcggggccgctctgggacgagcgcccgcccagcacgagcagcaccggtgagtcgaggtgcgctgcaacccgcgcgttgaaggcaagctcgctcggcgctgcaacgtcgctgaagtcagaccccacaataatgactgcatcacattgcgcttcgagcgctttgaatcgagccacgatttgcaccatggcagcatccgggtcgtgcgcggcgtcttcataggtcacgccaacgcatgcttcataggggatcgtgccgcccgcgcgctcgcgcaacagctcaagcacacgatctcgttggctgccggagcgaataagcggccgaaagatccccacagaagggatatccgcgagaagagcatcgagtagtccaagtgctacggcactcttaccggtgcacccctcggcagacgtcaggtacaaactcttggccacgacgctagtttagtgatgggcgagcatttctcccgctacggctgcgtgacctttgccattcctgccgtatggccatgcacggggatgctttgactgatcctatggcattgcattcgatacatggaatctgcatcagtccgccgatcggatcgcacaggtacaagacggacaaatgccccgcctccataacatctgccgccattcaaataccattgcgccctttgataattattaataaaccaagatatatcattccgggccgtggcctgagtacagccaagctcggctatgaatagaataacttatgcagttcccaaacgcgcctattcaccgatttttcactcctgcgctggctccatcgtgacactatagctgccatgacgtgcggcaccgttgagtttggcacgcagatagagtgccgcctgagtacttgcggcattacctgcattgcctttccaggcctgtaaggcaggctgctgcaatgcacggccgtacgagaaactcaagtcccagggttgcggtgccagacaattcatggcattgagattggcagttgcctcctccggagtcagcccaccagacagaaaattgatgctggggacggccgccggcacggtgcgccgcagtaccctgatcgtctgctcagccacctcttccgggctggccttctgggcgtgcgttttacccgggattaccatgttgggcttcagcagcatatgctccaaaattacgtgatagcggtgtaatgcatgaaatacttcatgcagcaccgcttcggtgacttcagcgcatcggccgatgctgtgatcgccatcgatgagcacttcgggttcaacgatgggcacaatgcccagcgtctgacagatagcggcataccgcgccaagacctcggcattggcctcgatggccaaccggctcggggtggttgtggagatgtggtacacatcacgccatttggcgaatcgtgcgccctgctgcttgtagctctccagacgcagtgccagaccatccagaccttcggtgatttcatccccaggcgcattggccaacgcgagtttacccttatcaaccttgatgcccggcacaatgccttgttgcgcggtgagcaccggcaacggagtaccgtcatccgctttttgcccgagggtttcctcaaacaagataacaccgctgacaaattcaccgagacccggtgttgccagtaacatgctgcggtaactgcggcgattttcctcggttgattccaccccgattggtttgaagcgtttcgcgatcgtcgggctgctttcatccatggccaggatacctttgccctgctgtactaacgcctcgacggttgcctgcaactgattttgaatattcatgagcatcctctttgcggcttaaacatcaaaccggatctttggtgggaactactttaagagcccggacgggtgagagacataagaaaagtaaattctcttttccatgaattttaaatttattgaaagccagctccgttgtcaactgctatgataattgatcgaaagatgccgataccccagtctgtttagtacaaaaaataaagcttttgacgtcttttggcgcttcagtcgcaggacacctgggggtaaaggtcaacccagagatgaaaggaatgcgcgcactgtagccgccccccttcgggatcactaacattcccgcaataatcatgattattgcgccccagcgctaccacctgtcccagcacagccaagctacgctgcaactcccagcccacctgaccggattggcctaatagcaagatcttcatgtgtaccctttttgtttttatcttcgcaaatgactggaagcccaaagcccttaaacaagttgagaaaatcaaaacaactgctatgcgccagaagatatttacagaggctcaagcattggctgattttcaaactgccaaggggtgaagaaacttactcatcacgaatacagctatcggctgagggtaggtaactaccgggtgtgcttcgagttcgacggcagcattcatgttattgatattgaagaggtgaaaaaacgcaatgagcgcacttattaactaccaaaccattctggatagcagtagaaatctggcttttatggtcgtgccttatgatgaatttattaagctgcctggtgtagtaagaccaggcatgatccccaatgaagttgttgggaaacgcatcatgaatgaggtcaccatgctgcaagcctggcgtgaatacctgatgctgacccaggaagaaatggccaaacgcatgggcatcacgcaagcaggttacgcacagatcgaagctgccaagcgtccgcgcaagccaacgcttgaaaaggctgcgacggcgatgggtatcactctcgaacaattggcgtactaaaatttgaggaaaaaatggtgaaaatgggaagaaatgggggtagaccatagttttcatggaatatccggcagtcaaacacggacggcgaagtcgccaggatgacgggcagagttatcgccgctcgcttgatcctgatgggtatctggctcaattcgtcgcagccatgattggaagaaacgggcgtgatcggctactgcaaacgaagaacaggtttcaaaaccggcgactcacgtcgccatggattcctttactcgcttggccccggacggctaatgggtagcccctattttccatgctgttatatgtttacattgtaaatacaaatgataaaatatttgcaatgaacatttattacgagctgaatggcgatttgttcgtttggaacgcaggcaaggcagaaaaaaacctgcacaagcatggcgtccgtttcgaggaagcggctacggttttctccgatccattgtttatattgactaatgcttcccgtaacgatgaagcacgcgatgccgttattggttttgatgtgaccggccgcttgctctatgtggttcatattgagattgaagaatcttgtatccgtattatttccgcccgccgcgctgaacctgaggaggaactcaactatgctctctgaacgcttaaaaaaacgcctgcaaaaggatcgcccaatgacatcgatcacattgcgcatcccgattgatgtcgtggaatccctaaaggaaattgctccgcataaaggtttctccggataccagacattactgaagtcatacattagtgaaggattacgtaaagatgaagaacggtattccggcatatcaacagtacggctgatcgaagcgttaaaaaaacgcggcgtatctgatgctgtaatcgaagaagccacgcgggatctgatagactgactattttcacgagaatggggatacaaaccacggttttcatggaatattcggcaaggtcaaacacgggcggcgcgacatgcgacataactgctttgtcaggataaagctgtcgcccatcagaaaccgtgtagagtagaggacaggtacatatagtatttggttttgcattaccgtttccgccattttcatctggcggagtctcccgtactgcacggtatattctccacaacatgccacccccaccccgggaatcgttgacgccacttccgttattccagcgacaaccaccggcccttccctttcagaccagaaagtcggcttctccattcaggattacgaggccacctccaggttcgcgtgcgcggcgacctgctgcttcgcccatgggaaactgacgacattcaattactcaaacgccgcttcccggtgctaaaaaggcgtacggacaactcctttcacggaacttcaacccgctggatataccaccgttcacggcgaacagcccgtcccctattttcctgctttaagccgtatctttaatgtttatttccactctcaaaccgatactcgcaatcatatctatcagtgattcgagagaaaacagatcaacacgaaagctcaatagaattgatgttctatttaatcgaacaaaggggaaaagaagaataaaaaagaatagtgatcaagtgcgcgaaggattcaagcacagcgatgaccaaaccgacgcctgttacctcgcccacttgttacggctgggaatactgccgaccggaaccattctgccaccaaaacaacgcgccatgcgcgatctgaccaggaagcgcatgcagttggtgcgtaatcgcactacgcacattctcgctattgagaacatcgccacccgccaataggatgcccagtccagcagcaatcaggtcaggcgattgattgacaggagacagcaccgatcagatgccgctcggcgtgtttccacgttctcaaggagcgcaaactatttgatataacacgctgtttcgcatgagttttgaccgggtactttgtgaatgacaggttttagagctatcagacaatccaattttccaaacgtaaaccgtctactcgttcaaactcgcgcaggttattgctgaccagtacaaaaccttcgctgcgggcatgagcggcaatgtgcaagtcattcacaccaataggcattccttttcgttccagatcagcacgaatatctccataatgcccagctgctttacgggtatatggcagcacatccagacgggacaaaaaatcagccacctgtcgcaggttatgctcacgttgctggcttttttctgcgtcatgcagcagctcggcttcggtaatagtgctcacgcacatcatgtccgcaagcgattaaaggtggccagtacctcctttggtcgacgtttgataacgtagatagcaatgttcgtatccagcatatatttaagcattagaatgcctcgcgctcttgctgctcctgactggcacgttcagataaagaatcttccgaaacaccctgttcagctagaaaaaaactgtcccaggtatggtcaaccggggtcaagattcgctctttacccagcttacgtacccagacttttttcacatcatcggcaaaacgcacatccaccggtaaacgtacagcctgagtacgattattttcaaaaacagtacctgtatacatcacaccccccaatcagaatcgccaaatacaagaagtatatagcaacacttactgcatgaacaaccaaggcgatatagccggacatatcagcacaaaatacacgcatgaagtccggcgcccatacctgaccacgatggcattttatatattctctaaataattccgtcctcatgaggccgcatctttgcgaggaagccgcagtcgatgtgacgatccagcactgccataacgataagaaaaatggggaactttgtacatcctgttggcgttgttactggattacctcatgccgcgtgttcgtaaagatagcgaagaaacacacctggcaatcgttgccgcgccagatcaggcgcaacagaacatttggcaacacaagaaacgtgagtggcgcggcatggagatcagaaacagcattaaggtactgaatgtttcgcagaaattatagtatggctccctgtttttctattctaattgcttctgcaaaaacaacctgtgtctgtcctcgcagctgattaggtggagcttctcgtacaacaatttccacatcccgccccaaatggtttaagcacgcgatcatcttggtttcactgataccgcgaaactggccacgtagcaaacctgaaagcttgggctgaggaaaacccaaaatctccgctgcccgttgttgcgtcagatgacgatggcggataatgtcaccgatcttgctggccaaccgagctttaacatacatgacctccgcatcaactaaccgtaaatctgcttatacgttaccgctggcctcttcaatttcaatcattctcgacctctcatacaggtttcaatcgctgtcaaacgtgacttgataaaccccacatccggctttggagttgcaatacctcgtattgatttcttctggaaacagtgcaacacataaacagcttcggcataacgaacggtatagactgcccgataagtatctccctgagaatcctcaactacctccagaacacccgcaccaccaaaacctttcataggtttggcatccggatgcttttgaccgatctgtgccaaatgcaaagcgtaaccaaaaacatcctgtaccagctcgggcatggccatgagatcttttttactggatgcaacctaacaggtcttaattggacgccaggtgccgtcaccgatttgcagcaaaagtggatcgcccgcaacgcgagccagcgaggaattggcgctgaaaaaccggaaactacgggtcaatgataaacccattgggtaatccccccacaaaataatcggatttaaaagtagaattttctccaatcaaattagaggaagttttacatgaagagatcccgctttaccgacagtcagatcatcgccgttcttaaacaagccgaggttggcacgccagtcccagaactctgccgagaacacggcatcagctctgccaccttttacaaatggcgcgccaagtttggcggcatggatgcatcgctcatggctcgcatgaaagagctggaagacgagaaccggcgcttgaagaagatgtacgccgaagagaagctcaaggctgaaatcatcgccgaggccatgcaaaaaaagtggtagcgccatctcaacgcaaagagatggcgcaatgggcagtgcaacaaaaatcggccaatgtgcgcgtggtctgcgaagcgtttagcatcagccagacttgctaccgttaccaggctaggctgtcatccgagaacagcgaaatcgcggactggttgatacgtttgacgaacaaccaacgcaactggggctttggcttgtgtttcctttatctgcgcaatgtgaagggctacggctggaatcacaagcgcgtctaccgtatttatcgcgagctggagctcaatttgcgcatcaaacccaaaaagcgtttagcaagagaaaaaccggagcccctcacggtgcctgagacagtcaacgctgtctggtcaatggatttcatgcatgatcagctatccgacggccgttcgatccggctgttcaatgtgatcgacgacttcaatcgcgaaggattgtgtattgatgtcgacttctcgctgccggcagaacgcgtgattcggtcgctagagcatttttgacttacttgtttacatatccacatgaagcgaagtagttggcacactcctccggagtgaacagatccaacactttgccgatctgtgcccataaggcatccatggttcgtttggcggctttgcgtaatagggctttgagtttggagaacattttctcgattggattcagatcaggcgaatacggcggtaagtagagcagggtggcacctgccgcttcaatggctgcgcggacgcctggaaccttgtgacaagacaggttgtcggccaccacaatgtcacctggctgcagcgttgggcacagacaggtttgaatataggcgagaaacgcggccccgttcattgggccgtcgagcactaacggagcggtgatcgcatcgtgacgcagtcccgcaatgaaggtggtgctcttccagtggccgtggggcaccgaagccacacagcgctggccgcgcggcgcgcgaccccgctgtcgcgtcatgttggtggccgttgccgtctcatccaggaagaccaggtgacggcaatcccaatgctgctactcgcgggcccactcagttcgtgcctgacgtacgtctgtgcgcgattgctcgctggcgtgcagggttttttttaaaactcaacccccatttgttcagttgatgccatagcgccggcaccttgatctgaatgccttctgcagccaaacgttcactgagctcgacaagcgttagatccggcgtggcttctatccattgccgaatctgcgcttccttgtgcgcaatgcgggatcgccgataacctcccatcggcaaactatggcgctggccttcttctttccatcgcttgcgtacctgatacacccacatgcgacccacctcaaagcgccgggcaattgccgttggatcttcgccacgatccaacgcacccagaatgcgatcccgaagatcttgtgaataggcatgcataaccttccccatcagttgtaatagagaatagtctattacatgcatatatttaaatcaaaaatgctctagaccaagtgattgaatggcgcggtgcacccaaggtgattcagtgtgataacggccccgagtacatcagcgccaccaccatggcatgggcgaacaggcgtggcatcaagcttgaatttatccaaccgggcagcccgcaacagaacgcttatgtcgagcgttataaccgcacagtgcgctacgattggctggcgcactacatgtttgattcgatcgatgaagtccaggatttcgccacgcagtggctgtggacttataatcacaaacggccaaacactgccatcggaggcatcaccccgaaacagaaattggtcttggccgcttagctctacttttaaccccggttaaaaacgggggattaccatatcatttcaacaaagagtacaaataatcaatctgatcgatcagtggatagtgatgattgccaacaaaaaaacctgcacgatcgatatactcagcatttttcaaatctgcatggattgtgtagtcaaaccattgcagcacttcatttttggcaaagttccctgcaacgatgggacgcacatcaatctggttagctacaagcttatccatcagtgttaagcggttaatcggtgcatcttccgttaatagtagagaaaaaccaaaccagctgcttcttccaatttccttctgtgtgtttaaccaaggatgcttcgcaaagcgcgaagtaaaatactctgcattatcgcggcgaacggcaatcatacttgctagcttcttcatttgctcttggccaatagcgccgctcatttccagcgggcgcaagttgtagccaggcagaacaaagcggaatgactcctcaaatgcgttatcacttttttcgccacatacccaattatgcttgggtaagttgcgtgtccaaccatgggcacgtaaacataaaagaatgtggtaaagctcctcatcatccgtcacaaccaaaccaccttccatcgtggcaatatgatgactaaaaaaactgctgaatgtacccattaaaccgtgagtgcccgcttgcttgtcgtcaaacactgcacctaatgattcacaattatcttccaataaaataatatcgcgctgaccgatggcttggtggatcacagtgaaattgttaggattacccagcagatttacagctagaatcgccttggtatcatctgtgatagcgtctttcaactgctccagatccaaattcagtgtttgacgatcaatatccacaaatttaagccttaggccatactgctgtaacggataataggtggtactccaggaaacagccggcacaatcacctcatcacctcgcttgagtgcgccttgcttgcggaacatcaacgctgcgatcatagccagattagcagaagaacccgagttaaccatcacggcataacgactacctacccattcggcaaactgcttttcaaatcgggcaacttctttgcccatcgagaacatacctgatttaacaacgcgatcaattgcagtgtattcagcttcatcccaagttataccggcaagggggtattgcattccatttccttaaagttgatttaaatagtattgataagtctttgccagaccctgttctagggtatggccaggctgccaaccccattccgttgctcggcgggtatcgcttaatttgcgctgcatgccagtaggtttggacaaatcatgatgaaaccctccttggtaacccactaccttggcggcaatttcgtagtactggttcacggtataatcgcgccctaacccaatgtttaccagttggggcaagctttcaaaattcgtcagtgcccgcatgacggcatcagccaaatcacctgcgtataaaaattcacgccgcgcctcaccagtgccccaaatttccacgctatccagaccttgctgcttggcttggtgcagcttgtaaataactgcaggaatcatgtgtgaccagcgcggatcaaacttgtcgtacggcccatacaagttacaagggatcaaagtcttgtaatgtaactgtggattctcgcgatggaggtagtcagctaggcgggccaccataattttagccagtgcataaccttcgttcgttggttctaacatacctgtcaacatatcctcctcagacagcgcactctgcttgtcctttggatacatgcacgtgctgccaaaattgatcaggcgtgtgatacctgcttctgccgctgccatcatcacattgcggcccatatctaggttatccacaagaaaacgcacaggctcttgcatattagcctggataccacccacgcgacctgccgcatgaatcacgacatccggatgttgagcctcgaaatactgcctgactgcagtgtagtcaagcagattcagtaccgcactgccaggtgtcagccaaatatattctgaagcggaaggatgactttggatgttgcgcccaaccatgccagaggcacctgtaagcaagattttcataagtgtttgttttagtgttctacactcaccactgcttcataaccattctccttgagcaaagcatgctgacgagcctgatgcagatcatgtgccaccatctctgcacacatttcctgcaccgtaatttcaggcacccaccccaatttagccttggctttggagggatcgcccaataaagcctctacttctgctgggcggaaataacgagggtcaacagcaacaattatgtccccaggtttaagggcaggtgctttatctccctttatagaggttataacagccttctcttctatacctttaccctcaaaacgtaatgtaatccccagttcagccgcagaccattcaataaactggcgtacactgtactgtactccggtagcaattacgaaatcttcaggttgctcttgttgcagcatcatccactgcatgcgcacataatctttggcatgtccccaatcacgtttagcatccagattacccatatacaggcatttgtctaatccctgtgcaatattagccagaccccgtgtaattttccgtgtaacaaaggtttcacctcggcgtggtgattcatggttaaacaatatgccattgcaggcatacataccataagcttctcgataattcacagtaatccagtaagcatacatttttgccactgcatagggactgcgaggatgaaagggggtagtttccttttgaggaatctcttgtaccaagccatatagttcagaagtcgaggcctggtaaaatttagtttttttctctaaaccaagaaaacgaatagcttccaacagacgtagtgtgccaatggcatcgacatcggcagtgtattctggcgcttcaaagctcactgctacgtgactttgagcacccaaattgtatacctcatcgggctgtacctctgccagaatgcgggtaaggttggaagaatctgttagatctccataatgcaatttgaagcgcacattttctatatgtggatcctggtaaatatgatcgatccgctgagtgttgaacagagaggaacggcgcttaataccatgtacttcgtagcctttttccagtaaaaattctgccagataagaaccatcttggcctgtcactccggtgattagggcctttttcatggaatacgctccttgtgaatttaagaattggaatttgattgatagttaatacgggcaaggcatcagatgaacccaatctcccccatatttcactgcccgcttgtaatatattttcgccttgtcagcttcaccaagtttatttttgataacagaggcaatataggagagaaatggcaaattctcttctgcaccacgctcaaaatccttgaaattagcagcataaaaataacgaccaccaccgtatgcggctaccacctcaattattttgggagcaaattttgtgtgcataaaatctgacaatcttttttctgcctctaaaagatgatcttttttgatcaattccgaaactatataaataatatatttggggttctctggatctaaaatagtggccttttccagtattggaaataaatcatccgccactttagtttctagccctagaatataacaatgatggcagtcaaaagcgcgtaacaacgggggaagtttggcatgatcttcatcaatatgatgtcttaaaaaatgatactgctcctcaggagaggacatctgatataccgaagttaatttagcttcacccgcaattatctgagccagtccagaaaacacagaattcccagatgaaaaaatctttttagcagaagacataaacttcatttcaaacaaacttttttgagtattatccatttttaaatcaaatggataataatcagcaacaacctttacgccgtacttatgtttcaggaaatcaaggatactggtttcatcaccaaatagaataatttgttttcctgtatcaacaagatcaccaattaatttctcagccaatccaaacgggagtgctttacgcataaagctttttccatataatcgataccctccatacacaagatcacccgtccgaatatgtaccgcaaaaaagtcttccaaatcatttgctgaacgatcagccgcatttaatactttctcgatattctgattaaactttatcttgttccaagaacgtttcagactaaagtgcaaatcatcaatttcaagatcagaaaatacaatatttaaatcatctagaggagcataccacccccattcattttcaaaattttcacgaatagataagaaattaattttctcgtttctagcttttctcagaaccccctgactactcggcagcagaccctgttttgagtatttctggataaaatcagatgaaaatatatcctgttcattttggattgcatgacccacaatttccgcatcaccaaccttaacaggtttcaaaaaatcgcctgcgtgtgcattcaaggttattggccagatataagcaaactgaaatcctgttttttctgcaagatacaatgcatttaatattgtttttagccttcctcccagcccatcacctctaccagcgacaatcaatcccggatattttcttttaaaaacttccaccttccaaaggtgtaaatatgctcgcccctccatacttattttgatataacgagcttgaataaaagaagacaagggaaagacaattttttcaccccaagccaaaaaacccgcatgaattaattcccatactccatccagatgggtggcatattctactttcaattgataggccttggcttgatgcttaatattttttcgattatagatatgaatttcttcaattggagatatcgcttgcagatcaagcatccaccatggattatcttctttatctgtatgaaaagaaaaatctttaacatccaatatcggatttaagggacgcaagggatcatccggttttgaccatttggaaaatgagctttgtaaagcaagcttgttgtttgatatgttctccaattcaatcagattattttctattttaggaaaatacattatggctactcctcaaccaaggcttgataaatagtttcacaagcatttcctgcaatattggggaagtatttatttttcatattcaatgcttcagtatttatgctagaaatatttctaagctgatcttcaagaagcgctattaactcttgttcgttataagctacttttccgggtaaatctgtcttcaagttgatataagcgccttggtatttttcatacatatcgatatcaaaatgataaaacaatactggctttccaagatagatacaatcccaagcgacactggaataatctgtaacaagaagttttgctctctgcagtaattctcgtatagaaaactcaccaaaatcgataatttttatatactcactttttattttgaatttatctaaatgttcaagaattttaggatgcaagtaaaaatttaatttaatattaaatttattaaggcattcacaaagagcttctgaagttaaaagattcatatagtttttaaaataatcagtctctaagaacttttcttctgacatatcctcaagccaattgcgccatgtaggcatcaggaaaatttcatctgtttctggaaaatcattttgtaaagaatcccaacgaggcaagccagaaattatcagatcatctttttcatagccaaaattatctataataaatttcacttccatgttattggatgcaataaatttatccgcggcaaatgctttatttgtttttttgtagatacgatctatttttttaaaagtaattactccatgttgtaagaatataaattttttatcaagtaaggatgttttatattcgccaaaaatcctccaccatgcgtatccatgccctctattttcagaagagatgattgtttcacatgctaggagaagcttcatgtgttcgatggacataaactcaacaacattctcttcatgaccaattaatttttttctatcgggtgagtttttttctatcacaaaataaacataaggtctctttttgacagcatacaagaaaaaataaaaggcattatcctgagcagtttttgaaaatttctcaaaaattaaccaagacttgcgtgcatccaactcatccttgttctgaagatattccttacgcgcttgttgctctctttctatataaactgaatcgtcatatccggtcactggccttttgagcagtgcaatttttgtacggggagtattgatgtgggggattattatattttcaaaaatactaatcgagtacgcgtaaggattaccctcaactctacccaataagttttgtaaaaatctgatttttttattatgtattctaactataacgtcgccataatttttatcaaaaacctctacatcggcataaatatcccaataatgtaaatctaacttctctattgaaaattcaaaatcaacccatccctcatgagtagaaacaagagtattattttcagcataaatttcagtatcttcattaccaatccgtctgcgatggagcaaaaccaggttttttattctgatatcgccattgattttgcttttatttttaaaatacaaggaaaatataaacttattttcttctgtttttatatcaagaatttcaataaaaaaatcattattaattctatttctaaagcctgcgagaagatccatctccttataagcagaaacagatttttgaaaatcaccctccctcaataaacaatatccgagacgatagttccatgcagctaccggattctgtttatgagaaatggcgttttcataagcttgagcagcctctttccacatttgtagccgttcagcttggttacccagcttataaaatgccgcggcccagtcattactgtacagagctccatcttgaatttgcagggtacgcaaattgtctttcagatcctgtatataacgctccgacaaaccagtttgtacagcaggtgtattggcctgctgtaccatgaacagcacgtccagttcagcttgtgtatgtatatgtaaaaaggcagagcaagcctcttcatactgtccagcttgggatagcacatagcctagccggtagaaccaatagggggtatgcttggcacgggtgataacagcgtattcataggcttcggcagctttttgccattgttgttggcgttccaacacaaagcccaggcgataatgccaatcgacattggttacatccagagctaacgcttgacgataacactgtgtggcttgctcccagcgatagcaacggtcgtgcgccaaaccaaggcaatagtggagttcagcattatgtggctgaatttcaatctcttttgcatacgcttcggcagcttggggccaaaagccacgttgttggtggaatacaccaatacccaaggtctgggctttcaagtcttggtcagcagcaatagcagcgttgtaagcggcttgggcctgtttaccttgatcagcacgctcccatgcccagccttctctaaagtgccacatagcgttcccgggctggatggcattggcctgagcaaaggtttgagcggcttcggaaaaacgattcatcttgtcttgtgcttccccgagttcgaattgccattgagcattgccagcatccagggccagggcttgctgtaatacttccacctcttgccaggtgcagccttgtttgcgaataaccaagatcaagtcattccaaaaaatagcattatgtggcacgagctttattgctttacgcagtggatcttcggcagcagcaaaattaccgatgagcattagaacttttcccaaatgccgtagacaataaggttgctccggtttcagggccaaagctgtttcaaagactgttatagcctctgcatattttttgccatattccagtgataaaccaaggtgataaatccattgtgcattaccaggctgtttttctactgcttgccttagataatattcggctgttttccagtttttgagtttttctgcaatgatgccttggctataggccagtttgcccgctttatcttcggttttggtagccaatcttttgtagatagcggctgccttttcccattgctctttttttttcagttgatgggcctgaaaatataaaaaaaggttcttcatctcttccttatttgttcatccttaaacgaacagttaacctaattccaatcacaattaatttgagtatcaaattatccgatggctaaacctcttgcagatattgcagcagtcagataaacaatctttcaggttgtcaaattaagccatttcttgccccaattccgtattccgagaaattttgaacgaggctgttgatttaacaaatctgatattcctagtgccgcaaaagtagcaatatcgcgtttattcggttccttatcggaaataaaataacgattcaatggtttcaacatttcctgtaaagctgttttaaatggctgaatcagttcaggcgatagcaatttaagtgtgtactgaaaagaacccatacgctttctcagaataacgcccagtgctttttgcatataaggatctactaggtacacttccagttcgcggtgaaattccgtgatgtgcttaaaagctccgtgcccagctcgattatctgtggtagagccttgtcggtaataccggtgatgatagaaatttactggaatctggattgttttctctgcataaaaatgtgaccaaaccgagaaacagaaatcttcagagaaatgggtacgtgggaaataagcaccactacaaagcagaatattcctggtataaatacgattccatatattggaaaaaaacgaactgtccagcactttggcaggttcattttcaggaatcgtaaaatatttctgaaggagtgattcggttctgtctggataatggcgggtaaatccggcagccgtcacaatatcagcgcgcatctgctgcatttcatgcaaggcagacgtatattcccctggtgaaatccaatcatcagcatcaataaaaccgaatttatccgtgcgtatgctcgccaaaccaatattacgcggcacggctggcaagccactcgccttacaaatcgaaatatgatcaatcacttccggatgctgactggcgaaaccggcaattacgccatgtgtatcatccgatgagccatcgtcaatcacaacgagcgttttatcgctgttaatggccagcgcactcataagacagtcggttaaatactggtcgcaattatgcgctgggataatcagggtaagttcctgttcctccggttggcaagatagtgtgtttttttgcatctccattgcaacgggaggtgtaaaaaacggtaataccctacgtaacatcttgccgccgcgcttatcacagtcaatcgtcaacacttcctgcgagtgataacgcgccagccagcgcccctgtgcttcgagtacagctgctgatttttcccgatggttaagaatcgcgtttactgaagaaaaacgggcacagtattttcttaaccatacctcatcatccgcgcaacggatattagcaacgagtagaatttccgttacgtcccgttcattcaggacagattggagcgtgttatctatctgccgccgctgcaccagatcagccagtaaaaatatcagcgtctggccagtctcaaattcagatgaactattgctcaccttatcttcaggaaaataaacacgctttcgtatcggcttcatagccagcagtcgcgacttcatttctgctatcagttactactaccgatagtattaccggaagtatctgtcaaacgccctgtgatcaatctatgcagattggttcgtatacgccggaatacttccagatcccccggtttttccacaacgtggtcgagtgccagtattgcttgcagcacacgttcgcaacactggccgtcatgccaggcaaaggtgttttgcatacgctctacgtactcgccggaaggctggcaattgcatgctagcaagtctgccatggcagtcaatacttcctgcttttccgtgcacactgggccgaaaccatcacggcgataatcaaaatagcctttttgatacgaatgggcccctgagaaaaactcttcttcatcaaactgccagtaaaccactgggcgcttgagataggccatttcaaacgcaacagaagaatagtcagtaaccagcaatgctgcccgctggaaaagtgtctggatactgccatccgtgtgtgataacacctcaatgccatccggcagattgaaaagaccaaggtaaggctgtatgttggcatgaggaaaaaagactactcggtaaccttgctgttgtgtgagtgccataaagtccgggtcagacagcaaggtgctccacgaacgcgcgtagagcgtatccataaaattctcacgtatgacacactcattgcctgtgccagtttgtccacccaagagatatttccgccaggtgggcatgactagaatcatcttttctttttgccacactccccgcagcaaagcatcatgacggggaaggcctgtgagaataacttccttggaagtgaatttatatcgattaccattccttgtgatggaatcccgctctgcaggtgaggcagttataaacagatcgatatatctaccattcaaccagcgcgacaaatcatccttgatgaccccatgctgtagaaaaacaaactggcgccgcctgaggccgccatccttaaaaggatcgagtacgtaaggagcggcctgagagctcaccactcgggtacattcccgcatcgctagccggtgttctgcgctgccaaaagcaatcagttgaaacccttcgacctgcaggcgcggccagtcatgtgattcttcatgtaacaggaaataggcaggcagctgcggcatcttgcggcgtacataacggtacagatgctcagcattgtcatccgcctgggtatcgcgatctataaacagccaagcgccggcatatttcccctcgcgcacaggctgcagcacagaaaaatgctcacggatcgtctgaacatcgatcgtttttcccacctgtttgctgcacatggaaatatgtgccgccgcgccatccagccgtacctccagttttcccttccggttcagcggcaaccagaccctgcgctcctgtacaaaagtgcgctcaagaaaatcatgcacagtatttttttcgaatgctggcgtaaccgctctccaatcaataacaaactcctcaacaggtaactcgccacaacaataacgcagcaatacctgttgcctggcccaatcgaaattttccacataaatgacctggaaaggaggttttaattgcttgaatgtggaaagtattccaaccttatgaaaaaaacagcagttggccagctcaaattccacaatggtatctgtcgtaatactggaaaatagcttgtcgaggtaggcgagaaagcgctctttttgaggaagcgtaagaaatgcaactatttccgggcgatctatgatttcttttaaataccagactagatcataaagtacggtacgttgtacatatttcggaacgttgtagccttgtgcaatataagcatcaaacaatgcctgatagctgtaaaccgtcacttcatcgaagtgttcttctttttgccaaccagtatcaagtgaagaattgatttccgtaaaacgccgacagtaataacgcggcgcggccagaaaagccacctgcttgtttttaagtggctgaagataacagccgacaaaatgcgcatcttcaaaattgggttttactcgttcattaaattgccggttttgttctcgcagcaaagacagtctgaaaaaagcagaattgactaataattgcaggtgattctctagattatctgcagcaaaaatacggttacctttggcaaacctgaattttaacgggtgagtatcgctgaagctgtcctgattttcccgataaaaaataaaattacacgaaagcagtgccaatttttcagctgttttttcagcggcttgccgagcaataaaatcatccacttgctggaaataatcgggggccacgaaatcatcgggatcaataaaggtcacccattcggtatgcacctgctgtaaccccagattacgtgcactggcctgatccccattttccttctgtagataaaggatattttccgggtaactcgcctgccagcgacggatgatttctgctgaattatcagtggagccgtcatccaccatgaccagataaatatgcgagcgaaaatttagtatctggcaggtcatcgagtagaaaaaatcatccaaataggcggctacgttataaacggctgaaacaactgtgtatttttcatggccagttgtattgcttactttgccaagatcggtgatttgtttgtcaaacagctttaaccatctgttgcagggatcagctttcagctcttcataaaagccgatttccacataatgcagcagtggattgagatcgattttcaagatttccggatgtcgttccagataacgagttgtatcaaaaaaagggccggtatttttcccctcgttcgccccatgatagaaataatgttcaaccggatctaccccactctccgcaacttcagaatattgagcaaggtaccaggcggtatcgaaccagctgcattgccgcaatacccgaatggccttttcagcaggatattgctttaatttttccagctcccggcctggctcgcgcgccaattttgcttctttttgtaatctgcctgcctggcgagtctcagaactgctgaatggggtatctgccggaagcaactccagcatagcagctgcttcaataacatcaccggcttcatgcattctgaaaacgagccatttcaaccgatagggtttcggatcaagcgcgtacgcacgccgcgccgcttcagctgcctgatcacgtttgttttgtatcaaatgccgggataacgccgtccaggcattcgcctgtatgacagatgagataggcaattttgttagtagtctttcaactgctgcaaaccctttttcctgataagtggaaatgaccttgctaaaccccttgccacccagcgtcgccgatgggtttttacggactgactggcgccagatactgagaagcttcccgggcaccgatattaatgtactcggggaatcaacagcctggatcagaatattaccaagccgaacattaagcgcattgtgcgtttcaagatgatgcagttgacgctgaacgcctactaatgcgtgtaagtgtcggttttcagccacaatacttaccagtttttgatcaaccgatcttctgtattcaaactccccctgatcttgaagcaacgaagactcatctgtttctttcaatccgtctgattgggagttttcaacgatatcggaaatcctcagtaagtttgttggctgattcatcgtttctcctatatataaaaaacagaattactctttgttacttatttatactattgtcataccttattctggattgaggttttcaaatcgagagtaaacactgctatcaggcctttattcaacataattgtgagagctgttttattcttgttctggcaaacaatatgctgataagcggattctccccagggatacgctcttaagtatccagcagcttgagatagactttatcttgcctttggtctagttgaaaatctccaatctttagtttaatggcagccagataacgtagacgacgataggtatcttgtttatgtatcagtccacgtgatcttgcacgatggcttccagtaatttcagggttccagccagaaccaaggccagcaacagcgtgacaaaggcgctgtaaatccggcgaggctccatggaatattccggcagcgtgggcgattgcagcacagaaaccttttccagcaggcgtgtggcatcaatacggcctttttcaagcgcggccagggcggttttataaatttcccgggtaaattcaacttccatttgtaagtattggaattcttccagcgccgtgttgagggtatcgctgcccgagacattggtgagcctggctttttcctgcgcgatctggtgattaacagcagccagggattgcttgagcatggtaatgttggggtgatttcgttccaggttcttgggcaaggaggcaagctgggtctgcaactgagcgcgctgttcttccagcttgaaaattagggaactgacaccttcagcgatcacttccggggatagcaaacctttttcattctgaaacttaagcaaaacctggttagcctcctgcaagcgctgctgagcctgcttgacctggctggtcaggaagttcacttgtacctgcgccagctcgtgatcaaggtgattcatgtaacgttcaccttcctcaaccatcatggtagaaatggcctgcgctgttggtgcatcgtaagcttgtgtctgaatgcgtagtacgcctgcgaaatcgtcatactcaacactgacccgtgaaaggaaatggcgatgaaaccattccatggaagcatccttgagccacatttgagaaacaacatcatgctgccaatcgctgtagtgcgagcgcagatcaaacgccgcatccagttttttgagcatatcaaccgagagcaagtactcccgcagcagaaattgatctgcccgatttgcaccgggaagccctgccatcagcatggaaatatccggtgtgggggcggctatcgaatcggttttacggatgataacgttggcttcagaaacgtagcgatccgaagcaatcagcaaccagtagactgaggccagtatggctgaaacaaaaatcagccgtcttgcgtaccggaacagtgtggtgaaagtccatctttctggcattttttgttgaacagcatccggatccattaaagatttttcaaatgatgtcatttttgagtgctgtccttgtaggcttttaatgcatcatcaatctgatcaaaccagtaggctttgcctttgtgaatccagacaccttgctgacaaaattgctttaatgtgctttcgctatgcgccaccatgattaacccggctttatgcgccatggatttaaacgcatctgctgcttttttacgaaaggcggcatcacccgctgctgtcacttcatccgaaatataaacatcaaaatcaaaagccagggacaagccaaactgcaggcgagaacgcataccagatgaataggtgtacaccggtttatcgaaggcatcctgcagctcggtaaaatcctggataaaggccagacgatccgccagatcatcctggtggccatgcacgcggcagacaaatttggcattttgtcgcccggtcagtgtggcttccagtccgccctgccccatcggccaggagacccgacaacgccgttcaatcgctccccggtccggataatctatgccgccgatcaaacgcaacaaggtcgatttccccgcgccattggggccaactaatccaacattcactcctttggggatggtcagattaattccggataacacccagggtccgacaccatgtctggtgcgataacgtttgtgtacgtcttgaacagcaatcatttcatcaccagttgggcatcaaaacggcgatacagcagcaaccccagaaacaggctgacactcccccagacatacagataacccaggttggttccgggtatgacatgatagttatagacgaaaccgtcgcgcaccagctcaacaccatgggcaattgggttgatcatcagccagccctgataaggctgaggaatcgtgtgaagcggccagatcacgccagaaataatatagagcggcagcatcagaatcttcaggatatgcttcatttcagggatcatccgcatcgcaaccgaggcaattaaaccgtaacccaaaccaaacaaccacagcccggcaaaagcaaccaaaattaataaaatatcagtcggcggcgcaaaatagccgagcaatgcggcgatagccaggatgatgattgatacaatcaacatcagaaaacactccagtaccgcccgcataaaagcagcatcaaatggcttgacttgccggtaagcaaacagcggctggttagaatccaccgcatgggtgacctgatcagccgtgcgccggaacagaaaaaaccccagcatcccgaccacaatccagatcacaacatccgcgccacctacactgcgcatccttaaaaccgagtaaataaatgcgtaaaaccccatgtgcatcagcggttccatcaccagccacagccatgcagcccgcatatcaaacaggcgttccagtgcttcgcgcaggaagatcgccttccaaacggaaaaggtgattgccatggggctacgcgtgattgagtgattcatcatcagggtaacaatagcgttctgttggcagtcactgccggattgatggtaatcatcaacagccgcatgaatttctcaaactcggcagccggtgaattggcgacataaataacatcccggttttgtaccggaaaattctgtgtcacaaaaaaagaggcaggatcacgtaaatcaacctggtaaaccacgggaacagtaccatttgcagcatctccaatcgcactcccggaagtcaccaggttggcatcctcgaagcgaaaaatgaatacaccgcgtgcatcggcacggttatcgatcagcccgccggaacgcgccaatgcctgagcaagggagatgccctgagcttcaaaaaacatttcctcatttttgcccgttgcacccagtaccgaaaagctgagtggctggaacagggccgtgaccacatcgccaggtttcagcacgatattttgtctgggatcgcgaataacgatgtcaagtggcatggtcgccgtgaggttgttgcgggaaagctgaattgccatacggctgactggctgattcactccgcccccggccgccagtgcatccagcagacgttctcctctaggcgtcaagggcatacgcgtactctggttcacatcgcctactacggtaacattggaggtattgttttgaatgatgcgtaccagcacctgcggcaaattggctttaccagtgaggcgcctgacaatatcggcttcgatttgctgcgtagtgcgtccccataccgaaacatgcccggcaaatggcatggtaattgagccatcctgcgtgaccatttgttcaggaaaggtaacaacgcgagtagtggttgcgcctgctttggggtcaagcaccaccgcgccaaacagcatggcgggctgcgcctcccagacggagatttcaatcacatcgccaggattaacaatgtaatcgttggcgccctcacccggataaacatcagcaaaccggtccagtaccttggcggcggctagttttttggccagggcatcattgacatccaccagctcgatgccttcaatccttcctgaagcatgttcttcctgtatttgctcgcggcttgcaccacttgatgacatccagcccggagacgtggcacatcctgacaatatcagcagtaacccaggcatagataacagcacaagccttttgataaggttttctccagctttcattctgttctgtcagagcagggttttcatggttgcacatacacggcggatgtcctgtccgctatgcatggcggacaaaaagaatctgagccgggccgcacgctcctcaactgccgggtagataatcggctgaacattaataccgtgctcaaatagcttgttcgaaagttttgtggccttgaacgagctgccggcaatggctgggatgatggcaaatccttgtgaagaacccgtattgaatccattttttttcgccatttccagaaacaactggccattttcctgcagacgggaaacacgctccggttccttcagcatcaatttgagggcagcaagtgctgccgcagccaaagggggagcaatccccacgctgtaaacaaaacccggagcagcatatttaagatgttcaaccagcgcccgctcgccagcgatataaccaccgcatccggcgagcgttttgctgagcgttcccatccagatatccactgctttgccagcaatattaaaatgttcatgcaaacctttaccggttttccccaacacaccaagggaatgtgcctcatccaccatcagaaaacagccatgccgccgcttgatgtcgataagtgccgacaggtcaggaatatcgccatccatgctgtagtgcccttcgacaataatcaacacacgttcaaaccggctgcgaacctccgcaagcatagcgtcgagcgctgttgaatcgttgtgcggaaaactgcgccgggcagctcctgaaagcttgatgccttcaagcacgctgttgtgaatcagactatcatggacaaccagatcctttggcccgaacagagtgccaattgtgcttatgttagtggcatgaccgctgacgaatacgatgcaatcctccacttcgtagagcccagccagcgcctgttcaagttcacgctgcaccggacgttcgccggctaccaggcggctggcggaagcagaagagccataatgatcaatcgcttctttggcagcttgattgacgattgcatgaccatttaatccaaggtagttgtaactggaaaaattgagatattcacggccttcaatacgtgttcgcgcgccgactgcaccatcgtgtgaaatgaaaaagggattgcgcaatcccaggcgatcagccgccgctctggagacaagcatcttttcgtaaccaggatactggtcgaaacgggtccaggcttcagggattgaagaacgaggttttgagcgcactgtgacggttgcagatgcatcatcagtgtggctctttttaccgagaatacgattgatcagttgcgatctggctttttgctcaggatttactttgctcatacgatcagtcttgttcccgatttggccagtttgcgtgcatcttctgctaattcctcaacatccagcaatgcgatctcttccccatgttggtgaccgagtccggctgccacgatactggtttgcgcaggttcagcgatctctttccctccggccaattttccgacgatacgcgccgtgacattatcgaccgtgggtgcgtcattcagcatcatgaccggcagctggataccaaaacgctgttccaaccccagagcaagttcaacagccatcaatgaatccatgcccagagcatgcaatgatcgtcccggttcaatccgttcaggagcaatggcgagaatttgtgcgacttcccgcgcaaccagattacgcacgatggttgtgatctcctccggagttttgccggtgatgagatcatgaatattggtggcttcccctttctgtgctgtaccctgctgattccggttgagcgcggtgaaacgactgttatctgccgagggcagcagccgggaaagcgtgtgccaatcaaagttggcggggatggtaaatccgtgccgagcggcaaatgcatgatcaagttgtgccaatgcttccgctgtagtgagcggcggtttaccaagccgctgtgcaaggctgtccctgactgattcattacgggtgagataaccgctatctccgattggcccccaggcaatacaggtggccggaagctccatatggtgacgtaaggcgatcaacccttccagcccgacattggcggccacgtaattggcttgtccgggattaccaatcgtggtggtcaccgaggaatacactacaaaatgatcaagcgcgctatccaacgtggcctgatgcaagtgccaagcgccttgcagcttagtgttcagaacattttcgatactgtttgcatcgagattggcgatcaaccgatcatcaaagacagcagcggcgtgcagcacaccctttaacggtggcaggttttgacggatatgcttgatgacgcgggtcagcgcagaaaaatccgtaatgtcacacgccaatgccagtgcgttgacaccctgtgcagcaaaagtagcgatgatttcccctgcccccggcgtatccatgccgcgccgccccagcaggacaagattaccaacgccgcgcgaggccagccagcgggcggattccaggccaaatccggaaaggccgcctgacaccagccaggtgctttctctaccaaaccggatggcaactggtggttgcgccggttgctcaagaatcggttttgcatttgccatggaaacaacaatcttgccgatatggcgtgcctgctgcatgacacggaaggcatcgacgatacgatcagcaacaaatgtgcgatacggcagcggcgccaggatctgctcatgaaacagggccatgaccttgcggaataatcgggcagcaagtttcggctggccggtcagcagctggtcggcatcaatgccgaaatagctgatgttgttcttgaagggacgcagaccaatcggtgtattttcaaagaaatcacgtttgccaagttccaggaaacgcccgaaaggctttagtacatccagactgcggcgcatcgcttcacccgcgagcgaattaagcacaacatcaaccccttcgccacctgttgcaacgaggatctcatcggcaaaggccagactgcgggagtcaaaaacatgatcagcgcccagcaacctgacgaaatcacgcttttcgtcactgcctgccgtggcatagatttctgcacccagatatcgcgccagctgaatggctgcgataccgacaccgccagcggcgccgtgaatcagtacccgctcacccggccgcagattggccaggtgcttgagtgcgtaataaacggtgaagaaaactgtcggtacagtagccgctgcttcaaatgtccagttttccggcatgcgcgccaccgcatcggcacgggtgacaatatggctggcaaagcacgaggcaccaaatcccatgactgcatcaccgggcgccaaatttttcacacgcgcccctacccggctgaccacacctgaaaattcaagaccgagactggcgccggcaaagccgttttcaacggcttcatccggcagcagccccatcacatacatcacgtcgcggaaattgagtccggtggcttgtgtttttatctcgatctcgttgttacgcaacgatcgttcagtttccggcaaccagacaaggttgcgtaattgtccaggcacatgaaaatcgagacggaaacgtgaggctggttggcccgacgctgcggattgtttttcgtctcctgcactatcttcctgcatcaccaggcaataacgcccctgggcagaaagcacaatttcattgatgccgtccggatgcagcaactcgtatcccagccgggcaggcatgtcaggtgcatccgggttatctgccagatcaataagcgtacaggcaagctgcgggcattcgttcatcagcacacgcccgaatccccacaatgcgaattgtgtcgggctgggttccaggctggctggtaattcggcagcaagcgcaccgccacgtgtcatcagccagagatgaggggatttatccgtctgcgtggtcaatacctgaacgtattccagcaacccggttacggtcaccgtcgcccggtcgggtgcatcgttccagcccaacacatgaacgatatgatcaaaatcagatagttgatcagcagaaacacgattggcaaccctgactcgttggttccgggatttgagatggttgcacagacgactgaccaaagacaaagaggtctcatcagccagtaataaccaggaagccgaagtcatttcaggcaatgacgtatcacgctctcccgagtatttggcaagcaacagatacgcgccttctgcaatcccctcggctgcaggctcaaggaaggtttcacaatcgacaaaaccggtatcaaccagtgcttgctgccacgcttgtggagggagtaatgaggaaaccgggatatccgggttctcgggatgttgatgccaccaggtcgcatcgattccctccagaaaatcagcgctccagtccggatagcgttcagccaataacaataatccgcctgctgccagccagtgccgagcgtgtaccaacccggcagaggggttggccgcacggtgcagggtgtgacgaagaataacgacatcgaattcgccaggcagacattcatttgtcaccagcttcaaatctgcatcctcaaacatcgttacgaagatattggcgtgatgctgatattcagcttcctggcgtgtttttacggcctcatccggcaaagcgagaacataatcaaaacgatcttccggcagagaaccgatcagcacttttggtaattcgctaaggcccgcagcaatttcaaggactcttaaacggcgtgatgctggccatccgcctgccagcccgatcagcacaccttccagcgtatgacgcaagccaagataagccggatcattatcgtaaagcccttcagcaaccggagattggcgctgctcggtcagcagttgattagcatcagcctctcctaaaagcagggatggcaaccgactgccaatccggccgatcagggtcagatgaggcaggctggcaggtgcatcacataacaaggtctgccagagttctgccgaggccggcagaccggtatcagcaaccaccgtccagcgatcattttcctgtttgagcaaaccttccctgttcagcagattcgccaaccaacgcccgtaaggattagccagaacagattgccaatctgttgtttcttcgccagaaagctgctggaaggcttcgctggcaaacgacaggatcaatgcctccatgaggggcaaggtttccttgaaccattgcctgcggctgatctcaatattggccagctgtaagtgaagcgcctgggatagatccgggattgctggtataacgctgtccgcgccctccagtggatgtggctgcagccttggtacaatttaccagcgtgaaacagcatgttgatcgttgcgcttgagaggcgcggcacgaaaacgacagccggaaacactggcaaccagggcccctgcttcattcagcaattcgaaatctgccagcactgaacggatgccacgcctggacagatttgcacgaaaacaggtgatgggttcgttttgataaaaatcgatgcgccccattttgaccggcagcagcgctattcctcgcccggcctcaatgtcatcagcaaaaaaatcgacaagcgactggaaacagatatccaacagcgcggggtgcagcagatattctttcagatcaacaaaatccggcactgccagactggcttccagcttatctgcactaacccgggccttctgcaatccttgaaatgccaatccatattccagaccaagttttgtggccagacgatagtggttttcttgcccgatttctttaaccggtacggcaggtaaatcgatacgggtcgtggcaattcggcctgccgcttccagcaggcgaccagcagcatgcagggtccagccatcctcactgagccgctggcgactcttgatctggaatctgccatcacgcggatcaagcacaaagcgcaaactgcgcgcgtgctcaccgtcaaacaccatgggtgcgacaatatccagttgctcgacaacaaaatgtcctcctccccgcacgaaccattcacgcgcagcagccagtgccatttcggcataggcagcaccgggatagacaatcgctccgctcacttgatgatctgccagccagggcaaactctccgggtcgagtatgttttcccaggtcgcatcggcatcggaaagccgccagcccagcagagggtgcacgcgctgacgttgagttacctgaaggctttcactggtgacaggatgccagtggcgctcgcgctgccagggataattgggaaggcgtacacgttgtcccggaactgggaaatagctttccaggataggtttatccacaagaaggtgggtacgtaaagcggtttcagcgagtcgattccaaccatctgcctgcctggtgagtgtggggagcacccgaccctggacattggcggcagcgagacattccgcgatatagcgctgcaagatggcatgtgggccaatttcgacaaatacccgacaacccagctcagtcagcttgtgaatggcatcggcaaaacgcacaggttcacgcacattgcgccaccagtagttggcagaaagggtgatgccactgagtacgctgcccgttacggtggaaacaaaagtcgcctctttgccgcaagaagggatcaggccagcaaggcgttcagcaagatcggttttgacagaatccatctgcttgctgtgaaaagcataatcaagatcaagcagacgaaaaaaaatccctctggattcaagcagagcttgaatattcaccaaactgttcagactgcctgcaagcgtaacgtttccgggactgttgataccggcaatctctacattctcttcttcacccaactcaaccaaaatttcttgcgcagcagtaacggacaaaccggccgcagccatccggcctgtgccgcgcgtcagttcctgaacctggctgcgggcacaaataacacagatagcctgatccagatccagcgcaccggccgcccaggcagcggcgatttcacccacgctatggccggcgacagcggatggtgtcaccccctgctctctcagtagaagtgtgactgcaacctgaatagcgaacagcagaggctgcgcgacagctgtgttactaagcctggcaagctcactttcggattgcagcgcctcaagcagagaaaaatctgtcaaggggcgcatggcgatatccatttccgtaaaaatttcttcaaaccgggaggattcagtcagcagcgcacgccccataccggcccactgcgcgccgttacctgaatagataaacgccacatcgccactttgtggcaggctatcctcaatgaagatatccgctgaaacattatccaacgcatattgctgcagcaaatgaattgtcgattcaacagagccggaatggagcgcgagccgtttttccatacgatcacgctgattgacagcagcatgtgccacgtcatagaaatcctgcccggatttatcgtgtaacagatctgcataacgacccgccagctcttttagtgctgtttcggaacgggctgacagaaaaagaggtggcaaggatgccggtagcggttccgtcgttgccagatcacggcaacgatattcctgcagcagcacatgcgcattggcaccaccaaagccgaaggaattcacaccggcaatcagagctcgattattctttttcgccagttccagatactcggtcaccggcctcagattcaagccgagaaaatcaatatttggattgggcgtttccagatgaatctgtggtggcagagcatgatgcttgagcgccagaattgccttgatgattcctgccatgccggaagccggttccatgtgtccaagattggccttgaccgatccgatcggcaaaggtttttcgcgctttttgccatagacttcaccaattgctgctgtttcaacaggatctcccaccgccgtacctgtgccatgcgcttcgataaaatcgatgtctcgtgctgacagactggttttggcgaggacgctcatcatgagctcggattgtccatcacggctgggaatggtaatgccagccttgcgtgcgccatccgtattgataccagtggccaggatcaccgcctgaatatcgtcgccctctgcaatcgcctgttcaaacggcttgagcagcaagactgccccgccttcggcacgtacataaccactaccggaagcatcgaaagccttacagcggccatcagcagacagcatggatgctttggtaaaaccaacgaagggatagggatgcaacaataaattaacccctcccaccagcgcagtgcctgcctcaccagtttgcagggcctgacaagcatgatgcaatgcaaccagcgacgatgaacaggccgtgtcaaccgccagcgaagggccatgcagattgaaaacataggaaagacgattggcggcaatgctgagcgtgttgccggtcatcatgtggggcgagagcgacgccagatcatccagtccgcgcgtgccgtaatccaggccggaaatacccacatagactgcacaattggaaccggacatggatgaaggcggaatacctgcattttccatggcctcccaggataattcgagcagaagccgctgttgagggtccatccaggctgcttcgcgcggagaaataccaaagaagctcgcgtcaaattcatcgatacgcgatagaacgcctgctgaataagtaatgctgcgaccaggctcggaacgtttgtcatgctgaagctcactgatcgcccaacgctcgggcgggatactggttacaagatcacgtttttgcttcagtgcattccagaaatctgtttcgtcaccaagatcaccagggaatcggaagccgataccaataattgcaaccgcttttgaggtcatatctccagatcaatatccatgcaatccgcttcacgttaactcagggaagttcttcggatttattgcgatcaccatccccttattgaaacttgaatcagtttgtcgtcatttgagaacatgacgggcgatactatcttatcgtcatgaaatgaacaacaggaaaaccggtattataaatgcctatatcatatatgaaacagtcaatcattgatgagcacacagttaccggcaaacttcagtattgatttttcagatcatagctaaagcaacaaaaggtttatttaaaaaaagtaaaaatgattttataaagataaaatctattgtctccaaacagagacatagtaattttgcctgattgccagactgctggtgaaattacagaaaaatctggataacacagttgaatcccggatttggccgagaaatgctgaagggcactctaaaaattggttactcagggacaaacgaaggaaaagaatccgcagaaaatcaggatgctgaacacgatgtacatgtacagcacattattacgatgcaatgaatatgggcagacggactatcaaacctgtgaggcaggtaaatcaagcgagaacgcttgatcagccacgccttatttttgtcgctatcgtgacaagatcgtatcagtggctcgtggcaaggcttccgggtaatcccggctgaagtgcaatccgcgactttcatgccgcagcatggcgctgcgaacaatcagatctgaagtacatacgagattacgcagctcaagcaaatcgctggttacccggaaattggaatagtactcatcaatttccccgctcagcagtctgatgcggtgttgtgcccgctgcaatcgcttgttggtgcgcacgataccgacataattccacatgaaacgacgcagctcatcccagttatgggagataacgacttcttcatccgcatccgtcacccgactttcatcccagtcaggcaatggaaaatccggcgcaggcgatcgggtaaggatatcttcaaccgctgaaagaccggttaccagacattccagtaaagagttactggccagccggttggcgccatgcaatccagtgtgcgcggtttcaccaatcgcgtacagattatcgagatccgttcttccacgttgatcgatcacgatgccgccgcaggtatagtgcgctgcgggaactaccggaatgggttcgcgtgtgatatcgatgcccagctccagacagcgctgatagattgtcggaaaatgctgcaccagaaaatcggctgactggtgcgatatatccagaaacacacaatccagtccgcgttttttcatttcaaaatcgattgcacgcgccacgacatcgcgcggagcaagttcagctcgctcatcgtgtttaagcataaaacgctcgccatcgggcaatttcagcaccccgccctctcctctcactgcttcagtgatcaaaaaggattttgcatgcgggtgatacaggcaggtggggtgaaactggataaattccatgttggcaacccggcaacccgcacgccatcccatggcaataccgtctccggttgctacatccggattggtggtgtacaggtagaccttgcctgccccgccagtagccagaattgtattttgcgccgctatcgtacgtactttcccggcatgaatatcaagcacataagcaccgtaacagcgattactgccccgggcatgagatagtttctcactggtgatcagatccactgcaatatgatgttccagcacggtaatgttcgggtgctgagccgcctgcctggtgagcgtgagttgcactaccttaccggtcgcatcatcagaatggatgatacggcgaacactatggccgccttcgcgcgtcaggtgataaccggttttattgtgatcatcgcgtgtaaaattaacccctcgttcaatcagccacctgaccgctcgcgggccgttctctacaatatgacgtgtcatggcttcgttacacagccccgcaccagcaatcagcgtatcgctgatatgtgcttccagcgagtcttccatcgaaagtacagctgcaatccctccttgcgcccaggcactagaactatcgtagagtgtccgcttggtaatcagcacgactttttgagtttcagccagcttcagggcgagtgtcagcccggcgagaccgctgccgataatcagtgcatcgaaacgaggtggttgcatagatagcaataattactcaaaaataattgaaagtgaaaatacttcctgaaattaccacactttttgccaggatttcgaatccatcaaactgtgctggcgttcccgtcagcaaaaatacgctagaatacagacaaaggtttcaggggaggcttaaccggtcaaaatcccgacggattcaagaaaaacaatagcctgacgtcggcacttcccgtcgtccaatttacagatctaatacaggagagtttcagcatgtcgatggcggaccgtgacggggttatctggtatgacggaaaactggttccgtggcgcaatgccacaacacatgtgcttacccataccctgcattatggaatgggagtattcgaaggattgcgcgcctaccagacaccccggggaacagctattttccgcttgcctgagcatacagaacgtctgttcaattcggcacatgttttcagaatgaaaatcccttttgatcaggccacgttgatacaggcgcaactggatgttgttcgggaaaatggattggcctctggctatatccgtccgattatcttttatggctcggaagccatggggctatctgccaagaatctgtctgtccatattgcaatcgctgcttggccatggggaacctatctgggtgccgatgcactggaaaacggcattcgcgtgaagacttcctcgttcacccgacatcacgtcaatatcaatatgtgtcgcgccaaatcggtatccacctataccaattccatcctcgcacatcaggaagttgcgcaggatggctaccaggaagccttgttgctggatgtagatggttatgtggcagaaggctccggtgaaaatattttcatcatcaagaaagacaggatttacacgcctgatctgacatcctgcctggaaggcatcacacgtgcgacggtcattcagttggcggaagaagccggcatggaagtggttcagaagcggattacgcgtgatgaagtctattgcgcagacgaagcattctttaccggcacggcggcagaaatcacaccgattcgcgaactggattgccgcacgattggcaatggcaaacgcggcccgattaccgagcagttgcaaacctcattttttgattgtgtcaacggcaaatcagataaacatgccgattggctgcattacgtttaattgttaaaccagacgaaatttcctatgagcactccttctacagttacctatccgcaagcaattgaaatccatccggatgatttaccactatactgcccaaacccggctatggatacaaaaagctggcatccacgtgttttcctcgaaatagaagcgaccggcaaagccatgtgtccttactgcggcacacgctataccctgatcggcacaccgaatccggatcatcacgggtaacacgggcaaaagactggctttcgtatcattcattatttatccggatcaaggaatcatcactgcatgaatacacttccacgccgcgaaatcttcaaggcttacgacatacgtggcatcgtagaaaccgcactgactccggaagtagtggaacaaatcggccatgccattggttccgaagcacgcgcacgtcagctgacagctattgcagtgggtcgcgatggccgtttatccggtcctcaactggtgcaagccttgacgaacggtatccgtaaaagtggaattgatgtcatcgatattggcatggtcgccaccccggtgctgtattacgctgctcacgaactctgtcattattctggggtaatggtaaccggcagccacaatccgccagaatataacggtctcaagatcgtgctgggaggcgaaacgctggcagccgagaccattcaatcattacggttgcgtattgagcaaaataacctgacgcatggacaaggcggttatcgccaacacgacatcatccccgcctatttgcaacgcatcgtggaggatgtcaagctggctcggccaatcaaaatcgtggtggactgcggcaatggtgtaactggcattctggcgccagaactgtatcgccgcctgggctgcgaagtaatcgagctgttttgtgaagtggatggtactttcccgaatcatcatcccgatccttcagtcccggagaatttgcaggatgtcatccgcacacttgctactaccgatgctgaaattggttttgcctttgatggcgatggtgaccggctgggcgtcgtcaccaaggatggaagcatcattttcccggatcgccaacttatgctgtttgctgccgatgtgttgtccagaaaccctggcggccagatcatctacgatgtcaaatgcacacgcacactggcaccgtggatcacacaacatggcggcaaacccatcatgtggaaaacggggcactccttcattaaggccaagttaaaggaaacaggcgcactcctggcaggcgagatgagcggccatatctttttccaggaacgttggtacggattcgacgatggcctatacgcaggtgcgcgtctgctggaattattgagtaaacaaaccgatccggaagcggtgctgcatgccctgcctgatacgatcaacacacctgaattgcagatcagactcaaggaaggagaaaatcacgccttgattgcgcaacttcagcaggaggcaaacttccctgaggcggatcaggtgattacgattgacgggctgcgggtggaatacaaggatggattcggcctgatccgggcatccaataccactccggtcgcagtactacgtttcgaggctgacaatcaggatgcgctgaaacgtatccagcaagattttcgccaaatcattctgcaagccaggccggatgcaaatctgcctttctaaccgggttccagttacggacccgaatacccttccacaatgaagatcgcgcttgcccagatcaactgcacggcaggcgatttgaacggtaactcgcttaaaatactgcacgcctgccagcaagccagggaagccggggccaggctggttatcactccggaaatggcgctgtgtggctcccttccggaagactggttgctgcgcgcagagtttgtacaagcctgccatcaggctttgatggatctggccacgcagatacatgacgtaacattggtaatcgggcatccgcaccgcacgaacggtaatctgctcaatgctgtttccgttattcgagatggtcgcctgcttatcacctatggtaaaaatcatttgctcaccgatccgttgctggatgaacgccgttatttcactcccggcaaccagccttgtacgtttgagtgtgacggtacacttttcggattgaccactttctctgattatcagcatccggcacacttgcaggctttgcattctgctggcgcgcaggttttactaacggtgggtgcatcaccctacgctattgatggccaggctgaccaactccgaattgtacgggcaggaattacgcaaaccggtctgccaactgtttacaccaacctagtcggcggacaggacgaactggttttcgatggtgcttcatttgcgatggatcacagcggtaaactcgtttgtcagctagcggctttccaggaaacacttggcttgattgagcttcataataatcaactgatccccggacaatgttctccgctgccagatcggatcgaaagtgtgtactcggcactacgtctgggcttacgcgattttattgataaaaacagaatctccggagtattgattggtttgtcaggcggggttgattcagcgctggtactggcgattgcggtggatgcgcttggagcagatcgggtcagcaacgtgatgatgccctccccttataccgccgacatcagcctggaagatgcgcaaatcatggcaggcaatctgggtgtacactacactgaaatacccattaccgagctattcgagcaattcaaacaaacattacaccccgcactgcaaacctatccagctaccggtccccaaactaccatggagaacctgcaggctcgtatccgtggaaccttgctgatggcattagccaatcaatccggaagactggtactgacaacgagtaacaaatccgaaactgccgtgggctacagcacactatacggcgatatggctggtgggttttcgatactcaaggatgtcagcaaaacgctggtttatcagctttgccactaccgcaacagaatttcacccatcatcccggagcgcatcctgcagcgcccgccttcggctgaattacgtcccgatcagactgatcaggataatctcccaccgtatgctgtactggatgcaatcattgcagcctacgtggaaaacaacctgtcacctgcagaaattattgccatgaattatccggaggaaaccgtccggcaggtgctgcacatgatccattcctgcgagtacaaacgcagacaggcagctcccggcatccgcattacccgacgtgatttcggtccatcatggcgattcccgatcacgtctggtttccggcaatgatcagccccaataatattttggcattcctcaattcaacagttgttacgcaatttcgtatacaacaggtgttatcgtacttgcggctgaaatcacaatctgctgtaacacaggaacgggaacaggaactcgatctgtcagcgttcgtcaaatacagcatgaaactccactaccttattatcattgtgcccttgctgtttccagcccatatttttggacaggaactgcctgatctgggggatgtctcgcaagctacggtaacacctcaccaggagcggcaaatcgggatgcagatcatgcgtgaaatccgcgccgatgccagttatctggatgatcctgaaatcaccgactatcttgccagattgggccaccggctgatttctgctgccggccagacaaattcagacaatccatttgagttttttgccattgatgattcctcaatcaatgcttttgcgcttcccggcggatttgtgggatttcatagcggcctgatcaccgccgcacaaaatgaatccgagctggcaggcgttatggcacatgaaattgcacacgtcacccaaaaacacctggccagaatgctctccgggagctcatatctgggtatcatcggctcgatcgcagcgctggctattgcgattcttgcttcacgctccaatccccaagctggccaggcagtgctggccaccgcccaggccagcgcgatccagtctcaactgaatttcacccgtaagcatgaaaaggaagcagatcgtgtcgggtttggcatgctcgtcaaagcaggattcgatccacatggcatgtcaactttctttgagcgcatgcaacacgccagtcgctactacgaaaacgggattccttcatacctcatgactcacccggttacccatgagcgtatcgctgatattcagaatcgcacccgggaattgggctaccggcaggttccggacagcctggaatttcatctggtacgcgccaaaatccgcgcctcccggggtaatccggcttcaattgtcagtgaattcaaggcacgtctgcaggataaacgctatattaacgaaattgctgagcgatacggactgattcaggcgttattacgtgccaagcaattcaaacaggcagatgaggagttaaatacactttaccggactatccaatccgattcttctgcgcagcccctaagaaatcaccgcttgggaaaacccatccaggtggaaggtgattatctgcaatcggctgctatgattgaaacacttgctgcacgcgttaagtttgctgacggacaaatcgacgatgcgttcaaactgtaccaggctgcactacaatctttcccgcattatcgtgcgcttgtttatgattatgttgatgcactactggaacacaaagatgcgcagaccgcgctgaatttcatcaatgagcaatcccgtttcattcatgatgatatccggctttaccggctgacggcacaatgtcatgctgcgctgggaaacgccctgttgcaacatcaggctgaagctgaagcgctgatccgcgagggaaatctccgggcagcaatcgaacagctccaggttgcactacgttataagcacgacaatttttaccaactatccagcgtggaggcccgcttgcgtcaaatcaaggagttcgtggctgccgaagagaaaaacaaataagcacctttcaatgatttgcatcttctgttaaaacccagtcatctgatatttctcatacgataaaaaatattaccccctatgttcagttcacgcggaagaattatccttttcctgatcatcctgctcgccgctacactctatggatatttttcgctccgggatgaatctggcactgtacgttacaaaacacatgttgttgatcatggagatattgcgcgcacgatttctgccaacggcacgctcaccccactggaactagtcgaggtcggtacacagatttccggcagagtgatccagctgtttgcagatttcaatgatgaggtgaaaaccggccaaatcctggcaaaactggatcccgcattgcttgatgcacaactacaacaatccgaggctaacctaaaaagcgcacagactgcattatccgtggccatcaataaagataggcgcagccgtaatctggttgaaagaggtttcatctccagagaagcgatggatgaatcaaaagaactgctcgattcagcgcgggcacaggtggtcgtcaatcaggcgcagattgcccgtgaccgtaccaatctggattacagcatcatccgctctcccgtttccggtgttgtcattgcccgtaacgtcaatattggacaaaccgttgccgctaacttccagacacctattctgttccagattgcgcgtgacctgaaacagatgcaaattgaaatcagcgtagtggaagcggacattggccagattcatgatggccagaccatggtattcacggtggatgccttccaggatcgtgaattctctgctgtggtcaaacaaatacggctcaatcccaccatccaggaaaatgtggtgacttacagcgttattgcgaccgttatcaatgaagatggcagcctgctgcctggcatgaccgccaatgtacgttttatcgtcaatgaaaaatccggcgtactgcgtgtacccaatgccgctctgcgttataaacccagtcgaaaggaatttgccaaacccactgacacacagcctggccagcggttgctctaccggctggaaaacaaccggccagtaccggtcaaagtggcaacaggcattacagatggcagcttcactgaaattctttcaggtgagctcaacgcgaatgacgaactaatcaccgaggaaattgacgacagcaaacaggataaatcgggcggcagcaacttcaagttcagaatgttctgatgagccagcgatgatgtttgcagatcattcccacggccggacgggtgaaccgctgatagaggtggaaaaactctccaagatttactatctgggcaatcccgctgattcatccctaagtctgcaagtgttgtttgatgtcagcttaacaatacaacgcggggaatttgtgtcgatcatggggcattctggctccggaaaatccaccttgatgaacatactcggttgcctggatactcccaccagcggccactaccgactggcgggacgtgatgtatcagcactttccggtaatcagctggccagcgtccgcaaccaactgatcggcttcgttttccagggattcaatctgctcaggcgcatgaccgcgctggacaacgtggccatcccgttactgtacgccggacgcagccgtgctgaaagtcgtgagcgagcaatgtcattgctgcagcaaaccgggcttggcaattttgttacacaccagcccaaccagctttccgggggacaacaacaacgtgttgccatcagccgtgcgctagttaaccagccacagcttattcttgccgacgaacctactggtaatctggacacacaaaccagctatgaaatcatgcaattacttgatcgcctcaaccgtgaagaaggcatgaccatcattatcgttacccatgaagaggatatcgctgcctggacacagcgcctgatccggctcaaggatggacgcatcattgaagatcgtccaatggaaaaactcgctgcctcccccgctgcctcatcatgaatttactgaccatcatcggtgaagccatgcgggcactgcagaccaaccgcctgcgcaccgccctcactatgcttggcatgatcatcggcgtagctgcagtggtactcatgcttgccgtaggacaaggcgcacaaaccagcatcaacagtgccatcgcttcaatgggcagccatttgctgatcatcatgccgggtgcgacttcttctggcggcgtgcgctggggcatcggcagcgttaaaacgctgacagtgcaggatgcgcaagccattgcagaattacccatgattgatgcaaccgccccgattatttcgggtgcagcacaacttaactacaatgcaaataactggagcaccatcttgacaggtgttacgccggattatttttccattaacaactgggaaattgccagcggcaccatcttttccgaaggagatttacgctccggcacacgtatggctgttctgggacagatcaccgcaaccagcctgtttggtgatgaagatccggtgggaaaagtcatccggattaccaatcggccattcacggttgtcggtgtactggctgccaaaggccaaagtttgtcaggacgcgatcaggatgacaacgtattcattccactcactaccgcgcagcgacagatcattggcaaccagtttcccggctccatcaattttatgatggttcgtgcaaaatcggagaacgacatggaagctgccgaagcagagatcacgcatctgctccggcagcgccaccgcatcagcaaccacatggaaaatgattttactgttcgcaacctgaccgcactggcctctgtagcaagcaacaccgccaagatcatgggttggatgctgggcgcaattgcatccgtctcactactggtcggtgggatcggcatcatgaatatcatgctggtctccgttacagaacgtactcgtgaaattggaatacgcatggcaataggagccaatcagcgcatgattcttacccaattcctgctggaatcactgatgatctgtacgctgggtgggctgactggaatcgccctgggaattggtggcgcgtggctcgccagccagcttgccgggattgacattgtcattacatccgggacaattgctctggccttctcatttgcctctatcaccggtgttttcttcggcctctatcccgcccggaaagccgccgcactcaaacccgtggaagccttacgccacgaataatcccggattctctatccagctggaaaaacacgggatgcaaattgccgggaacggagcacgagctttggaaaaaatttgatttgggttatgttcccataacaaccgataaatttcagttggatggaaatatcgcattagatggcactattaaatatgatcttgaagcgcaaatttaccacctgaatccactggattttagcgcagacatataacctgacatactgaaacagtatcgctaaaaaaagagagtggttgcaggtcatgagaactgagatcaaaggtgaagtgaatgccagcaatatttctcgaccccattccactggcagatggtgaaatcactatcaccccaccaagcattactgaactgctgaaaacactggagcaagatccagagcaagtatcactaaaaagcctgaatgcccatgcgaaattcagcagcgataacatgtgcgaccatatgggatacagcacttaaacaataataagcggacagcaatagtatttattaagggtaagatgagtggtatgggtgagaaatcagagcaaatatcaaaatcagcccgttcaacagatccccaagagcaagagtctgttgctcttgcatcgcagtgtgttggcgaggggcgtgtactcaagattcgcgggggggtagtggatgtcttttttacagagcatattccacgtatccacgacttggtttatgccggcgatttagcgatggaagttgctgctctgttagatcaaggtaccgtacgctgtatagcgttaacaccagtgcgcggtctgggtttaggtatgccggcacacgcaaccggagcaccgattcaagtgccagttggtgaagcggtactgggacgtatgctcaatgtctttggcgaacccattgatggaaaacccgcaccaaatgctacaatttcccgttccatccaccaagccccgccagtattagaagagcgtgtggtgcacagcaccatcctcgaaaccgggattaaagccattgatttactctcaccaattgagcgtggaggtaaaacaggattatttggtggcgctggagtgggtaagacggttttgattactgagctaattaataacaccgcgcaacatcacaaaggtgtcagtctgttttgtgggattggagagcgctcgcgtgaagcagaagagctgtaccgagaaatgggcgaagctggcgtgcgcgataaaaccgtgatgctatttgggcagatgagtgaagctcccggcgtacgttttttagtcggtaaaacagcactgaccatggctgagtattttcgcgatgatctagggcaggatgtgttgctgcttatcgataacgtgtttcgctttgtgcaggcgggctctgaagtttcaggtttattaggacggatgccatcgcgggtgggttatcagccgaccttggccactgagttggcttcgttgcaagagcgtattacctcgacccgtaaaggtgcgattacctcgattcaagcggtgtacgtgccggcagatgactttactgaccccgccgcggcgcatattttctcgcatctgtcggcttcagtagtgttgtcgcgtaagcgtgccagtgagggcttgtatccggcggttgacccgttagcctccacctcagtgatgttaaccccagcggtagtgggtcagcgccattatgatattgcccgcgctgtacgccgcacccttgctgaatatgaagagctacgtgacattattgccatgttaggtttagaggagttatccgcagcggatcgcacggtggtggctcgagcacgccgtcttgagcgttttttaacccagccgttcttttctgctgagtcttttagcggtgagataggcgcacgggtctcggttgccgagaccttagccgggtgtgaaagaatcttgcagcaaaccaaatttgccgatgatgaaatagactattacatgattggtgctttgcccgagcagaagactgcagtatgagccaggctgaagtgatgcatgttaatctacatttgccaacacgcttgctgtttggctgtgaagctaagcaagtatttgctgaagctgaaaacggtgcttttgccatgctgcccaatcacactgattttgttgctgctttgctgccatcggtattggtgattaccgatgctgagggcgcggagctgttttttggtattgatcaaggcgtactggtgaaacatggccatcaggttgatattgccgtgcgtcgtgctgtgcaaagcgaggatttggtcagcttaaatgacattattcaaaccacttttattgaggtagatgaaaatgaacgagtggcgcgcacggccttatcgcgccttgaggccggtattgtgcggcgtttcagtgatttacggaaacctttaacatgacagaaaaaaatgatgcctccgcgaccattcgtcgtcatgctgaacgcatgcagcagaaacataaagcaccaaaatatagccccttaagcggtctgggtgtatttggagtgattggttggtcagtggccattcctactgttggcggcgcttttctgggaatgtggttagatcgtgtcgtaccgcaaagtttttcctggcccattgccttaatactcggtggtgttgtcgtcggggcaatggtggcttggaactggattgataaaacccgtgataaataactgacagtgtatttgtttgtcagcgaagtagcagggagagataaagtgattgatatagatggcagcgcaatattgcttggctttgtggttggtctacccgtaagtgcgttgttttttatgggtttaaattggggaatacgtttggccttagcttcagcgtatccaggtcgtttgttaatgctaagttttttttgtcgcttagtggtgttgctggcagtggggtttggcttaatcgcgctgatccaaacactgtggtcattagctggttatatgttggcttttgtactgatgcgcgtcctggcagtggtacgagcgcagttgacccacagcgtcacctaatcaaaacacgaaggtatataaatgcagctcacaccagaccaaacagtagtgtttactttaggacagtggcaggttaacgccactatcgttaatacttggattgtgatgatactgttggctggcatttcgatgctggtgactcgcaatctacgtgctgacaaagcacctgggcgctggcgcagtgctttagaactgattgtcactatgattcaaggacaaattgaagaggtaacccgcagcagtgcacggcatgtattgtatttttccggtactttatttctctttatagctgcgtccaatgtgctaacagttattccaggctttgttccgcccacttcatcgttatcaactacggttgcgctaaccttgtcggtgttagtagcgattcctttgtttggaattgccaaggggggggtgcaccaatacttgcgcaaatttattgaaccatcgatgattatgctgccatttaatatcattggtgaattttctcgaggcgtatctttagcgatccgtctgtatggaaacgtgatgagcggtgtggtgattgcagctattttactcagtattgcaccattcttttttcctgtggtaatggatatgctgggcctgctaaccggctttattcaggcctacatctttgccattttagccactgtgtatatttcatctgccatggcagatcctcccctggatacatctgataaggataaataatcatgactgatcttgcactgattgccgctatttctatttttactgctggcctaaccatcgcgattggctcgctagggcccgcgctaggtgaaggacgtgcggcggctgcagcgattgctgcaattgctcaacagcctgatgctgcaccgaccttatcacgtacgctgttcgttagcttggcgatgattgaatcaaccgcaatttattgttttgtggtggcgatgattcttatttttgccaatccgttttgggatgcaatgcaggcggtagcaggaggttaatgtctgatgtccattgactggataacagtactggcacaaattgctaattttttagtcttgttgtggctgctcaaacgttttctctatcgtcctattttagatggtatcgacgcccgtgaagctgaaatagccaagcgtatggctgatgcagaacttgcgcagcaagaagcgaaagctgcagaaagacaatatattaagcagcgcgcgcagctggtatctgagcaggacgccttgctggaaaaagcattacaagctaccgagaaaaaacgcgatggcttattgtctgatgcacgtactcagttgcagcaagagcagcagaattggcgcaagtatcttgagcatgagcgtcaggcgtttaatcagcgtttgcaacaaaccggtgctgatgcactgttgcgactgacccgtaaagcactacatgatctggccgatgaacacttagaagatgcgattgttcggcatattggtcagcgattaaagccgattgctgctgaattggtgcaagctgcggcaggcagtcagcaagcgcaggttaccacccgtgatgcattaccggccgccacgcaagcgttattacagaaagaagtgcagcaatggctgcctgacgtcactttaagtttcgctaccgatccacagcagtcgcccggcgtaatcatgcaagtgggcggcgcgcaagtagcgtggacgacggacagctatatggatgagttagccgaactgttaacccagcatacttctagcgttgctgctgtgcacttaaccgctgatggccgctaaaaaggaattgaagtgagtgtacttgacgatgtcactgagcagcagtttgagcaaaactttaacgcttggttagacagtctcagcacaggtgccacacccacgccggtactcaccgaaaccggcacagtgaccgaggtggcggatggtgtggccatcgtctcaggtctggcgcgcgccttagctgatgagttgctggtatttgccagcggtgtgcacggtattgtgctcgacttggaaccgggtcgcttagggattattttattgggcccgtctgaacagatccacttaggcgagacggtgtatcgcactcgtaaagtagtcagtgtgccagtgggctcggcgttacttgggcgcgtaatcgatgctatgggccgtccacgtgataccttaggaccgattgatgcgatagctgagcatcccattgaagcggaagcgccgagtattctaaatcgcacccagattttcagacccttagccacgggattaaaggctattgatgcggcgatcccagtgggtttaggccagcgtgaattgattattggcgatcgccagactggtaaaacttctatcgctatcgacactatgctgaatcaggcacgttcggatgtgctttgtatttactgcgcagtggggcaacgcggtgatgctgtcgcacgggtgattcgtgcgctcaaagatggcgaaatgctgcagcgctgcattgtgatgagtgccggtgatgaagaagctccagggctgtcctatattgcgccctatgcggctatgactatggcggaatatttctcggcgcagggccaagatgtattggtgatctttgatgatatgactcatcatgcgcgctcttatcgcgaattatcgttattgctgcgtcgaccaccaggacgtgaagcctttcctggggatattttctatgtgcatgcgcgtcttttagagcgcgctggacaatttggcgccgacatcggtggcggatcgattaccactttgcccgtggtagaaacgcaggctggaaacctctcggcttatattcctactaacctcatttcgattactgatgggcagatttatttatcgccgcagttagtacgtaaaaaccaattccccgcagtagatttaggactgtccgtgtcacgggttggtagtaaagcgcagaaccgtaccttgcgtggagtgtcaggcaacttgcgggtgaccctctcacaatttgaagagttggaagattttgcccgctttggtacacggctcgatgatgttacccgtgcacgtttggcacgtggttctgcggtgcgtaccgccttacgtcaagctgagcgtgacccgatgtctgcccttgagcagctggcggtgttgatcgcagcgatggaaggcttatttgatcagtttaatgagcaaaaaattaatgatgctatgcgtttagtgcgtgatgccgcccaacaacagctggctgtgattgaacaacgtattattgataaccaaaccctacaggatgacgatcacacactgattgttaattgcgcgcaaaaagctttaagcatattcgatcagccagcaacgaatacaaagtagtgagatggcacaaactctagagcatctatcgcgaaaaaataataccctaaccagcatcaggggtattgtgcatacgatgaaaaccctatcagcaattaatgctgcaccctatgagcaggcagcgcaatcgattgaagcctatcatcaaacgatattgcaaggttttgctgcttttatttatcgtactggtggcgccagtttgctcactgaagcaacccagcctaacaagcggctactggtagcgtttggctccgatcatggcttgtgtggtaactacaatgagctactagccgatacggtaacggagtacagcaaaaatcagccgatggtaaaacaacatattctctgtattggctcacgtatgagcaatgccttgctagagcaaaaactcactccagatatggtgttaatgccacctgcatcagcagatggtataggtcgtttagccggcgatattgtcatgcatattgaacgcttgggccgtggtcagcctttagccaatctagtggtaactttgatttacactcaacgcgctaaacatggctatcaagaatctgtgacacgcgctttactgccactggataaaagcctattacaacctgagcggcgctggcattcgcgttcactgccggattacagtatggcggccgatgctttgttatcatcactggtacgtaatcatgtatttgccagtgtgttccgcgcttctgccgaagctatggttaccgagaatgcgacccggctagccttaatgcaacaggccgaacagtcagtggatgagcagctagaagaggtgcaacaagaaatgagcaacgtgcgccaagatgaaattaccaatgagttaatggatatcgtgattggccatttagcttaatcagcgcgccctagtcataatcagctagggttgatatctgcagcgcagtctggcttacgccaacatcccgccccatccacagttaggggtagcaccgatggtgtaacatgacgcatcgctggctagatacagcaccgcaccagccatttcactgggatcagtcacgtgattcagcgagatacgagacaactaaactgcttacgaagctgcgcaaggattagttatcctcctttaaaagcttgatatagaaatcacaggagcaggccgagccttctgcttgcgcttctatctcagcaaaaacatccccttttataacatcccaagcagagacttattttgcatttttgagcgaagcgacagaaaaacaaatcctgctggcttggcttgttaggtgtttttatctgaatgaatccattttgtggttaatccaaggcctgtgccctcctccacctgggacaatttttttacataccgactcaacggattaccacgttacaataaaatgtacgacatcagccagctgcacgcttgatggcgattaatcaaaaattgcctgatcccactggaaaaaaatggtcagcatgaaataatggtcaatgtaattggagtaatgatcccagcttgtgtattacacctgctgtttcagtaatttttgcaagaaaccacgcctacaaaatcagatttgatttttgagctcgatacaaaccccgaatctgacaaacacctggagtaattattgacaacatctggaaactcaataaataaaccagatcattccgctcacacccccatgatgcagcaatacctgcgtatcaaaacacagcataccgacaagctgctgttttaccgcatgggagatttttatgagctgttttatgaagatgccgaaaaagcagccaggttgctggatattacattgactcaccgtggctcctccgccggggagccaatcaaaatggcaggtgtgccatttcatgcggcggatcaatatctggctaaattggtgaaactaggtgaatccattgctatttgtgaacagatcggcgatcccgctaccagcaaggggccggtagaacgtcaggttgttcgcatcatcacccctggcaccctgactgatgccgggttgctggaagaacgtggcaacagtattgtattgacactggcactgcatcacggcgtgattggtctagcttggctcaacctggcagccggggatatgcgcgtactggaaacctccccggataatctggctagcgagctggagcgtttgcatccatcagaaattttgctaccggaatcacttgctctgcctgtgatattaaacagttttaccgcccccaaacgcctgccggattggcaatttgattatgagcatgctatgcagcagcttacccggcaattcggtacccgtgatctgaatgcctttggttgtgaagagttgcgtgccgcaatcatggcagccggtgcgttatttgaatatgtcaggctgacgcagcacactgcaaccgatgaatcagcaacacaggtacttggtcatttgcaaacattacgggtggaacggccagagacctatttgcgtatggatgccgctacccgccgtaatcttgaaattacgctgacattacgtggagaagaagctcccacgctatcatccctgctggacatctgcgcaaccagcatgggtagccggttgttgcggcattggctgcatcacccgttacgcaatcgtatcaccctgcagcagcgactggatgccgtttctgacttgattggagcaaagccgggaatcctctatgcaggtatccgggagcggctcaaacatatcgctgatatcgaacgtatcaccagccgaattgccttaagaacggccagacctcgtgatttatccggtttacgcgacagcctgacggcacttcctgaaattatcaaactgattacaacctcaacagctattgccattcatcgttttgtcccggccatggagccagatactacactcacacaactgctcgttcacgcgctgcagccagtgcccggcgcagtaattcgtgaaggaggcgtcatcgctgacggctatgatgctgaactggacgaattacgcgctttacagaagaattgtggtgaattcctgttgcaactggaagcacgggaacgcgagcgtaccggcattccaacccttaaggtggaatataaccgggtacatggtttttatatcgaggtaacccgcatccatggcgaaaaaatccccgctgactatcgccgcagacaaaccttgaaaaatgcggaacgctatagcatccccgagttgcaggtatttgagaacaagacactgacagcacgtgaacaggcattggcacaggaaaagaaactgtacgagcagttactggaacaactggcagatttcatcattcctttacaggaaattgcccgctctgttgctgaactggatgttctgtgtgcttttgctgaacgtgcagatttgtttggttataccaaaccggtatttactgatgatcctgctttggatatcgaagctgggcggcatccggtagtggaaaatcaaatagaacaatacattgccaatgatatacagctgggtgctgtcacgcgggaaggacggcagatgctgatcatcaccggcccaaacatgggcggaaaatctacctacatgcgacaaacagcgctaattattctgctagcgcattgcggtagttttgttccagccgggagcgcccgtatcggccccattgatcagatttttacccggattggtgcagctgacgatctggcaggggggcgttccactttcatggtagaaatgacggaagccgccagtattttacgcaatgcaaccgcacaaagcctggtgttggtggatgaaattggccggggaacttcaacttttgacgggcttgcattggcttttgccatcgcccgccacttgctgactcagaatcagagctataccttgtttgccacgcactactttgaactgacccgactagcagaagaatttccgcaggcaattaatgtacatgtcaccgcagtggagcacaagagacgtattgtctttcttcaccggatagaggaaggatctgccagccggagttatgggctgcatgttgccgcactggcaggtgtgccggataaagttatccgaaatgccggaaagattctggcacaactggagcaggaagcactcagcaagagtcctcagcagacattatttgaaacaattgaggaaaacgcggaagctgctcctgcttccgcgcatccggtgctcgattaccttgagcaacttcacccggatgagctgactccccgggaggcactggaacagctttacctcattaaatcaatggccaatcggataaaataattaacaagatggtgaaaaatgctggtgagatcgtctaatgctcgtggccgtgcggcccgtgtacatgtccgtgagataattcttcttccgttgccgggcgtacttccgtaactgtgcattcaaactgaaatgccataccagcgtagggatgattaccatccactaccacgacatcatcagtgatctctctcactgtatagatataaaaatcatcagaatcttcctcacccccctcaaattgcatcccggccgtgatttcttctgggaacgcactacgtggctcaacgcgcatcagttcctcatcatattctccaaaagcatcatccggttccatttgcagggataaggttgccccggtttctttttcatgcagcgcttcttccactactggaaatattccatcataaccaccatgcaagtagctgatgggttcatcagtttcttccatcagatttccttcctgatcggtcattttatagtggagtgataccaccgtattttttactatgcgcatgcttcctctgcctgaatcaggcttccttgtagttgggcacctcgaaaaacctataaattctgaagagatttgtatgtaacacattgagtttacgatcaatggattttcaaaaatagggtttttcgaggtaaccagttgataaaatttgtttaaaatcacaccgttgatttctcagcacacggcgcgaaacttttgcgatgagtagctgttattccatgcaaacgaattgcgtccaagtgcactctggtgggatagcctttatgtcgatcaaaaccataaatcgggtaaatctcgtgtagccgtaacatttctgcatccctcgcagttttggcaagaattgaggctgccgaaatctcagctaccagactatctcctctgataactgcctgcacttcataatccagttgtggtacatgggtgccatctaccagaattagtgcattagacaccggcattaattcaatgactgctcttcgcattgcgagcatgctggcttgtaaaatattcagccgatcaatctcctccactgaggctgaagcaattgcccatgcgcgagcatgctgttttatttgttcggccaaactggcccgccgtttttcacttaaccgtttggaatccgccagtccattgataacgtagcaagaatccagcacaacacacgcagcatagaccggaccagctagcggccccctaccagcttcatccaccccgtagatagctttcccttccggatggatccattctcgaacgacgacaccagaagtcttgatttctaacctccctgctaaccgaatcagatggcccgagcagtacacatcagctgagcttcggtgacaagctggccatccacttctgcacaggctgaatatttccaaattcctttcagctgacgggtgatttcaacctttaataccagctgatcacccgcgataaccggctttttgaatcgtactccgtcgatacccacgaagtaatacacctgtccggcatctttttctatattttctgatcgaatcgtcagcaaggcagctgcctgcgccagtgcttcaacaatcaatactcccggcatcaccggatgatgcggaaaatgtccggaaaaataaggctcattgatagaaacattcttgtatgcgtgaatccgcttgcccaactcaagtgaaaccacccgatcaaccagaatcagtggatagcgatgcggcaagtatttcagtatttcatggatatccatcacagccattctatctctctgttatacaaatttttatatatttattgtttcttggaagtcggttcctgtgcgtttaatgccttgatcacctggtcagtaatatcaatacgcgcacttcggtagactgaatcttgcagctgcaggatcagatcataatcctgttgctccgcgagttctttgatcaccttgttggtacgttccagaatcaggctgtactcttcattttggcgcaaactcaaatcttcccgcatctgctgctgtgtacgttggtaacgtcggctgagtccagccagttcccgctccttcaagcgccgttcctcttcattgacaaagtcaatatttttttccagctcctgctgtaaagctctgatctgcacggaaagctccctgatacgtgcatcacgtgcctgaaattcattttctatctttttctgtgcggctacggcgggcattgattcccgcagcactctctcggtattgacaacgccgatcttgatctccccagcaaacagataaggtgacaaaataaacactgccaaaaaaatgaatatttttacaaaccgaacaacagttatctggctgtatctatttaatgaatctttcattttcttttaatacaatttttcagattcagaaagtctgtccaaactggaactggaaacgttgcaatttgtcgcctggtttatcattaagtggctgggcgacactgaacttcagcggccccatgggagaaatccaggttgcagccaacccggcagagtaacgaaaatcatcaaatcccagtccggaaaatgaattaataattgtaccgccatcggcaaatgcactcagacgaactgatttgtcatccttcataaatggtaccgggaataatacctcaacgttaccgactatacgtttgctgccacccagagccagattattattgtcacgaggccccaacgtattgatgttgtaccctctaaccgaattaaagccgcctgcaaaaaaattcttgaaaaaaggtagcggtttaccggaatatccatcgcccactcccacttcaccattcagcatcagggtaaatagcctggaaacgggaaaaaaccatctctgctcataactgaccttgtagtaattcaggtctccgaacggcataccaaattcgccaaataatcgctgcgtcaatccggaggttgtccagatcgcactgtcacgacgatcacgtgcccagctcaaggtaagcgggaggttattggaagtcttgccaaactgatcgacgaaatccctgaaacgttgcgggctgtcattgcgcaaatcaattttggtgtgttcataacccagtcccaatgaaaccatgtcattttccgcgacggggataccaaagcgaatgttggcaccagtcgtatcggtattaaacacccccaccctgctcagagagcgggtattgatgtcacgtctgaacgcttccagaccgagactgactccattaatcgtataatacggattactaaatgaagccgagatgatcttgttaacgctcccggtattcacctgcagactaagaaaattacccgtccccagaatattgttctgggcaattgatccattcaggataatcccttcgcgatcagaatagccggcaccaaacatgattgctccagttggcttctcaactacattgacattgatatccacctgatccggaacatcggcaaccgggggagtttcaacgttaacgttggtaaaaaaatccagcctgtccacccgttggcgggagcgattgatctgttcagtagaatgccagcccccttccatttgccggaactcacgccgtatcacttcatcccgggtacgttcattaccgctaatattaatgcgtctgacataaactcggcgccctgggtcgataaaaaaagtaaaggctgtcttgcgagtttccttgtccagctccggtgatgcattgacattggcaaaggcgtaaccatcattccccagcctgtcactgattagcttgatagattcagtcagcttctcgcggacaaatacgccacctggttcaagcttgatcaatttacgcaactcttcttccggcacaagcaactcgccggccagttttatatcggacaccgtatattgaggaccttccgttacattgactgtaatgtaaatatctttcatatccggcgtaatcgaaacttgcgtagattcaatattaaactccagatacccccgatcaagataataggaacgtagcgtttcaagatcagctgataatttttgctttgaatactgatcgtccttcgtaaaccatgtcataaaacccggtgttttgagactgaacagaccggtcagatcatcttcaggaaaaacatgattgccgacgatgttgatttgcttgatccgagctgtttttccttccttgatatcgaaattgataccgatacggtttcgttccagcggcgtggttgtggtcgtaattttgacggcatacttaccccggctgatgtactgacgcttcaattcctgttcagccttttcaagcagcgaacgactgaaaatacgagattctgataagcctgcctgcttcagcccttccttgagtttatccttgtcaaattcctttgcaccgttgattgtgatctgcgcgattgcagggcgttcctgaacctgtacaatcaacagctctccttcggatttcagtttgacatcactgaaaaaaccggttgcatacaatgctttgatcgccgcactggcttttttactgtcgagtacatcgccgactttaacaggtagataactgaatattgttccagcctcggtacgctgaataccctccacccggatatccttgaccacgaatgaatcatttgccgcacagcctattgaatacaggaaaaaaaataatgcataaaacctgaatttcatgtctattcagaagccaggcgaagtagatcgttatatattgcaaacatcatcagtgtaattagcaaagccataccaatctgattgccgatatacattactctttcagataatggtatacctcgcaccacctcgatcaagtaatacatcaagtgtccgccatccagaaccggaatcggcagaagattcaacacaccaagactgatactgatcagggccaggaatcccaggtaggcagtaaaccctatttgtgccgactggccggcatagtttgcaatggtaatcggcccgctgatattcttcagagaaacatcaccagtaaccattttcccaagcatgcgcacggtaaaataagacatttcccaagtcttggtaactgctttaaccaaagctgccatcggaggatagctggttttcaccagcagattttccagtatctcatgatggatttcaggcgtaattccagccttgccaatttcagcatgaccctcggatacggtttccggttgtaatgacatagcaagctcccggccatcccgcatcacctcaaccgagagtgtgtgcccgggatttgaacgcaccatatcgacaacatcttcccaggaggagacttcctttccattaatcgccacaactctgtcgccagtcttgagacccgcgcgttctgccgccccgccaaccatcacctgatcaataactggagcaacaattggccgataaacactcaaacccagtcgattcagaaaatcactttcaagatcttctgcgccaagactgctcatatcgagtttaagctgacgagaaattccactttcgcctgttactgttatcctgacatcaggattcttgtctactgcattgtccagcagtagcagtcgggtttcctgccaggtggtaattgcctggtcgccgatcccggtaatggtatccccgtttctgaagcctgctgaagccgcaagtgtcgcgggttcaatttcccccaggattggctttacaccactgacaccgagtataaaaagtaaccagtacagcagaatagccaataagaagttcgccacagggcctgcaaccacgatagcgaaacgcttggaaacaggttgtcggttaaacgcacgtggaagttcgtcagcgggaacccgcccttcccgctcatccagcatcttgacatatccccccagagggatcgcagcgatcacccattccgtctgatcattaccaaggcgttttttgaacaagggctggccaaatccgagagaaaagcgcagcaccttgactccacaccaacgagcgaccagataatggccaaattcgtgaaaagtgatcagtagacccagtgcaattacgaatgcaaaaatagttgagagcagtgtcatattaaagatctgcaaaaattatccattccactgctcggcacgaaataacggagctccggactgccctctttgccaagcctgagtatccaaccacttgcgagctgtctcacgcgcccgtaaatcagcagcaagcacatcttccaggtctgtaatttcctgtctgtctattgattccattacatgctcgatgatcgcagggattgccgtgaaaggtattttaccagccagaaaaacttcaaccgcaacttcattggcggcattcagtacggcgggcatattacctccctttgaaagggcttcatatgcaagcctgagacagggaaatcgctcgaaatctggagcctcaaaattcaattgtgcaattttgaaaatatccatggattgcacaccactttctattctctcgggataacccaacgcatgcgctatcggtgtgcgcatatccggattaccgagttgggcaagcaccgagccatcaatatattcaaccatagaatgaatgacgctttgcggatgaacaaccacctggattttttcgggttccacattaaacagccagtgcgcctcaatgacttccagccctttattcatcatggtagccgaatcaaccgatatttttctgcccattacccaattgggatgagcacaagcttgctccggcgtaacggttgacagggtctgcaaatctgctttatggaaaggtcctcccgaggcagtaagcaatatccggcgcaccccagaactaatcagatctccattgtaatgttgtggcaatgactgaaaaatcgcattgtgttcgctgtctatcggtaataacgttgcatgatattgtctgatcgtatccataaagatacgtccagccatcaccagcgtctccttgttagccagaagaatatgtttgcccgcctgcgcagccgagagtgtcggacgaatacctgccgcgccaacaatcgctgccataaccgtatcgatttctggtaaagatgctactttttccagtgattcgatacctgaaagtaccatggtacccaagcctgccacacgcaatttagcttccagttgctcggcactctgagcgttgagcatcacagcgtacgacgggtaaaatcgtttgcactgctcaaacattttttcaacattcttgtcggcagtcagggcaaccgcctgaaaccggtcgggatgtctggctaccacatccaatgtgctttccccaatgctgccggtcgagcccaagatggtcagatgacggattggagtcataattcagtcgaataaaataagatggccgatagcgcagcaacaggtaaaactgggatcaacgcatcaatacgatccagtataccgccgtgacctggcagaatattgccactatccttaacgcctgcctgccgtttcaacagtgattcaaacagatcacccactattcccagcaccgcgagcacaagcaataaaggaaccagcaagctaatcagcttgttttctctatctactatgcaaaaccagatcaatgcatagatcaatacgccaactagcgcagcagccactccctcccatgtctttccaggactgatctgcggggcaagtttatgcttgccataggtacgcccgataaaataggcaacgctgtcagatacccatactactcccatgaatccaagtaacaataatggatccatcgcacgaagctgataaagtgacagacacgccggcagcaataccagccagccggttaacatgaatacccacacattgcggatgggttgggttgttaccaattggtaaggtaccgctaacagccagaagatggcagatgcaatataaaaccagatcatcgatgaatctgccggatttctggctaccgccatgctggtcaggaataatagctcccctcccagcaaggtggtaaaaatcatataaagaacagtctggccaactgagaaacgccccagacggcaccattctctggctgctgtaacagtcaatcccaggagtaatactgcccagaaaatatccggtagataaaataatgccgccagaaaggcggtcaataatatgagtgcggtaaagagtcgggtgctaagcatgaacgggtgagtcccgttaattgaacaatgatggttaaactttattttcgttcaagatcgtatccttgatttcctgccgacttgcaagctgctcacttgtttgaccaaatctgcgctcacgtttctgataggaaaggatagccttgtcaagagttgatacattgaaatctggccacaaggtatcggtaaaatatagttcggtatacgcaagttgccagagcagaaaattactgatccgacattctcctcctgtgcgaatgaataaatctggctcgggagcatccgccatagtcaggtatctagaaagatcagattcattaaaatccatagttgaatcagagcgttgggcgatcattttgcgtacagcctgcatgatatcccagcgtcctccgtaatttgcagccaccgtaaaatgcaaacgagtatttccggcagtaagcatctcaccatgccgaacacattcgattactctgggatcaaatttcgaaagatcaccaatcaccctgaatcggactccattttcatgcaagctggtaacctcccgttcaagcgcagcgagaaacagttgcatcagcaacttgacctcttccgcaggtcttcgccagttttcactactgaacgcaaaaactgtcagatacggaacacctctttcaatgcaggctttaatcgtacctcgtactgcctcaacaccctgagtatgtcctgctattcgtggcagataacgctgctttgcccaccggccattaccatccatgataatagcgatatgcttgggtatcatcccggtttccgggattccacgagttgaactcaatattgaaggcatatatcagacagccatcaattctgcttctttggcttgcagcagcttgtctacctcggcaatatatcggtctgtcagtttctggatatcatcctgcgcacggcgatcttcatcttccgcaatcaacttgtccttcagcaattctttcaactgggtattagcatcacgccgaatattcctcatcgcgatacgagctgtttccgcttccgttctaacaatcttggtcaagtccttgcgtctttcttctgtcaagggaggcataggcactctcaccatttcacccgcagtcatcggattcaagcccatatcagaatctcgtatcgctttttcaatggctgaaaatgctttcttatcccatggaataacgcctatggtccgcgcatcagccagggttacattcgcaagctgcctgatcggtgtaggtgttccatagtagtcaactgttatatgatccagcagtcctgtatgtggacgtccacttcttactttgctgaaatcaactttaagtgcatccaggcttttctgcattttctgctcagtagccttttttatatcagcaatcatatttaagtagatattgatattaaaaagcgattacaacaatgcacatgtgctctgccatataccgcgaggaataacaatattttagataatgtccaaaaattcaaataattaccaaagtcccttcatcttcacccatgataactcgtttgagtgctccggtcttaaaaatactgaatacattgatgggaagtttctgatcacggcacaaggtcagtgcagtagcatccattacctgaaggtttttattaattgcctcatcaaaagtcaggttacgataacgttgtgcatctttattttcaaaagggtcactggtataaatcccatcaactttggtcgccttgagaactatgttggcattcatttccataccacgcaaggcagctgctgtatcagtagtaaaaaaaggattaccagtccccgcagcaaatatgactactttatgttcatttaaataacgtaaagccttgccacgaatataaggctccacgacctgatctatccgcaaagctgattgtacccgtgagactacgccattccgcctcattgcatcgtgtaatgctaaagcattcatggtggtagcaagcattcccatatagtcagctgttacgcgatccatgccatctcccgcggatttcatgccacgaaaaatattacccccacctaccacaatcgcaacctcgacgcctaactgcaacactccggcaatctcgacaacgatacgctcaaccactgtacgatcaatgccatactgcgcatcacccataagagcctcgcccgacaacttcaataaaatacgtttatagacggctggcatatatgctcgtgtaatggagatttatcgtaaagtcttcctgaaaattgatcacgccgctattcatacaccatcaacagccactccagattctgttgagattcacctgaatgatgacagtagatagggaaatggctgacaagaagttgcggtcggtcttgttattgcacaaaatacgcctgaaagaaagatcgtgttccatttgctaaattcgactgacaaatcgcgccaggaactgcctgtgcgtattatccataacacggcctctaccaaaaaactggcgattgttcgtatcgccgcgtccggatcgtctgccttgcctaaacaacagggggccatctttactcactgcgcctctgttcatacgtgaattgagccccaataatccattagaaacccatagaagatatacagaatttacgcctgatgaacaaactcaggttgtagcacaatccacctacaccagatactgaatctcaacagatcctagcttatagtgataagttattatttacctctgccacacgcccggtcaaaccaatcactggaaaacattcttattttgactgacttacctgcgccataacctcagctgcaaaatcatcagatttcctttcgattccctcacctacaacgtacagtgtaaaactgctgacttcagcagattttgtttttaacagcctctcaacagtctgctcgggatctttaacaaaaggctggcctaacaatgtaacttctgccaaatatttggtaactcgcccttccaccattttctcaattatattagccggtttgccactttctgccgcctgggcagtaaatatctgacgctcatgctcaagtaaatcaacggggacttgtgcgcttgatacgcaaacaggcttgctggccgcaatatgcatggctatatctttacccagggcttcgtctccccccgaataatcaaccattacaccgatcctgctcccgtgtagatacatcgcgagacgaccttcggcatggtaactgatcccacgacgaatactaatattttcgcccagcttcataatcaaagccttgcgaacagattcaaccgtttctccaccagctagaggcatttcagccaataatgctgtatctgaaacactttgactcaccatcagcttcgccagatcgccggcaaaattgatgaaatcttcattcttggcaacaaagtcagtttcacagttaacctctatcagcgctccctgtttgccatcagcggtaataaatccgctaataactccttccgcagcaatacgagcagccgctttacttgctttggctccacttctgatccgcaataaatcctcagcggctttcatatctccaccagcctcggataaggcttttttacattccatcatgcccaagccggtaagctcgcgcaattctttaaccatgcttgcagtaatctctgccatactgactccggatccggttaatacaaaaactttgaataatctatttcaataaggggtggtaacggagatcatttatgcatctgcagacagatcttgaccagacagaacctcactatcagttttacccatctcgacaatttcctggatggcttggttgcgcccctccagaatggcatccgccatggcgcgcgcataaagtcgtatcgcctggctggagtcatcatttcccggtatcacatattgaataccggccgggttatgattggtatctactacacccacgaccggaatacccagtttattcgcctcgataatcgtgcctttctgataccccacatcaatcacaaacatggcatccggcagccctttcatctccttgatgccaccaagactgttgttcaatttttccaattcacgctgaaaatcaagagcctctttctttaccagcttgtttaatgttccgtcttgcaccattttttccatatcttgcaaacgcttgatcgattgcctgatcgtcttgaaattggtcagcatccctcccaaccagcgctgattaacataaggagcgccacaccggattgcttcttctttgacaatatcacgtgcctgacgcttggttcccacgaaaagaattgtttctttgtttgctgctaacctgcgggcataatccagcgcatctctgaacatgacaagcgtatgctcaagattaacgatatgaattttattacgctgaccgaaaatatatggagccattttcgggttccagaaacgggtttgatgaccaaaatgaacacccgcttccaacatttgccgcatagtaactgacatgcattctccctagggttaaccgctacttatcgacgtacttccttaatgaaggcaccctattttgataagtgcgaattgtaaattatgttataaaaagttaataaaacaagaaatttcctcggcgcagaaaattacctctggcaccgcgcgccattataacatggcagatcctgcgctcaagaaaactcatttttcaaatcggatgaaaccgaaatcagtccgctgaattaccaattctgaggttcaacttatcaacgtcatgtaatgtgatatgtttgatattaaccgtgataagcccttcctcctgcagcttggagaatgatcggctgactgtttccagcttgagccccagataactgccaatatcttcccttgttgctctcaaaataaaatccgttggcgaatacccccgtctggccagacgagtggataggttaagcaaaaaagcagccagccgttcttctgctcgcatgctgcccagtagcatcataacccctctgtcctgcacaatttcacggctcataatcttgtgaagctgactcatcaatgaaggaatattttgcccgatttcctcaagttttttgaaaggcacttcacagacttcactatcaaccagcgcaaccgtgtcacaagtatgcttctccggactgatcgcatccagccccagcagctcgcctgtcatataaaagccagtcacctgctggcgcccatccaccttcagcacacaagttttaaaggagccgttttttactgcgtagagtgacttgaaatcagatccggcatgcgacaaatactcgcctctccgcaccttgaatttataattgatcagattaccaagatactctatttcctcatcagtcaaccccaccggcagacacaattctcgaaaactgcaagtcatacagtcggatttttgctgcaggacagtggaattaccaggcattgcgcagttatacaagacgactcccaccttaatttagagaggaataaaaaccagcactgatttatctagtcacactatttatcagcacatactccgccagactctgcgcagaatcccctgtcaaatttggaaaagcgggcatcccgattcctttaccattcttcactctttccatgatagcgtccgcattagccatctcgggcttcaatatcattgcgttgccgcttacaggcgtatgacactgcacacaggcttccttaaaaatcttttcacctgtcgcgcctgatgctggcatgtagtcattacttctagtgcaaccacccaacgcaaacaacacaaaaccaagcagcatcacaggtaaaatagttttcatttttccagcatctatcaataataatatttctaaaaacagtcaagcttacagacaaccggtcaagtctaacatacttaccattctatcggattaattcctataaaaacacattaaaatcaattgattatcccgaatatatcaaatatgaaaacagcataaccgttgcgaacaaaaagcttgcaatgaatcaatgaatttcagccacctcggaagcctgagttcatcatagtattcatcctaaaaattcacacgcactcccgcaagaccagaacgcccgggcaatggcgcgcgatcctttaaaaaggaggtgtgtcgccgcgcctcttcatttaacaagttggagcctcgcacgaacaggctgcaattcatctctccccagtcaaacccgtaatccagctgaatattcagcatcgtatagccggcagtagctgtttccagtgaagcggtatcagtctgtttgtatacttgcatcacatcaaccttccctcgccagggaccatagacataatcgagcgcccccccaaaacgaagtggcgttatccgtggcaaatatccccccgtggacagccgtccacgcacgtagtcagtccacaatcgcaaatccagtttgccgtgacgatcgtttagcagatgaatattcgtctcgaattccgctcctatgaaatttgcattactctgatcgtaattcagtaataacaagccatccctgtccaacgcacccttgatatcaacacgatccggcaatctgtcacctgtcaaatctgattcccgtaaaaatataaaatcattgatccgtttggcaaacaggttaagtgtccagtttaaattcccgttctgtttgctcagagacagatcaatactactggtcttttccggcgagagcgtagttttgcccacttcaaatgtatttgtggccagatgcggcccgttggaatacagctcttctaatgccggggcgcgcagcgcgtaggaaagactcccgcccagcgaataatcctcctgaaatttccacgttgcaccactcgaaatactgaatatgttatgactgactgcgacagcgtcatttttacgctctgtccattgatgttcaaagcgcccacccacttcaacaatccagcgtccgacatccagtttttccagcaaaaacattcccagtgaatccaagtgagaatcgggaacaaaggcttcttcaccagcagtagcaagattgcggttctggtattgcaatcccagcacacccttccaattgtttaggggctggtgcagcatctcaagccgaccatcccactcacgattcaacagcaatgttccgttcccatcatctcccgattcccgatgcgcatgatcgttataaccccagcgcagttttattttctgcaacccgggcaaaggtcgatttaatgctcctttcatatcgaaacgcgtctgtttttgtctgattcgcgccccttcttcatggcccggcgcaacatcgtcatcatgtaaatcttcgtcatgcccgtgatcatgtccgggcacgccatagtgattaacaaagcgactaactgcaatccctaaaaaaccccgttcatcaatataagacaaaccgctggaaaaattttctgtccggacatcactgttctcaagcacaccttttctcgcaccgggctctggctcaatctgcgcgaaaccgggaatcgaataattcccggtgtgccgcttcattccatccagatgccaggcaaaatgtccgccccccgtattaagtcggaatgctcccgtaaaatcatcagcaaccgaactgtaatgcccatacagatctccctccgttttatcaggaatatgatctggtattcgttgattcacgacattcaccacccctccactggctccggagccataaagcaaagccgaaggcccgcgaaaaatttcaacctgatcggcaaacaatgcctctactgccacggcatgatcagggctgaccgtggaaacatccatcgtaccgacaccatcctccagtacccgcacccgcgtgccacccaggccgcggattatcgggcgaccgactgccggcccgaaatcactactggacacacccaactcctgagaaatcgcctcaccaatgttacgtaaatcatgtgtttgaatacgttctcgttgcaaaattgatacaggtttgggtatatctgcctgagttccacttaaaggatcagccgtcaccacgataggtttaagtgatacagatccagctgccgcagatttagacaccgtaccattcgcaactcccaaagaacagatacaaagcgacatccccaaaaaaatcactaagctcgctaaagaccgcagtttcttcatcttttacattctccagttttcacactgtacactaccaatgtatgatgtatcatatcattattgcattccaacccttcaactttaatggtgccaacaatgctaaccgtagcaaccgaaccaggccattcgtcacaactcgatcccgcttctcggaagcagggaaagccactgtctttagatgaagagaacgcacgtagtataagggatcggttcactggtcaagttaaattcagcgatatcattctagccaacatgacagatcttataagcactgataaactcaaacagcttggattccgcttacgcctttggatagagccacggctttcgtttttacacagacaaagtactctgtcgcctcactaccacctatataagaccaaggagcgaatggttggatagataggccataatctctcgactttacataccgacgatcacatcatcacatcccattttccattcatttgcacactgcatgaaaatgatattgcaccacccagacagaggtggccagtgagataaaaacgaacactcaagtgtcattcactaccccccaacaatatgtattggcaaaacaaaattgttactcactttagatttttcctgcgaagcaagtgggagccattacgatataaatatggtctattatcatcgtagtattgaaatttttattcaatagctcacaacaggaagttcttgccctggactatagagatgccaaccaagatcgaacaaattatcaaaaaatcacaagaagcttgcgcatccaccggagcaaaattaaccaataaacgcaaaaatattcttgttgtgcttgctaactcgattgcacctctttcagcttatgaaattgttgagcattacagaggacaatttcaggaatcactaccagtcatgtcagtttaccgcatgcttgacttcctgattaaggaagaactcgtacataaactagaaacttctgcgcaatatatgctgtgtgcacatattgcctgcgaacatcaacatgagatgccgcaatttctaatatgtaatcgatgcggtagtgtcaaggagatcggtattaaaaaacagattattgaagaacttgaacgtagcgtagaaaatatgggatttatgctgacacagaatcaacttgaattacgcggcatttgtaacgaatgtcgtcttcaattaacgtctgcctaagaacctgttcaaagcctagggaagtgtgagaaacttggggagatgagaaaaagttacccgagcgacatcagtcgtgaacaattcgagcttatcaagcctttgctggagagcgcgcgcaggaagaccagccctcgacgaatagatctgcaaaatctggacaaatgagccagatcgttttatctttgacccattccagcacaccgtgggactaaacatcttagaagctgaaaagaagggaaaaattacacatatgaaatttacgatactattcaataatgggctgttaacatcacgattccacaacataccgcctgttctgttactgggtaaattctgctaagccatatgtgttgtacaagccgaacacttgtactatcattcaaagcttctcagcaaatcaatatgaggaaaaattatgaaatatgtatatttatttattgcatgcacgactattgcattgagtgcctgcgaagagaaaaaaagccttgacgggcactcaatggagaaaccacctccctcagctttcatggagcgtgattccgccccagatctcgatgctatagaggaacctgaaggaatggctaccagctcatcttcagccgaagaagaaaagagtcaaccttaaaacttcataattataaacagctcaccagcactgtagcgtgacctgtatcatgtcatgcatagccttcttgtttgaaagatgtgtcgcaaaatacaataaggctatgcaggcaaaataaaatcagaacaaacagtctctcttgcaggcatgcaagattaatcagccttaccatctatacatatgcgccatattctgactctggcgcatatttacccgctatcacaagaaacagctgaaacagctcaattatttactggcagcaacaaatgctgtccaaaaagcactcgtagaaacaagttgcaacgcagccgttagttcatctgtgagatgtatataaaagctcccagtaaaaacacgataatagttgctacccacaacacctgtgcccgttgagctatttttattatggctgttttgctatgatgaggaaccttgtgatcacacattcttcgatgctaaacattgacttgcacagccactcaaccatatccgatgggatgttatcaccctcccgattattggcgcacgctgcctcgcgcggtgtaaatatactggcattaacagatcatgacgatatcgccgggttgagtgaagcccgccgctgcgccctgcaggaaaatatcacattaatcaacggcgttgagatctctgtcacgtggcacagccgaactttacacatcataggacttggaatcaaccccgagcatccaccactggcagatggactagaagaaatccgggatggtcgcatggatcgggcacaagcaattgctgcacaactggataaatacggtattcatggcagtcttgagggggctcgcgcccaggctggtgaaagcagattgatcggtcgcacacacttcgcccgcttcctagctagccagggatacgccaaggacgtcaaatccgtattcaagaaattcctggttaaaggcaagcccggttatgtctcacacgtatggaccagcctgagcgaagccatagactggatccgtggcagtggaggtcaggctgtcattgcccatccagctcgctacaagctgggtaataacttgctcgaacaattactcagcgaattttgtgagctgggaggcacaggaatagaggttgtctcttccagccatacgcccgaacaaactcggcaatttgcacaactggcttctcgcatgaatctatacgcatcgtgcgggtccgactaccacggcccgggagaaagttactttgatctgggcaggttacctgcattaccgcccgaatgcaccccaatatggtcagaatggaaaattccagacattcaggaaagttaatacagtaaccacaaatatgagcaagccggataaaccagattattattctctggaaaattatcctatttcactcaatcatgaaactgctgtaatttccttatataactgcttaaaaaatagccatggctcaatttttttccatacacccacaaacacctcacttaagacttatccgtcaggcagctgatatcgttcgcgaaggcggcataattgtttatccgaccgattcctgttatgcactgggttgccagatcggcaacaaggaggcaatggatcgtatacgcaccatccgaaaggtgggtcaggatcataatttcacactggtgtgccgggatctggcggaaatagcaacgtatgccaaagtagataatgcgcaatatcgtctgcttaaagctaccacacccggcagttatacttttattctgactgcgagccgcgaagtcccgcgccggcttcaacatcccaagcgacatacaatcgggctacgcatccctgagcaccctgtcacacaggcattattaaccgaattaaatgaacctctgctgagttcaacacttatcctcccagaggacgagctgccactaaatgatgccgaagaaatacgccagcgcctggaacatcaggtcgagttaatcatggatgccggctcatgtggcaccaatatgactacggtaattgatctgacggaagcaaccccgagagtcgcccgccttgggaaaggagatctctcacccttcggaatcacaaatggatgacatcattcagggtatcgctatttacgcactgcctgttatttttgccatcacattgcatgaggccgcccacggctacgttgcccggcattttggtgacctaaccgcagaaaaagccgggcgtatcagtctgaatccgctcaggcacatcgatccctttggcactattctgcttcccttaatgatgttcctggccagcaaactggtaatgggtaacggcctgctttttggctgggccaaaccggttcctgttaatttcaaccagttacgacagcccaaaaaaaacatgctgtgggtagctgccgccggcccgggtgccaacctgttgatggccttcttctgggcagctatcatcaaattcggaataaacgtacctgacggcatttatgccaaacccatgatactaatgggtattgctggtatcgaaatcaatgtggttttgatggtactgaacctcttacctctgccaccgcttgatggtgggcgtattgcagtaagtctgctgcccaacaagcttgcctggaaatttgcccaaattgaaccttatggtttcgtaattttgctggtgctactcgtcagcggtgtcctgggtgtggtgctgtggcctctaattacaatcaccaagcagatgatcgtcatactttttggtctttatgtataaatagtattttttctacgtttcaccaggcacccttatattttttcttcgattccatgctatccggagctctgtaaaaatgtttgttgatcgcgttctctcaggcatgcgccctacaggaaatctacatctgggacattaccatggtgtattgaaaaactggctggccctgcaacagaaatatgaatgcctcttttttgtagctgattggcatgcattgacgactcattacgactcccctgaaatcattgagcagcatagctggaacatggtggtcgattggctggcagcaggagtagatcctgcacaagcaaccttgttcattcagtcgaaagtccccgcacacgccgagttatacttattattatcaatgattaccccgcttggctggctggaacgtgtccctacttacaaggatcagcaggaaaaacttgttgcgaaggatctcagcacctacggttttctcgggtatcccctcctacaaagcgctgacatactggtttaccgggccaatcttgttcctgtaggagaagaccaggcacctcatttggagtttacgcgtgaggtatcccgccggtttaaccatatctttggtaaagaaccggatttcgagaacaaagtaacgcaagccatcaaaagaatgggctctaaaaaaggaaagctttatggtgaactgcgtaaccgctatcaggaacaaggtgacgaaaatgcgctatccgaagccagattactgctgaaggaacaacaaaatctcagcatggatgatcgcgagcggctatctggctatctggaaggaagaagcaaggtcattttgcctgaaccacaaacgctattgaccaaggcgtctaaaatgcctggtctggatggccagaagatgtccaaatcgtatggcaacacaattggtttgcgcgaagatgcggacagtattgctcgaaaaattcgcaccatgccgactgatccagcacgcgtccgccgcaacgaccctggtaacccggagaaatgtccggtatggcaattccaccagctttattcatcagaagatacccggaaatgggtatggcaaggctgcacaaccgcagggatcgggtgcctggaatgtaaacaaccgatcattcaatcaatacgggaagaacaggcgcctattctggaacgtgccaaaatgtatcaggaagaccctgctcaagtaaaaaaaattgtcgccgaaggatgtgaaaaagccaatcaactggcagaagaaaccatgcgggatgtcagagcggcactggggatcgggtatccgtgatgaatgacatatccagacaaacccttgcagacaccgggaatatattggataacgctacgctgaacgacccgattgcaagagtacaaggcataccgctactggaggttccacaagacttatacattccacccgaggcactccaggtttttctggaaacctttgaaggaccgcttgatctgctgctttatctgatccgcaagcataacctggatattcttgatatccccatggccgaactcacgcggcaatatatcgcttatgttgaaaccatgcgtgcggatcagcttgagctggcggctgagtatctgctcatgactgcgttactgatcgatatcaaatctcgcatgctgctaccgcacccggccatcattcaggaagaggaagctgatccccgggcagagctagtacaacggctcttggaatatgaacgaatcaaacaagcggctatccacctacataacctaccgattgtcggtaaagattttatgttgacctctgtctggacagatttcgttgccgaaagacagttccctgatgtcaatcctcaggatttgtgtgatacctggtttgcactgatggaacgcctcaaacttaaccgtaaccacaccatccgatatgaagccatctctgtacgagcatgcatgagtgaaattctgaaaaatctgcagcctcgaggcagtgcttcctttactgaattattcagtaatatctccaatattcataaacttgtagccagtttccttgcgttgctggagctggcccgggaagcgctgattgatattgttcaatcagatcgctttggaacaatttatgtccacacctgccattctgaccgagccaattgaagcgaacctggttctttcgctgaatgatcaggtcgtcagggttgttgaagccgcattgttaaccacgtctgagcctttgaccattaatgatctcaagaaactctttgagggtaatattgataaaaaaatgctgcatgaatccctgacaatcctggatgagaaatggtgtaacagcggaatagaattggttttagttgctggaggctggcgtttccaaagcaagcctgaaatgcaaattttcctggatcgacttaacccacaaaggccaccccgttattcgcgtgcagtaatggaaacattagccatcatcgcctaccgacaacccgtcacccgtggagatattgaagaaatccggggggtagcggtttctacacaagttattaaaaccctggaatcacgcggctggattgaaactattgggcaacgcgagataccgggcaagccttatctttatgcaaccacccggcattttcttgatgatctgaatttgcaatcgctggaacagctgccctccctggaaaattttaattccctgaatatatctgcagaggaaaagttaaacgatcagagaatagatcaagagtccggcgagtccagcattcatgagtcaatataattttttaacttcttggagacacgatgtatcaacatatcaaggtaccggccatcggcagcaaaattcaggtaaaaaatgactctaccctgatcgtaccagataacccgatcatcccttttattgagggagatggtacaggtatagatatcacacccgtcatgatcaaagtgatcgatggcgcagtaaaaaaagcatatggtgattcccggaaaatttcctggatggaaatttacgcgggtgagaaatcgactcgcgtctatggacaggatgtctggctgccagacgaaaccttgcaagcagcaaaggaatttgtggtatccatcaaggggccattgaccacaccagtaagcggtggcatccggtcaatcaatgtagcattacgccaactgctggatctgtatgtttgtctgcgcccggtacggtatttccaaggggttcccagcccggtcaaacaaccggagaaagtagatatgatcatatttcgcgaaaactcggaagatatctatgcgggcatcgaatgggaagctggaacagcagctgttggaaaagtaattaatttcctgacaacagaaatggaaatcaccaagatccgatttcctcaatcttctgcgatcgggataaaaccggtttcaaaagaaggcagcgaacgtttgatcaggaaagccattcagtatgcgattgaccataaacggcgctctgtcaccttggtgcacaaaggaaatattatgaaattcacagaaggggctttcaagaaatggggttacgaactagcagcaaaagaatttggcgcagaattactggatggcggtccgtggatgaaactgcggtatgatggtaatgaaattaccatcaaggatgttattgctgatgccttcctccagcaaatcttgctgcgtccggatgaatacgatgttatcgccacacttaatttaaatggtgactatatttctgacgctctggctgcacaggtgggtggtatcggaatcgctcccggagcaaatttgagcgacagcatagcgatatttgaggcgacacacggcacagcaccaaagtacgctggcaaagatcaagtcaatccaggatcaatcatcctgtcagcagaaatgatgctcagacacattaactggcacgaagcagccgatatcattatcagttcaatggagaaaacgatacaagacaaaatcatgacctatgatctggcaagacttacaccgaatgccaggcaggccacttcttcagaatttgggagtgcaatgatacaaagaatgtaatagataaaacttattagattgagattctctgtaatattacttcagtaagcttatttcagaaatcaacccccggcctggcattataaaaacttcaggccgggggaaactaacccgaaagatcggctcttacaccgtcagaatcagggagcttgaatatttgaagcttgcttgccttttggtccttgcgtaacttcaaagcttactttttggccttccttcagggtcttgaagcctgacatattgattgcggaaaaatgcgcgaataaatcctcgctgccgtcatccggtgtaataaaaccaaatcctttagaatcattaaaccattttactgtgcctgttgccatttctacttcctataaaaaactgggccggataccctgatactatttgaatttcaagaccgcaaacggctctaaccagtactgcagaaaacttgaagccaaacgccgattgcagttttacgcaaaatatgtcccaagtcaagcaaagatatgatgttgatgctacaaattttcacttatgaaatgaggcaaataactacctgactaatcactcaagaaaggcaggaactttgtcgtaatcgacccagatgactccgggaaagaaggtagctataaacaccggaaagatcgggttagcggttagaatacagaagtcagtactgataaatatttttcttataaaataccagacccagaacatcgaaaacgtaagccatggcagcaaataaccgaaatcctgaaagtgttatcgaaaaaggcaagaccagattgacccccccgcctttatataaggtaatactgattaatgatgattttacccccatggatttcgtggtaaaggtgttgcgccatttcttcttcatggatgaagaaatggcaacccgaattatgttgaaaattcacactgaaggtgcaggaatatgtggaacttatcctggcgatattgcagccacaaaagtacaacaggtcaatgaattctcaaaacaaaatcagcatccactcatgtgtgtgatggagaaggaataatatgattgcgcaagaattggaagtaagtttgcatatggctttcgtcgagtcacgacaaaaacgtcacgaatacattacggttgaacacctgctactggctctgctagataatcccagcgctataaaagtgttgcttgcctgtacagttgatatcgaggatttgcgcaagtccctgcaggatcatattgcccgccacacaccagtagtagaaggttctggggatgttgacacccagcctactctgggctttcagcgggtcatccaaagagcgattctccatgtccaatcctccggcaaaaaagaagtcaccggtgctaacgtcctggtcgcaatttttggcgagaaagattcacacgcagtttattttttgcagcagaaaggcgcaacacgactggatgtggtgaattatatttcccacaaaatagacaagacagcacagaacagcgaatctgaaaaaaatgaggacagtactgacagcgagcaacgggattcaggcagcccgctggaaagctacaccatcaatctgaacagccaggcagctgctaaccgaatagatcctctgattggacgtgaaaaagaggttgaacgagtcattcagacattatgccgtcgccgcaaaaacaacccgctgctggttggtgaggctggtgtaggaaaaactgccattgccgaagggctggccagaagaattactgaaaatcgagtaccggatgtacttgccaatcatcaggtctatgccctggacatgggggcgttactggccggaacaaaatatcggggcgattttgaacagcggctgaaggcggtattaaaacagctcactgacaaccccaaagcaattctgttcatcgacgaaattcatactctgatcggtgctggtgctgcatcgggcggtacgctggatgcatccaatctgctcaaacccgcactcagctccggacagcttaaatgtatcggagccactacctacaacgaatatcgtggcatttttgagaaggatcacgccttgtctcgccgcttccagaaaattgatatctccgaacctgatatcagcgaaaccgtggagattctgcgcgggttaaaatcccgctacgaaaaacatcataatgttagatacactgaagtcgcgctaacagcagccgcagaattatccgcacgtttcattaatgatcgtcacttaccagacaaggcaattgatgtcatcgatgaagccggcgctgcccagcgagtgctccccaaatccagacagcggaaaattatcggcaaacaggaaattgagcatgttattgctggaatagcgcggataccgccacagaatgtttccaatgatgaccgtaataaacttaaaacactggatcgtgacctcaaggccatcgttttcgggcaggatgcagcaattgatgcgctcactgccgccattaaaatggcacgcagtggactgggaaataccggcaagcctattggttccttcctgttttccggaccaaccggcgtaggaaaaactgaagtggcacgtcagctcgcctatacactcggaatccctctgcatcgctttgatatgtccgaatacatggaacgccatgcggtttcaagactggtcggtgcaccgccgggctacgttggattcgatcagggaggcctgctgactgaaacgatcatcaaacaaccacacgctgtactgctatttgatgagattgaaaaagcacaccctgatatcttcaacgtcatgctccagatcatggattatggaacattaacggataacaatgggcgtaaggctgattttcgtaacgtgatcatcatcatgacgactaacgcgggtgccgatacgctcaccaagacagtaatcggatttaccaaacacgcaaaatccggagatgaaatgattgaaatcaaacggctgttcacgcccgagtttcgtaaccggctggacgctattatctcgtttgcaccactgggagaagccattatattgcgcgttgttgacaagttcctgatagagctcgaagcacaactgcaagaaaagaaagtggatgttacattcaccgacaacctgcgcagtcatcttgccagccatggatttgacccgctaatgggtgctcgccccatggctcggcttattcaagatattatccgccgggcacttgctgatgaattgttattcgggcaactggttaacggtggcaaggtaaccgtagatattggtgaagacggcaaagctgttctcacatttgaaaataaggaaaatgtagctgcatccatcccatcttgaaaaccaaaagaataaaatgaatcttcggatacacttccgtacattcttcattgcacttcttattttcgtataccccctgactgctgatgcagacgccacgtataagtggcgtctggccatgtcttggccggaaggaacgccgatactgcacaatgcggccaggcgtttcgctgaaaatgtcgaaaaaatgtcaggggggcggatgcacattactgtcgatgcacctggccgacacaaatctgctctgggaatttttgattttgtgcgcatcggtgcatacgaaatgggccacactgcttcctactactataaaggcaaagatccgaccaccacattcttcacgacaacgccgttcggcatgacccccaccgagatgaacgcctggtattactacggtggcggactggaattgctgcataagatctatgcccggcacaacattgttgctttcccagccggaaacacgcacattcagatgggaggatggtttagaaacgaaattcactcactgaaagatctgcaagggctaaagatgcgcattcccggacatgccggcgaggtggtagaaaaagtcggcatgaaacctgtcaacatcccgcctggtgaactctatacagcattggaacgccgcacaattgatgccgtcgaatggctgggtcccgccaatgatgaaaaaatgggctttcagcaaatagctccctactattacactggatggcacgaaccgggcgctgaacttcatcttctcatcaataaggaaaagtttgatgcgctgcctgaagatctgcgcaccatcatcgcagtcgctgccaaggaagcctcacttgatatgctgtccgagtccttttaccgcaatgcccttgtctggggaagaatgcgtgaggaacatggcattcatattcgcacttttcctgacgatgtactccaggctttcaaaaaggccaacgatgaactgctgcagcaggttgctaacaaatcaccggttgcccgtgaagtcattgaaagtcagcgagtgttcctgaccaaggcaaaagaatggagcaaaatcaccgatcaaaactatctggagttacgttaattccgactttaaaaatactttcccggaatgaaacagtctgctgcatgcagctatcaacttgactctgatcatttaatacacaacctgatacctatggcggattttcgacaggaatttattgattttgctcttcggtataacgtcttgcgttttggcaatttcaaaaccaaggcaggtcgcccctctccttatttcttcaatgccggcttgttcaatgatggccaatcgctgcaacaactggggcagttctacgctcaggccattcttgcttctgagatccactttgatgccctgtttggccctgcctataaaggcattccactagtcagtactgttgttattgcccttgccaaagctgggtataactatcctttcagcttcaatcgcaaagaaaccaaggatcatggcgaaggtggcaatatcgtaggtgctccgctggtcgggcgtatcttgattgtcgatgatgtcatatcggcaggcctgtctgtcagtgaatctgtcaccatgattcgcgcagccagcgccacaccatgcggcatcatggttgcgctggatcgtatggaaaaaggcaaaaatgaatgctccactttgcaagaaatcagaaaccaatacgacatcccggtcatttccctggtcacactggatgatatcgtcgcttatttacacacccggcacgatcttacctgccatattccagcaatagaaacctatcgcgcacgctacggcgcaaaaatatcggttagctccggacagtagcagcaacaacgctgcggacaggtacatatcacacgtcattccatcactattcttagcctggttacatcttttgtttagctgttattttccccacttccgatcaagttaaaaatatttgctggcttttccaggaaatctgattacaatacaaaacggagagaacgatcagtctacttttatagggaattccagtcatgataaaaaacattattggtcgtctgattcgaaagaacaccactgccccgataatccgtgagccaggcaacgcgctgtttatcccatcaagacgccgattcttgtgtacctgcggctgtggaatgttctatgtcactgctgctggcgccggattgctggctgctgcgacgcgcaccgaagccgctgcgggcggcacggtcattcgtgtcggacatctaccagcaggctgcgtctctcatctgctgttggcaaaagtaagaggaaagtttaccaaagcagggctgaatgttgttctgacgcaattcaacagtcccggtgatgctatgcaatcactgatcgccaataatcttgagataatacacagcccgtggaccatgacagcagccgcctacaccgctggcactaccgacctgcgcattattggcggctccggccaggctggcatcgagctggtcgcacgcaatggctcggtcagatctgtggaagaatttatcgatgcagcaggtaaagggctgcgtgtgggaaccttgcggctagatacgctagagctggttggatacggcaccatgtcacaacatggtaaatcctatgacgactaccacatgaccttctttccgagcatgatcggcatgggagaagccattgccaacaaggtgctggatgtctgcaccttggcgcaaccttatgctgagcatgttgtcgctgaacaaggggcagtttatttgactgattccaactcagtatggggacctgaagcggcagactgtgttgtcaccaccagaacccgcactattgatcatcagcaggatgtgttgagaacctacctcctggttctgcaagaatctgcccgagcctttgctgaggattatgaaacagtactggatgatttacagcctatctatggtgtaccacgaccgatattatccgttgcgctcaaacgccagttccccaatccggtcatcagccagacgggggttaacggcctgcgtcagggagcaaaatatctgaccgaactgggttatctgaagccggatgtcattgataccgttctggatctgcaataccagccggcctgacgccatgaaacctcatgtttcagaaaaatccggtcaccagctcacgctaactggccgggttagccaactgctttttaaatcaaatttcctgtggttttgtctggcctggttgctgatcattctatcctgggagcttggttcctggctggaatggttaaatccgcaaattctgccccctcctagtgaaactattccgtatgccttttccggcaacatcaccatcgggttcggtcagcagaaaaccgggttgtttgagtctactaccatcacgctggggcgcgtgggtgccggtatgctgatcggcctcctggtttcatcctgcctcgctatcatggtgattgagctgcccattttgcgacgattgatcttgccccttgtccagtcgcttgcacctatcgcaccggtggcctggatccctttcaccatcgttgttattggtattggtggcccagccgctgtattcatcgtattcatggcggtactcggaaccatgacgctctcgctaattgccgcactagatagcatcccggatgaatatctgaaaatcgcccataatttgggtacctcacgcatccgtatgtggtggtatatacggctgcccgccatcatccccagcacaatgacagccattcgcatgtcgttcttcggtgcctggatggctgttctggcaggagaaatggctggcctcaactccggcctggggtacatgatcatcatggcgcagcagatgtacaacatgaaattagtcatggtcggcattctcgccattggcttcattggttttgccattgatcgcctgttattgctgatcaatgccagactattgcaatgggtgcagtaaatccatgaacacaataccttcttcctcatccggcgctcggctagaattcagtaacatccgtaaatccttcagcgatactgtttctgtagaagcagataggctcatcatagaaccgggcagtctgactgtactcctcggccgcagtggttgcggcaaaacaaccctgctcaacctcgctgccggactggattttccagatcagggcaacgtcagctacgataatcaggtactgcaaggcccggccccttcgactgcgctaatttttcagactcataatctgtttccatggatgacagcggaagagaatgttgctttcccgttgcgtaaccaaggtatggtaagggtggaagcactggaacacgcaaagcaatatctcaaacaagttgggttggaatcttttgccggccacaagccttcacaattatctggcggcatgcgtcagcgtatcaccctggcgcggaccatcgccaccaaacctcggttgctactactggacgaacccttctccgcactggatatgcaaactcgccgcatgatgcaacgctacctgctgcgtgtctggagtgattctgccgccaccatactgatgatcacccatgatctgcacgaagcactcatgctggcagatcgtatcgcgctcatggcctcatctcccaatggccatattgcagaaattctggatattgaacttgatcgtccccgcaatccagaaaaccagtccttccgcgttatccagcaacaacttgaccgcttcctggaacacgaaaccctcctggcagaacatgcccccatcctcgaagcaactgatcagacaaaccatctgtaaaacagtaaaggcataagatcgccagggttctccccctacgctgcactcacatctcgacgaacaaccgagttaatatgtaacatctgacattgcagcagaaggaggatgaagtatatgaagacacctcgtttactgatgccctacttgagagatctgcccgctgatctgctgccactggtcgaacagattgcaagcttggcaatggatttacgttggacatggagtcatgccggagatgcaatgtggaagatcatggatccgcagctgtgggagcaaagtgaaaatcctttcgttgttctgcaaaatctgtcgtatgaacgcttgcagacactgaaccaaaacaaggaattcaggcaatatcttgatcacctggtcaaagcacgcaacgattactgcagttatggcggatggttcggtgaggtgcatggcgacgtcaaattgcgaggagttgcctatttcagtatggaatacggtctgggcaaggccttgccactatatgccggtggcctgggtgtgctggcgggtgactatctcaaggcagccagtgatctggctatcccgataactgcaattggcctgctgtatcaggaaggttattttcggcagatgctggataccagcggctggcagctggaaatctatccatataatgattccagcagcctgcctttgcgccccctgctggcccataacggcacctggctatccattccaatcgaattgcccggacgaacagtacaactgcatgtctgggtagcacaggtggggcgaatcaacctgtatttgctcgacagcaataaccctctgaacaatgcacttgatcgcggcattaccggcaagctgtacggtggtggggaggaagtcagactgatacaggaaattgtgctgggaattggtggctggcggctcatcgaaacattggagctggcaattgatgtctgtcacctgaatgaaggccatgctgcattcgttacactggagcgtgcccgctgttttgcgcagaaaagacagatagatttccaggaagcgctctgggcaacacggcctggcaatctgtttactactcataccccggtggcagctggttttgatacctttccgcgtgaactggtcatgaaatacagccagccctacaccaaagacccgggaatgccattggaagagttgatggcgctcgggcgtagcaaccggcaagatgagagcgagcctttcaacatggcttatctggcagcacgcacctgcggcagaatcaacggtgtcagccgactccatggccaggtcagccgaaatatttttcagaaactgtacccccgctggcccgaacgcgaagtaccggttacgcatgtcaccaatggcgtacatgttccatcgtgggattctccctgggcagataaaatctggacacttttttgcggcaaaggtcgctggctgggttcagaagaagcactctccgctgaaatacgcaaactggatgacacgacgctctggactttgtgcggccaggagcgcgctgatctgatacgctacgtccggcagcggatgcaggtactactgggacaaaggggagcagatatggaagccgtcaatcaggttggccggattctggatcccaatgtgctgacgcttggatttgcacggcgcttcactgcttacaaacgccccaacctgctgttgcacgaccgcgaacgccttgccagactgctgacacgggtagatcggccagtgcagctggtggtagccggtaaggctcaccccgctgataatgaaggcaagcgcttcatccaggaatgggcacagttctccagccgcccggatgtgcgtaatcatgttgtgtttctcgaagattatgacattgcactggcgcaggaaatggtgcagggagtagatgtctggatcaacaccccgcgccggccgtgggaggccagcggcaccagcggcatgaaagtactagccaacggcggattgaatctttcggaactagacggctggtgggccgaggcctacactcctgaaaccggttgggcactgggtgatggccatgaacaccacgaaccgggctgggatgcagtagaggcagaacagctttatcacttgctggaaaaagaaatcgtaccgatgttttacgaccgcgatgccagcggcattcccggaacctgggtagcccgtatgcgcgccagcatggcacatcttgctccgcagttcagcagcaaccgcatggtgcgtgaatatgtcgagcaactgtatcttcccgcagcggccacctttcagcatcgaacaacccctggaagctctgccgcgcaggaattgcgccaatgggatgaacaactgaaaaaaagctggcacgagatacactggggaaacctgatcgtatccagagatcaggaagactgggtatttgaagtgccggtttatctgggaggtgtatcacctgaattcgtacagattcagctctatgctgatccggttgctgaggagcctcctgtttgcgaaacaatgcagcgtggtgacgagataccgggagctatcaatggatatctgtataaatcccggttaaataccgaccgtgttcataccgatttcacgccacgctgcgtgccgtatcatcccgatgcccatatcccgattgaaagccacctgattcattggtggatcggaataatggccccataaaagcattaatcccggattttcatcagattctggcaacgcaaggaacactttcaaaattgacaaggttgctcaacgtaactacttcgcagggaagagagcttctccattgggataaaaaatacagattaatcactaccacaccactatcactctcccggaattacccattacaaataccccagcggcatagcacgcccctccctgcccagagtatggaaatagcccgcgattaggtgattatttacgtgatcaaatcctctggagattacccataatgcgctggtattaattaatatccacgcaggagaaatcatgagcgaagcgactgcagcggccggcacgggcaataaaagtaaactgatcctgttcatcctgatcggattactgtttactggggcaggcatcggcgggacttggtattttatgaaaaaacagcatgaagaggcgggatcagaagctgtagtcgaaaagaaaaaaccgacagcttttgtcaagatcgaatcttttaccgtcaacctgcagccagaagaaagggaatctcactatctgcaggtggaactatccctcaaagtaaacgaaaccgcagtaatcacggttatcgaaaacagcaaacctgaaatccgcaatcagattctgttgctgctatccagtaaaaaaccctctgaaattaatacgttggatggaaagcagaaactcagccaagatatcattcaggcgatccgatcaaagattggatctgaagccctgcaaaatgacattctggatgttttgttcacctctttcattattcagtaaaccctgcgcgccatggccgagaattttctcactcaggatgaagttgatgcgctactgaattttgataacggtaacaagcatcagcaagcagcccagaaggaaaacgaggttacctatccgggcggtatccgtccttacgacatggccacccaggagcggattgtgcggggacgcatgcccgctctggaaattatcaatgcacgctttgccaattctctgcagatcgggctctacaattttttgcgccggggggtagatatttccgctggctcaataaaaaccatcaaatacagcgaattcacccgttcgctggtcgtgcctgcaaatatcaacatggtcagcatgaaaccattgcgcggcactgcactgatcaccattgatccgaacctgatatttctgatcgtggacaatatgttcggtggagatggtcgttttcatacccgagtggaaggacgtgagttcaccctgaccgaacagggcattatccgacgcttgctggatgttttattcgaaaactacgagaaagcctggaaatctgtctacccagtcaaatttgaatacatccgcgcggaaatgaatccgcaatttgccaatattgcgacaccaaccgatgttgttgttgcaagctcgtttgagctcaatctgggcggtaatcgtggagagttctacatctgcaccccctacaccatgctggagccaatacgtgatctgctcaacaacagcatgcaggaagatcatgcggaagttgataataactggatcaagtcgctaaccagacaggtacaaggcgcagaaatagaaattattgctaatctcggccatacccgggtgacattacaccagatcctcaacatgcaggaaggcgatgtcatcgcactcgatattccggacacagtagttgctatggcaaatggtgtaccgatcatggattgtcattacggcattctcaacgatcactatgcgcttaaagtcaagactgtacgaaccccagctgaaactgactgataattaaaatcaaacatcggagcagaacatgaatgaaccgatatcaaccgaaccacaaaccgaacaggatgactgggccgccgccatggcggaacaacaggctgctgaaacttgttcggttatcgacgaagctagcgaatcatcagccagcgcatcggcccatataccagacgaggatctgacaaagccatcttctgttttcgagcagttttccaggaataatgtgctgaacgatacccgcaacgatatcgatatgattctggatattccggtgcaactgacagttgagttgggtcgcacccgaatcgccattaaaaatctgctgcaactggcacaaggctccgtcattgagctggatggtatggcgggcgagccgatggatgtgctggtcaatggctgcctgattgcccaaggtgaagtcgttgtcgtcaatgaaaaatttggcattcgcctgacagacatcatcactcccagtgaacgcatccgcaaactgaaccgctagcccacctctggattgattccatacccatgccacgcataattgtccagattggcagcatactgtggttaccccaacaggtgcttgctgagtccgtgcgaaatcagggctttaccccgccctccccggtaatttccagcgagaatatgctgcaactatcggcaggattgttcattgtgctggcatttattgcactaattgcctggttgttcaagaaaatcggacttaatcctgccaatcggacaggtctgttaaaaattatctcgtccgccagtatcggccagaaagaaagagtagtgattgcagagattgatgatatctggctagtgctaggtgtcgcaccaggtcaggtcaacttgttgcaccagatgcacaaaaaaccctccccatctactgaaacagctgagcctccctctggcaacggttttacagagaagttgcaggccaatctggggcaagaccatgagcaataaaaacctgctatgcaaacgaatcgttatccggcaacactccatcggttgcatcattctgctactggtagtgggtatcagcccggtatttgcccagaaagcaggacttccggccatcaccagcacaccagcggcagggggaggtactacctattccctcagcctgcaaactctgctgctgctgacttcaatgacatttttgcctgctactgtcctgatgatgtccagcttcactcgcattatcatcgttttgtcattgttgcgacaggcgctgggtacgcagtcatctcctcccaatcaggtgctggttggtttggcactgtttttgtctttctttattatgtcgccggtcattgacaaaatgtatacggaagcatatctgcctttctctgaagacaagatcagtattatcgaagcaatggacaaggcaagcgatccactcaagaccttcatgctacgccagacacgcgaaacagatattgcactgttcgcccggatttccgggagcgaggaaatcgaaagcccggatcaggtaccaatgaaaatcctggtacctgcctacatcaccagcgagctaaagacagcttttcaaatcggatttatcgtctttatcccttttctgatcattgatatggttgttgccagcacactgatggcaatgggaatgatgatgctgtcgccaatgattatctctctaccgttcaagctgatgctgtttgtactggtggatggctggcatctgctgattggttcactcacccagagtttctatacctgataaggagatcgccacatgagcccagaacaggcaatgactatcggccgacaggcgttggaaattacattcacaatcgctgcacctttattgctggcagcgttggtgacaggtctggccatcagtatcttccaggctgccacacagatcaatgaaatgactttgtcattcattcctaaactgctggctatcttccttaccctagcgctggctggcccctggatgttacaaatcatacttgactacattgaaaggctttacaccagtattccctggattatcaacggtggataggccgttacaaatacacggaacggcagctctctggtcacatttcttcacagcttgagaaatcacctttaacagcgttcaaacaacaggttatcgatccatgttcagcatcaccaccgagcaactgaacggctggctgattatcctgatctggccactggccagaattctcgcactcatgactgccaccccactgctaggcagtagcagtatcccaatccaggtcaaactggggctggctgtactactgactattctgattgcccctctgctgcccccgctacctcagattgacccaggctccggcgtgggtctcattgtcttgctgcaacagattattattgggctggcgatgggtttctccatacgcattgtttttactgcagtagaaatggcgggagaaattacagggttgcagatggggctcggttttgcaactttctttgatccgcagcaatccggccaggttcagctggtcggccgtttctacggactacttgccacactcttgtttctggccatcgatgggcatttgcaggttattgctgtgctcgcacagagtttcaccatcttgccaatcggtgcagatgggatgaatgttacttcattcacaattcttgttaactggggcgctgaaattttcacattgggattacatctggccctgccagttctggcagctttgctaatcaccaatcttgcactgggcatcctgacacgcgctgcgccgcaattgaatatttttgcagttggatttccattgacgctgggaatcggcttgctggtcatgtcatgggccttgccttattttactcctgtgcttacgcaaatgtttcaggaaagcttttccatcatgcgttcactcgccggtgggagcgtcaatgtaaccggcataccataaacccggttccggaaatctatttacgctatggcttatctgtgacgctcacattcttttaattaactaggtttttcacctcctttttagtcgattgccatgccacagtgattgataaggtaagcgccgttcccacatttttctcgataaacggtatccgccatgctattcaaatctcatctcagatcgattttgaacatttcaccacaaccagaaaatgaggctgaattaaacgttgtccccattcataccggcaaaatgccatccgggaacgaactcccacagataaatgatcctttcgggcaagaaggttgcgactcttcttttgatgacagtaatgcctcacgactggaggctgaaaatatcgcgatccgcgaggccaaaggtcggattgaaaccgaggcccgcgcacgtgttaccgcagaagcacgtgcgcgggtagaagccagtgctagactggccgccgcagcacgcatcaaggccgaaacagcagccacggaagaagccagggcacgtgctcgggcagaaacattggcggcacaggaggctcaggcacgccaagagctagaggcgaagttacgtcagactgttgaagacagccttagagcagaaaaagcaatcgttgctgctttgcgtgccagagtacaaactgaagcggccacaaccgagaaagcacgcaggcgtgcacaagaagaagcgctcgctctggaaaaatccagagaaaaggaattggcagagcaaaaagcaatagaagcaaccattgcccgcagaaaaaacagtgaggaagcactgaagatagcgcttgccgcctcggcagcagaagcagaagcagcaacactggcgcgcaccagagctgaagaggatgagaaaaaaattgtgctggcaaatgccaaagccgaagctgaacgtcagactatcgaggaaattagattgcgcacagaggctgaagccaatctggcctcacaaacacaagagaaattacaggcagaaaccagggcacgggaagctgaacaagccaaactggatgctgaaaaaaaagcggctgagacagcagatgcccgacaaaaacttgatcttgctgcaaaatcagaggcagagggccgcactgcaaccgaactggaagccgcagctgcggcacgcagcaggatagaggctgaacgaaacgctaaaacaatcgcggaacagcttatccagatcgagcaggaggctgaacaggctgccttggaacgcacccggaccgacactctgctgctggaaaaagcacaagcccgcatcattgcagaaaatgaagcacgagttgctgttgaggctcgcatacaggcgaaagaacaggaaacagccatattcaatgaaaaaacacaagctgatctggctattacggacgcaattcgggaacgtattcaggcacaggaagtggcgatcaaacgatcccgcgctcgtgctgctacagaagcagtcgccaagaaaaccgccgaagatagaatcgcagcagaaacccatgcagcaaaactggctgatgaacgaattgcactggacaaacagcttgaaaaagaagccaatgagctggcagaaatggaagcacgcctgatcgaaaacaggaaaaaacaggcggaagccgttcagcaagccaagtcagcagccagagtacgcatggaaatggagccaaaactgaccggactcgccacgaccattgcacagaaccagattatcgccatggcaaaagcggaagagcggctccaggcagctgaaacaacggctaccacggtactgtataaaatccggacagaggcttcagccctgatggcaatacaagcacgcatagagcaggatgcactggctgtcgaacgcgccattgcgcgagaagcggttgaaaccatggctgtagaagccgcacgggcacgtattcaggcagacgaggctgcgattgcactggcctctcggaaaatacgggaagaaattgaaacaaccagaattattcaggattgttccgacgaagaaatttcacccgatatagtcgtagattatgaagagcattctactcacccctcttctgataacagcgaaaccatgttggcagatactgaagaaggaacggaaaaagaagcatctgctgaatttattgagcctgatgattcaacaaatcgactggatttgaacacacccggtaattcacttcaattagatacactcgacaactcaataaagcctgatgaaacagcagtaccattagataaatccaaaactgctgaagtagcataaccttgcaacttaaatatcaaaatagcagcatgatacgcaatgtatctagctgcaatttttcagggtcggactaacaacaatactaaagaatcaggaaagaatgacatgctgaaagccttatattcaactgtactgccgctgacactggcaattaccagtgttaccggatttaccatgcacatgcaggaaaaaaccatcacactccaggatcaaaagcagatcggtgttacgatctacaatgaaaacctggcattgatcagagatctacgacaagtttccatggaacaaggtataaacaggctggtttggcgtgaagtttcagcccggatacgtccacaaacagtactgctgcgcacaccggggcaatcttccgaatcccggttgctggaacagaattttgattttgatctgcttaccccggaaaaactgctggaaagctatctcggacgtaccgtcaatgttatttacaccaatcctgtaactggaaaagaaacaatagaagccgccaccgtactctccacccttgggggagttatattgaaattcacagatcgtatcgaaaccggtactacaggacgaatcacctttccggatatccccgatcacctgcatgatcggcccaccttgtcactggtactggagaatacttctccaggaaaacgtgaactcgaattatcctacctgacctccgggctttcctggcaggctgactatgtggctaaactcaatgccgatgatagccggattgatctcagcggattaattacgctggccaaccatagtggcattgcgtatccggatgcccatctgcagctggtggccgggaatatcaatcaggtttccttcgagcaaccccagaccagaaaaatgatggccatggtggctgatgccgccgaatatcaggagagtaagcaagaatccctgtttgaataccatctctacaccatgcctgcctccgcaacgctggcagaaaaccagacaaaacagattacgctgatgacagctgcagatattccggtcaacaaggaatttctactgcgtggtattgaagcccattacttcagcagatataccggcgacgataacaaactgaggccggatgtttttatccagtttgagaacaagggaaaagagctggacaagccgctacctggaggaacagtgcatgtttacaaaaatgattcccagggcaatgcgcaatttttgggtgaagatcgcattaaccacaccgcgaaaaatgaactcgttcgtgtgaagctgggcaaagctttcgacattacagccacgagaacccagacggattttcagcagctggataccccttctcaacatttcactgaaacagcccacaagattgaaattcacaacacacgccaggaagcagtcaccattcgagtacaagaacccatccccggtgactggatagtaatttcagaatcttttccccataccaagccagccgctaacctggctgaatggcagatcatcattcctgacaatgagaaaattgtgctgagttaccgggtccggattaaacattgataaattccgtctgctgtttgcattgtaggctgcagatctgattactcgtctgaaggtatttattacacctgatttctgaattgcagcagaaagtttctgaccaggttgatttgttctgtatccatcagcatgggcgcatgaccgataccagccagttcaacgaactttacattgggctgatgtaattgcatttcactgactgtttccggtgtcagaacctctgatttttctccccggagcaccagtatcggaagatcaagccggttccagtaggaccatagattgagatctctcaaatttgatggacgaaaaccagatgagatgacaggatcatagcggtagccaattgtgccatcctcatattcacgcgcactgtacagcgccatatggcgccattgcacatccgtaagcgcattatagggcagtgccgtattgcgcatgtgtgtttccagttcactcaggctctggaaacggggatcttgcccgatagtcatggcaaacacagataggatagcagatgaaacaaacgggccaatatcactcattaccagcgccctgagccggtaaatggctgacaaacgctgccgggcagccagcaacatgccaaccagcccccccatggacacacccacccagtaaaagtgaaggcaatcatggtggttttgccggtaaatatgtttgagcacacattccatgtccgacaaataagtcatcgcagaattgtaatcctctgcgttttccagccagtcactgcgaccacgccccgccagatcaatacaaattactctgaaatcttgctccagggcctccgccagaaaatcaaaatccctacagttgcgtgtcaggccatgtacacataccactacatgatgattttccggatttccccaatctgtataggcaagctgacggctgcctcgtccagattttgcttttccgggttgtgccggtacagacagatatttccacgatatatccgaagggtttttcataggaaatttttcagaatgatgcgtaatcatatcaaaacgagtttgctgaaccgcaatcgcacaaataccaatcagtttatacaaccggacaatcaaaaaagaacagagataaccagagcagcagtcaatgcagtactttctgcaaatttgatagataataagaactaagaatagctgatctgagtagctctaccctctgctaacggatactgactgtatagttttaaagtcagcaccttggttaacagaaataatggaatagtcggttttcctaaatcagtgcctacggagagcttttgcaatccgcattctcagcgcattaagtttgatgaagcccgctgcatccgcctgatgataagcccctccgtcttcctcaaaagtagcaatcgtgggatcgaatagcgaatctgtccgggaatcacgcccgaccaccatcacgttacccttatagagcttgacccgggcttggccatttacatgtgcctgggactcatcaataagtacctgtaataattttctttccgggctccaccagtaaccgttataaatcagtgccgcatagcgcggcatcagatcatccttcaaatgtgcgacttcccgatcaagagtgattgattcgattgcacggtgggcacgcagcataattgtgccaccaggcgtttcatagcagccacgtgacttcattccaacataacggttttccaccagatcaagacgcccgatgccatgtttaccgcctagctggttgagttttgttagtacggctgcaggagatagtttctcaccgttcaatgcaacaatatctccccgctcatattccagatccaaatattcaggttcgtttggcgctgcttccggtgaaaccgtccagcgccacatgctttcttctgcttctacagcagggtcttccagtgcacgtccttcataggaaatatgtaaaagattggcatccatactgtacggtgatccctgctttttcttcatttcaattggaataccttgtttctcggcatacgccagcagtttttcacgtgaagtcaaatcccattcacgccaaggagcgataacacggatatccggctgcaaggcgtaatacccaagctcgaaacgtacttgatcgttgcccttcccggttgcgccgtgagagaccgcatcagcgcccgtttgctgcgcaatttcaacttgacgtttggcaatcaacgggcgggcgatactagtaccaagcagatattccccttcataaaccgtattggcacggaacatgggaaaaacatagtcgcgtacaaattcttcacgcaaatcttcgatgaaaatttccttgataccaaactgtagggccttggcgcgtgccggctcaatttcctcgccctggccaatatccgccgtaaaagtaaccacctcgcactgataggtatcctggagccatttcagtataaccgaggtatccaacccccccgaaaatgccaataccgctttcttaactttatccatatctctttacaatcaaaaaatttacaggtaattaaaagattacctgacactaattctgcccagcagcaagtactccatcaacgccttttgtgtgtgcagccggttctctgcttcatcccataccaccgattgggggccatcaatgacttccgcatccacctcttcgcctcggtgtgctggcagacaatgcatgaacaaggcttctttttttgcacagaccatcatctcagcatccacacaaaaatctgcaaaatcatttttacgcgtatccaactcgtcttcgaaacccatgctggtccacacatccgttgtgaccagatcagcatctttcactgcatcgtgcggcgagacaaactgttcatagtgatctgtgccatacaaacccgcccgttcgggctccacttcataacctggtggtgtagaaacatgcacattgaagtcaaaaatttcggcagcttgcagccaggtattgcacacgttattggaatctccaatccaggctatggttttgcctgtgatacttccgcgatgttctatgaaggtaaagatatctgccagaatctggcaaggatgatattcgtccgtcaggccattgatcaccggcacccgtgaattctcggcaaaacgttcaataatttgatgctcgtgagtacgaatggtaatgatatcaaccattcttgaaataactctggctgcatcctccaccggctcgccacgccccaattgggtatcacgtgttgagagatagatggcactgccacccaactgatgcatgcctgcttcaaatgaaaggcgcgtgcgcgtggagtgtttttcaaaaatcatggccaacgtacggtcagtcagcggccagtagcggcgatattgcttgaattcattcttgatccagcgcgtccggtcgaacaggtattcgtattccaaccggtcaaaatccttgaactgtaaaaaatgcctgatctgcataaatgatttctaccaacaaaaacatccggagatttttatatttctggctctctatcaggtagatgaaacagaaatcacttgaatccggaaaagtaaaaaaggcgggataaccatgtagcgagaaaaaatctttcgagtgcgctctggcgacaaccgtcggctcacacccttatcattatttctctcgattctcaagaaaccaggaaataagagcggatacctcatgtaccacctgttctgcctctgccttttgcatattcaatgccggcagtaatcgtactactttttcagatgttacattgatcagcaaatggcgtttcaatgcttcaggcacaagttcaccacagggtatcggcagctcaaccccgatcatcatcccctgcccgcgaattttcagcacgttttgccaggcgtgtaatttctgcttgaattcctcccgcatgaaattaccgatagtcacagcattagccatcaatccttcctgctcaatgatgtcaagagtggtcaaggcagctctacatgcgagtggattgccaccaaaagtagatgcgtgattaccaggcttgaatacttctgctgctttcccgcccgccaaacaggcgccgatcggcaggccggatcccaatccttttgccagtgtcatgacatccggtacgatatcactatgctgaaaagcaaaccacttgcccgtccgtccaaggccacactgcacctcatcaagcatcagcaaccaaccgttctggtcgcagatcttgcgcaacccttgcagataatttgcttgtgggaaattaactccaccttcgccctgataggtttccagcagcaccgccacaatttccttgttattcgctgcaaccttgttgattgcctccagatcatcatagggcacacgcacgaaacccgtgagtaacggctcaaaacccgcttgagtcttgcgattacccgtggcagtaagtgttgccatggtccggccatgaaatgagcgctccataacaataatcgttggcagatctattccctggttatggccgtaaagccgcgccagtttaatggctgcctcattcgactctgctccggaattacagaaaaaagccttctccaggcctgacagactggtcaatctgtctgccaaacgctcctgattctgaatgtggtagagattagaggtgtgtattaacgtagcagcctgttcacacaatgctttcgtcagtaccggatggcaatgtccagcgccgcagaccgcaattcctgatagcgcatcaaggtagcgattaccttgatcatcccacagccaaacgccttctcccctgacaaaggtaacgggaagccgtgcataagtattcattaaatgagacacagaaaacacaccctattttttgttctgaaacaacacggtggctggtgccaccactcctgggaacaggttccctcattcagaacctctgaataaatttatacgcaaaaacaacatagatttattcagaagttcctttacgctttagcgaaacaatattcacttatctatcaagtcatttcaagcagtttttctgttagatattctggccgaaatcagccatctatacctcgccagatcactttttttgccaggagccgttctcttgctgataccaccagcctggtttggcccactttatccatcgttgggcaaatgttgaacgaatattgctttcccattccggatgattgttagccagtgctatttcccgataaagtgcattacgatcttggttctcggccgtcacaagcgtattaaccgattgccgtcctgataaaggtacaacactggcatcacgcaacacgatcagaccgtcacgggtcaaacctactgcaccactatcataaaatggtatcaattgaccgtgacgctgttttatattttgttttaactgggtaactgctggtgaactggctttaaaatccaccgcactcgcaaagctgatacacagaaagaaacccagtgatattagtgttatataccgaattaactgtctatgcacaagattcacatcctcagaagatctttcatggcctggtcttgtcgggtttattgtcaattttattgttgcgagtatcattacccgatttttctctgggttgttccctgccatcagcctcatcatcagcctgccaaacctcatcgataattttgtcggccactttctccgcggctgctgccggaaagtaaatattgatagttacgcaagctgctaccacaaagccagcggccatcagcaaaatcaggttggaattgcgatttgtcattatcatttagtgaatcaccgggttgccactttcaatggcgcgctccagacgcttgagcagttcaggccagtccacctctggattatagccggtaatggtaattgcaggtattccactacccttgaccagcacatatcccttgtcatcacgagaagccgactcaatcccgctcatataacaaatatgtccacgtaacttacaaccccagccaatttcagtgtagcgaaattgttcaaacatactgagaaaacttttctggatagctgtcactgcagattcgccacctaatgcaataatattcttgatcgctgcctgactgatccgacgcttgtaatctcccgcgctactggtaagttttgcatcaaatcttaccggttcccagttaaccagctcaagatcgttcacctcaacatcaacccgtccctgtatatttccaaacgaataggcacgggtcaacaaatcaagatcgatatgatgcatggccacatccgctgtcagatgaggggtcaagctaagtggcttggtcagcaccaaattcctggctaccgcgacaccgtcgaatatccctgaaacaagctcgccttccattgttatagttgaattggtatagctcattttcggcatagtacccgacagcgttccaaacattggttgaatctgcaggaattcagtcagtttttccatagagatcggaaaaagttgcccgtttaactgccattgccagccggacgtctgcaaagaagctatgaaattttctatcagcagtcttccatccagtatcggcacctctgcacgaggaatattgagctgcatcccgtttgtctcgattggaatatgtgttgtacccagcggaatcctcaagatctgggcattactgaaccggattaatccatccagcgcctcgtttcgattccatggtacataggcgtccaatccttcaactgcaaaccgctcgcgagtatcggttaatgatacattctgcaaatcaatgattagtgactggtttgcattatcctggtaatgccaggcaatatttaccttgccggcagcctctgtttctgccagtgccgtctcctcagccaggggtcgaataatactaccaaacaaagtggataactccaggctctcggccgacaatctagcctgctgtattgcttgatccggaatgctggcaatagcagaaaaatctgctttacctatacccgtcaaactgagttcaccttgtgataggttgatatgatcaccttttattatccctttggcggttaattggtgcccttctccagaaaaataaaatggctgccaaaagacctctccttccggccagatgatcttgcctctccattgccaaacatcctgttttcttcgcacatccaggtcaagcaacagattgatccgttcacccacgtgcaacccgctcgaatcgctgaaagataatttattgatgctcagctgtgtggataacgctgacattgaagtcttacttccattcaggtagatacttccattaagttttgcctgatgtatctgtagtgaatcttcttcttgaggcaacaaatcggccaaaaattttccctctccatttacaatcttcaacacacttcgccacttttctgcctgccagtcgatcatcagctgccatttctctcccgaattttttttcgggaatggatgaacttcaagtacaagctgtttatgttgcaaggaaagctggaaagttattgatgaagatagcttgccaagctccaatgtccccatttcacagccaattaattcgcgattaatacggacttgattacatctcaaacgaaggtcatgccatctccaatttcctgcgagcaactcacccacattgatttcaagaacgggcgataagacgccagtcagcttgatgctggctgagtgaatattaaaggcaggatgccggatattctccagtacaaaattaaaataagggaccgcagcattagccggagaataacaacctgcgtaaagtagaaaaaacagccagaggcgtgtagcaagcctgcagatacaagccggaatactgacgcgacgaaaccagagatacctcggctccatgctcttcaggaaggaaaaactccggttgacaggtaacgatccccacggtcacacacaatagaaacaatcaccgcgtttcttacttgagcagaaagtttcagcactgctgccagtgcccccccggaagaaatgccagcgaatactccctcttcagatgccaatcgacgcgccatgatctcggcctcttgctgggataccagcaaaatacgatcaacaagttccgactgataaattttaggcaaataagcttccggccatttacggattccgggaatctgggcaccttcttgcggctgtacacctacaatttctaccttccgctctttttctcggaagtagcgggcacaccccatgattgtgccggtcgttcccatactgcttacaaaatgagtaatcttgcccgcagtatcctgccagatctcgggagcagtaccttcgtaatgtgccaacggattatcgggattggaaaactgatcaagaataaaacccttgccagcctcgcacaattgtccggcgacatcccgtgcttcctccatattttctgtcagaataattttggcaccgtacgcagccatcacttgacgacgctccagactctgattttccggcatgaccagaatcatgtgatagcctagtattgctgccgacatagccaatgcaatcccggtattgccgctagttgcctcaatcaacgtatctcccggctgaatatctccacgctgctgagctcgtatgatcatggagtaggatggccgatctttgactgaccccgccggattattaccttccagttttgccagaataatattgctggttttccccgggatatgtttaagctggaccaagggggtatgtccgatgaaatgttcgatagttttatacatgaccagatacgtgctgccacaaataaatcaggattatctcatacacatacaaaaaaccccttgtgaaaggaattcacaaggggttcagtcaaggattagcctgaaagaaatagcatgctagcactgtctcgtcacaggctttcaaacaatttcttcgcctcatctttctgagaaaaaggtttatcgctactcagtagtttctcaagctcctggcgcgcttcaaccgtattgccagatttatatagtccaactgcatagtgatagtggacttcagcagcttccggaacagctgcaacagcctgttgcagcaaggaagtccctcgttcggcatccccttgctcaaccagaatccatccaagtgtatccaggatcgccgggctatccggagcctgcttgtatgccttctcggcataatcgagcgcagtagcaaaatcttttttctgctggtatatccaggctagattattcagtgtggcagcatgatcaggatgttgcttcaggatggttttgtattccctaatagcaggatcatattttttgccggcaaggtaaacacctgcaagatacatacgaacgccatcatcagccggattttccttcagccattgcgtgacacgttgatcagcctgcttttctttcccgctttgactcagagctgtatgcaatttgatcaataattgactggttttctgtttagtcagcgcctcttcataagccgtggcagcggcagctgcatttttctgccgcatttgtaaatcaccctccagctcaaatccaaccggcagcttttcatgttgtttttgtatatcccgcgcgatactgagtgcatcatccacacgaccgtctccaaccgccagttgagcctgcatcagtttagcttcccagaaatccggcttaatagccaacgcctttttcaatgaatcagccgttgccctggtattctgcatagaggcatagatctgcgctagttgaagctgggcaggggcagaatctggtaatctggcagccagtttctggaaattttccagtgcagcatccttatccccagtagccagataagcacgagccaacagctctatgacgctcaaattatccggatgaatgccttgcagtttcttggccagcgcaagcgattttccaggttcattgatggccagataatgcgctcccagctgcaaagctggcggcagctcatccggattctcctgactggctttttccagccattcagttgctttttctttatttccttgtgagagcgcgatacctgctagcgcattcattgcctgtacgtttttcttatcctgcttcagcacttcttcaaaacgctgctgtgcagcttcgggatgtttttcctgtaaatcaattctcgccaggttggaaatggcgggaaaatagtctggctgtatggaaagcgcctgattgaagcttgcacgcgccttgatcaggtcttttttgcccagatagactccaccttccagattatgtagcagtggattgtcaggttgctcggcaagttgtgatttgacagctttcagcgctttatcaaattcacgctgctgcagataagtcaaaacaagcataatacctgcccggccggatttatcatccagttgggtagcgtgttccagatcagcaatggcactttcattttccccctgccccattttgctcatagccattgcggtatataatgcagcgttatccggagataattcaccagccttctcaaaatactccgtggctttcgtaaaatcccgcgcccgcatataggcctcacctgccagtgcaaacaattgtggatcctgttgtactaccttcagcgccggggtcaaggtagtaaccgcctgttttgcctggttattcttcaactgaatcgacgccataagcttaatggcataaagattattcggaatcttcttcaagtattgatcaacatactgctctgcttgtggaagcgaccccaatgcaaactgggtggcccccgcaagtaatacactgggaagatgatctggtgctgaactcaacacctgttgcaaagtttcaagggcaaccgcatgtttaccctggctaaaatcgagtaatgcctgtgtgtatgcagcaggcaggctaccgggagcaatcttgcgaacggcatccagatctgcttgggcagctttaaattttttggtactgattgatatggttgcccggttaatatacgcagctaatgattccgggttcagttttatagctttgtcataatcggccagcgcttcatcaatcttgttctgcgcacgcaacaaatctcctctgaacaatactgtatcgctgttttctggattaagtttcaccgcttcttcggaaaaattcatagcagattcaatatcgttccgggcaagcgaacatctggccatacccatcagcgcatctgcgaaccctggtttatcctgcaaagcctgctcaaacaatgctttggcttcttcgattttacctagcgctaatgacgcattgccacgcagagtaagtaattcagcaaaattcccttcttcggataatttctcagtttcatccagtacttgttgaaatttccccattcccagccatgcctggctcaatccgggcaacaccttgactggatccatgccgagatcaagtgccttattcaattctttttctgccgactgaatattcccttccttgttataaagcgttcccagtaaataacggacttcagggtcatttggattttgttgcagggcattcttcaactgaataatagctgccttgtcattaccctgttgctgatactgtttagcttcggctaccagagcttgcgcatccataggcttcccacaggcagaaagcaccagaataacggccatcataggagcaagaattgttgtcgatttcatctgggtgatcgctttaccagaacagctcatatttacctcttttggtaattaagttaaatacataaattcacaaaacaccgactgaaacaaaattcagaatagcagtttttatatccaaatatcatttaacgggatagtgatagttataacacagtcaacttataggcaaatttgtgaaatcaattgggattgcatgttttaacactgtaatgatcgatgtaccaatgaattaccgagataccagatacctcggtcaacaggaatacgcaatctgagcccgcccacacaccataatccgacagactctaccctcaaatcagccaaatctattaatttattcgattcattcctgctttactgacacaaaaagcacagccagtaccggatacgatgacatcaccccacatcagattcttgacaacagggcctaaatataacattatgcacagctcttcgagcgtatccggatgccactattcgcagaggttacgaaataaaaagagatatttatcgtaaaaatgcgcccgtagctcagttggatagagtacttggctacgaaccaaggggtcgtgggttcgaatcctgccgggcgcgccagtaaattaatattatttatcggcatgataagatatagtcagttttatacgccgttttgattttttgaggccaagtagctcagtcggtagagcagaggactgaaaatccttgtgtcggtggttcgattccgcccttggccaccatcattttggtcaacccattctacaattgaccctctcgttttctacatttaacagatctccacacgattcttactaacctccatatttcctgaaatttcccaggatctctcgccgtatccccaatactccattaggagtaaatcctatgtatttaggtagattttcaatagcatcccattagaataacccattgattcacaatggggccaatctctaatagattatatttaccagtctcatatcagctgccacaacttcacttcacccatcgcttgaagcttgaagatgcaacgtatcaatatttgacgcagacaaagccagcctgacagacgtaccaacagatacttcgagcctctgacactcatctgatcgacgctcaaacaagcctcaccctatttacgatatgaattttacccctcccacaagcacctcatgatgtttgcagaaaacaatctctcattagctataaccctgcaaataccagtttgtttcaacaaatcacacaaaatctacataagtattggttattaacaactactttgactgaaccatgtgtctctgatgcacccagttaaagttagcaaggatagtgtcgatattgatttcttggcaggagaatcacaagctgtccaaaaaacataagtcaaataaccaaaagattttattttgttaattttcatatggagactcagaagatgaaaaaaatttttttgattcttgtaatgtttttcgggttaaatttatccgtattagctggagtagatatcaatacagcaagtcaaattgatcttgagtcggtaaaaggtttgggaccggctaaagcaaaagcgataattgaataccgagaaaaacacggtatgttcaagtcagtaggagatctaaccaatgtgaagggtataggtgtcgggacgctcagacaattaggtgatcaggtgagtgttcaagaggaaactgcttcaaatgaagctgaggctcattaattgaaaaatcagtgtcttagatattatgttttaacctgatggttaagatttatcgggtagtcagcgcggtatgatataagctgcccgataaatccatacagtcaataatttctgtgccagtttaatttacacagatacctttaaaaagtgaaatacgcactcaaatccagcttaaataatttttcagacaatttgactacaacgttctcatctactgcttgaagtcacgccatcaccacataaaagtatcatcgatgaaaagcttcttaagatcaactcccacttcgcgcagaaacaattatttgatcctggatagaaacggctctctagtaggcaaatagaattatctaaataataccggctccacctggttttttggagagatacaacatgggtataaccaatccgcatcataacaacatcgcatcaatagtcatgtgactttcagctgcacatttttatccacagtatccaggatgataaacttattatccagaaccgttgttactattcaatatttgccgattcatgttcatatccagatccctagatataaacacaaatcagccacagcaaactaattaatcagtattttctatgtatttttttctttttgactttttgaagcgaagaagaagtatccaccgcctatgacaatgatcaacaagggccagaaatacatattcatcttaaatttgcctcctgtgcccacagcgaaagggaagcgtgatacatgctctattccattgtctctaactgttaccagtcctacaaaatctccttctgtgggaaatgtatgttcaaacgtgactgatccattcgagtacacttttggagggatatgcatgacggtaatctcgtcaagatttccttcttcccccggctctgcacctgtatcacgaataatgcgtacttctgttgttaacggtctcagcgcttcatcaatataatccagtgctaccactgtacgaccagtattgggtatatcctcacagaattcctgctcttgcgagctttcaggttggtagcccgtaaagtgcatggtataaggcccaaccgtgagtttacacatatcctccgccatagacagtccgccatgagcataagcttgcatccagcaggtcatgcccagtaacattccaaccagccatttaatgccggttattgtccatccttttgtcatctatctatcctccctgtcttttatatttttgttgcaaatcatgtcagcactctctatgagactgcctgaatttaatcgtcttcagatttaaaccagcttcttaagcggccggattgtatcagcttatacagcagccaactcaggaacaggagcgcaattgctgggcctgcccaagtgcgtacaagcttgccataatcaaccatttcaactcgcagctggtaataataatttagcggagggaccccttctgccgttactattactgaatataaccctttatccagtctgcctattccattaatgactccatccgggtgatgagctgcattgacctggatgatcatatctccttctttttcttcacctctgaatactttcatacccactggcatatcgcgcaaacccaggtctatcagatccacaaccaaataggtatctccagccattggaatctccgtgcaataatgcccgccccgatcaaattgaggttgataggtgttcaggtgcaccatattttcacctatctggcgcacgcaggtatcttcctccagtgatacacgaccatgccccaaggctgtattcgtgtaacacaagatggcaagaacacaagtcataaaagccagttgtaccgattgcttcaacataatgactccttgctcctgtcttgataaaaaaccacttttctgcttttccaacagatgctctcttcccatttttataattcctttcaattcagtactcaagataccgaatttgacaggctgtctgatgctttgtctcaaaatcagaatcacaataaaaaaccggtacacctctgccttgcgacaggcgatgtaccggttcttattaactaatacgcagtacctcagtactgtctattagagcttggtaaagactggaatcaccggaccagcaatactgttgatatggcgattaccttctgaatcccaagacattaacagtccaccaaaacggctttccgggtcacccagcaacgccatcagacgttggatttcccacagagcatctttggcttccatcctcaattgcttggtctcgcctggctgaattgcaccatcatcatcaaaattcaagcctactgcaaccagttcacgaggatactgtggatccaggtacttgcggccggtactgttaacgaaacgaatacctgctgtggtaaattcaccaaatgtgactggtgtatcaccgttgttggttacttccatcgatacacgcagtgcacgtcccggtacgtcatagttagcatctgtaattttgattgctaccggatttggtgctaccggtaatggtgcaactttggattgaccagcctggataggtactgtgtatggatgcttggtttctgtatagcggtatccaccccatactatagccaaggtcaggattgcaagtacccaggtgattttcttatccatcggatccagcaacagatcatcaccataagcgagcaatacccggctacgtggcaggaacatcggacgcgctacaaagataccaatccaaaatataccaattgacatccagagaatatgccagaaaataccgtttgacaggttgaatgtttctgagtcaattgtttcgcctgtcagcagcttgagtggattagtaaaatcatcccagcttccggtaatgttcatccatgcacccggtcctgcaattggacctgcatctttaacgtttaacatggcgtgcatgtgatggcgtcctggaatacgtgctctcagctgaacttcgaacgcatagtcacgaccaatttgcagcggacctgaaataaaccatgggtggccattaatcttcgtactcaaacgcacgtataccgagcttgggctacctacgttaaagaatgcgaaatccggtcttgctgccgcacgcggccagtcttcagccaagtgaaatttgccggtaatttgggcattctcattgactttggttacttccggaccccacttaacatcgtaccactgtactgtacgcatccgaagaaacggttcctgggatcgttctccatgggctgctactgttgagacatctagtgtcactgtcatggtcagtgccgccattgcataaacagcaacgccacaaagtcccatcattccacgtttataaaggttcttgatacccattatttgatcccctctggaaacccttcttcaccaaatgccgtaacatcattgcgctgcacgatacgtcctcttttacctttaacgtagaagaaggctgtgcagtaaacttttccaagataccaccagactgcaaacatcagcatggatacaaacgcagcgaagaatgctgcaataactgtggtgtgaccaccaaaggtacgtaatgaaccttgttcaatatgacgaacatactcaggtgtacccgtacgaacatacaggtgacccatatagtcagccatcgacaacagtgttccttctacaacgattggcagatgggtcggaccaaagattgcccagttacccgggtaaaacagcagaccaaagaatccacccccaaccaatgcagtcaccaaccagttacgtgtcagatacattgtgaaatccaacatcaatgcacccgggagcatgatacctggggttacaaaattgagtggatagtgtgaccaccagtagaaaccccagtaacgtgtcagccactcacctatcagcaaacacactacgcacagagtcgcaccaaatggttgacggtagttgacccacaggtaatacataattgccgagcaataggtaatgcctacaataggtgttactacaggccaccattgacgatctttccagtccatccagaaatcccagtcacctgccaacaacatgaagtgcatatggtaggtacctaccaacagaacaaccagaatcggaaaataaaccgcatcaatcaggcgtgacatatggaccgcttccggcggcatcttggccgctttcaggatctcttctgttctaaatatactcaccctatcctcccctcttataatttaaaattaacatcacgattcctctttttctttaaggtaccgcattccgattaccggccggctaaacgttaattgcttaacgtcagccagtcatttctttttccatataccccttgaaatgtagtttcctagatttcaaggggtattccggactaagctacaacccggttattcagaatttctttgctttgattattccagaccacgtcagtcaggttggaataacgggtaatgatttgggcagcaactccaccctggaataacccagcccaaccgagcactacaaaaccccaatgcagcggtgcgctgaacagctcttccatgaaccagaaagcatgaccccattcattcagaccaacgtttggcagaatcatcagaggacctgcaatcgccatcaccagtgggaaagaaattccacgatgaaacagcggcagacgggtcattgcatacagataggttgcaactccgcagacgatgtacatcggaaatgatccataaaacacgactacgtgacttggtgtaaagctggtgtcacgaataatcacctggtgccaggaggcatcttgctccgtaaagaagctaccaccccagtaaacaccaaaaatgtatacacccagccacatcatgtagtagaagtagcgtttgatttccagtttcggatccaggttattcaattgctcttctgtatcacgtgttttccagatccagccccaggttaccagtgcaaacagcggcataatggccatgtgcacacgccacaggcccatccatacacggtcaaactctggttccattgaatccattccgtgtgaataggcaaagtaacgttgataccatacccagaatatcgctaccaacaacatggttattaaaccaaatttataaaatttggagtcataccacagtgacatgtcatagcctcttgatgagactgatgaggcactgctcgttcctaacgtagttgccatctctttatcctcctttacaccacattttgttaaaaccagtaatgaaaattagaatttttcattactgtccatcgcaaataaccacatttaaatcacggtctttgcttgatttttgcctcagtatttctcattttgttccgggaaggcttctatacccacaccagatacatccgaaaggctagtcaccttggctcttttagtcaagcattttttattcacacaaccacaaggtttagttagttaacacaaaatcaattgattacaataatcttcacagcaccccctcacaaaaaccagatcatccctcaaaataaaataaaccatgaaaactttgtggatataggtttatatgctaaaggatttccagctcgttgggttttattttttctgtaaaaacaggtaggtaagctcgtactagaagcttataggcgctaaattggggcaggcagattctcttatgttttgttttgttttgttttgttttgttttgttttgttttgtttttctgaaatcttaatcagctacccccgtttacatggcgggataccttattattgataaaaatttcttcaatgacgatgagtagcgtgtggaatagcagctctcaaatagtagaccatggaccacaatgtcaaaatggcggcaatataaatcaaccaggtgccaatcatttgtgaatcgaatgaatcatgaaccctatcatggtaaagcaatagaggaattgccaccatttgcgcagctgtcttgatcttgcccagaaaggaaaccgccacacttttagatttgccaatttgcgccatccattcacgcagagcagaaatcgtaatttcgcggccgatgataatcaatgcaatcgatacatcaagccgatccaaatgtaccaaaacaatcagcgcagcagctaccatcaacttgtcagccaccggatcaagaaaagcaccaaatgcggaagtttgattgagtgctcgggccaagtagccatccagccagtcagtcaatgcggcccccccaaatacaatagctgcaaccaagttttgcgcggctggagacaaccattctgatggcaggtaaaaaataccaacaaacagaggaatagccattatgcgcagccacgtcaaagaattgggaagattcatcagcataaccaaaagcactccaatctgtttcagcccatcacattagtaggcagatatttataatttactacagacgttctctctacccagagtaatcacgacttacaccgggcttcactttaatgagctcaacaagctaatttctggaggcgtacagaagcgattgaactgcagctttccagcctgtatacaatcgttctctttccgtttctgttatcgtaggagtatagattttatcccgctgccaataacattcagttgcttccagatcagcaaacaaatccaccgtcagaccggccaggatcgccgcacccagtgctgttgcttccgttatttttggcacttccaccggcttgttcaatatatcagcaagaaactgacacatgaatttgtttgctaccagccctccatctacacggataatctcggcatgatgaccgccatcctcttctatcgccgccattagatcccgagtttggtagccttgcgcttccagtgcggcacgtacaatatgcgcccgcgttgtatcacgcgataatccgctgatcatgcctcgtacatccggccgccaatatggcgcaccgagaccagtaaaggcaggcacaaaatacacttcattgctgtctggcacactgagcgccagtgcatcgctcgccgcaacctcctgaaaaaactccagctcatctcgcaaccattgaatcgctgctccggcaataaaaatagacccctcgatagcataaaccatcttaccgttcagacgatacgctggcgtggtcagtaaacgatgctgcgaaggcttaaaatccgagccgatattcatgagagcaaaacaacctgtaccgtaggtagacttgaccatgcctggccggaagcacctttgcccgatcagtgccgcatgctgatctcctgccatgccaccgatgggaattccccgtccgaacaaggtccgatcagtcatcccaaacctggctgcgttatcgcaaacttccggcagaatcgtttccgggatattgaacaatgtcagcaaatctgcatcccatttttgctcaacgatattaaataacagtgtccgcgcagcattcgtcacatccgtagcatgcaccttcccgccggtcaggtgccagagcaaataacaatccactgttccaaatgccagctcgccacgcattgcccgagaacgcactccttcgacgttatccaatatccaggcaattttagttgcagaaaaataaggatcaaacaacaagccagtccgggctgttaccattggctcatacccttgagcttttaattgctcacaaccaatatcggtgcgacgatcctgccagacaatggcaggataaacaggcttaccggttttacgatcccacaaaatagttgtttcacgctgattagtaatgccgatagcagcaaccgaccctaccatactgacattgtgttccagtaccgcatgacaaacttcgagcgtatcctgccagatagcttctggattctgttcgacccaccccttgtgtggataatgtagcttcagctctttctgttgcaccgcgagaatttccaatgttgccgaaaatagaatggcacgagtgctggttgttccctgatcgattgccagaatcactggctggttattcataactggttttatacaaagaacaaaagaattccagaaaacagcatgttcacttaccgataatattcaccggaacgctcaggctgataggttacttctacaatacgcacacgcaatacccctccgcctggttttggccattcaatttcatctccctgtgaaagtcccagcagggcacttcctactggtgcaaggatcgagatcttctcgccactagtatcgacatcctttggatagaccagcgtcagacaaaactcctcggccgaagactcaaccctaaatctgacagttgagttcattgtgaccacagtgggcggaatctcctctgggtccaccacgtcagcgcgcgcaagctcggcttccagatcatctcttcctggaaatacactctgcggaagagaatccagcaacatttctaatctctccgcatcaagcgaagaaatcattatttttggtttcacactcatttttacattcctctaatttggtcgttcacgtgaatcactgcggaaaacagcctcactgcctgaaaaaaaacaactcttccggaacagcactgtcaatgggaataactgattggcaggagcaactggttacagccacaccttgttatgaagaaacagcagcatcaagtattcgtgcttgaaaagacaaaaagcgccctgcaattgccattaatatggctcatccacctatggcgcttgtcaaggcagtataacttaccgatatctcattggccagcgcatcccaatttcagaaagcatcttcatttcgcgtggaaaaacgatacccggcccctcttactgtctggatcaaatcagcttttccagcaacctccagcaccttgcgcaaccggcgtatgtgaacgtcaaccgtccgatcttcgacaaaaacatgatcaccccatacccgatctaataactgggcgcgagtatgcacacgctcagcatgagccatcagaaaatgcagcaatcgaaattcagtgggactgaccagtaattccttttctcgaaatccatcttcctgattaatgactgttacccgatgcgtcatcgggttcagcctcactccctcagcattgagaatttcatcagaagcttcgggcagactcctacgcaaaactgcctttatccgggcgatcagctcgcgtggtgaaaatggtttggtaatgtaatcatccgctcctgcttccagcccagacaccttgtcaccttcctctacccgggcagtcagcataatgacaggaatcgacctggtacgcggatctcggcgcagtgatcgcgcaaattcgatgccacttttacccaggagcatccagtccagtaatatcagatccggcaatatctcattaatctttactaccgcttgttcggcactatttacacatacaacaatatagttcgcattgcgcagattataggcaatcaactcctgaattgctggctcatcttctaccaccaaaaccgttgcagacatctttcatctcactgaggggatatggctaacagcacgaattatgcaaggcaatgatgacatagcaatgacttcctgaaaacttgttttgttgacaatatagccatgcgggatacgcctggcgcatggccatataatattttcaggatgcgaggagattatcaaggccatcctggaggaggctgcttgtgaaactctgggagagagggattcatattgatttgtaatgccgcataaataaacagtttttggattaataatttgtacatacttgttcagtcccagatgattgtatagataaaactcgttatccgctgttcatggcgcgagctgtcatgagagagctgatagagtacatcactgccgatccttgcggccaacttgcactttttacgccaagtagcaccaattacatcctcggattggcaggggcacgtagccggcagcactcccgacaggccacgcgctagctcagatacaagacagcacgggcaagcaaactaggtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaaccccgatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacaactaggccaccccgccgcctagctagtagctacatcctgtggtgatcagccgtacccggtctttgacatcatgctaaccgttcaagagatcactgcattcaaggtcactatcaatcacccgtatccagatagaagcctgtttttctcccatgtcagcatccgtccattttcagccaaaggacacgccttcatatagcattttttactgtgttagtcgcagcacgtccatcgtgcgcatagtatatatagattttcctgtgcgccagcccggctgccacgctccatttcagtatctgtgatatgccccgagaatagaggaagctgcttggttaaagtaaaatattcattgtggtcttgttgtcctaagttggtaggcagttttctttggcttgtgccggagagatatacccaataggctcgagcaggtgttgatagttataccaggcgcccattccagggttgccaattccgcttcagatctggttttccagagtacccggcgagaaccagttcagccttattttcagctatggccttaaacgtcatggcatccgcttgttttccgctttgcgtacggccatgaggctgcgttcttcagccaactcccgtttgatcgccaaacgcacatgacgcgctgctgaaagcgtcataacgggatagatgccgcaggaaatagtcttgtgcttatcttcgaagcggtagtcatagcgccgccaataccggccaggccgattcgccagcagatacaggccagtaccattggtccgcttgtgcggcttttctttgggcttggactacctcacggctacatctgatagcttcatgatggtatttgaactaccgtcataattaccatctatgtcaagcaattgccatctataattgtagacaataaaaaacccgcaatgcaagtaaacatgcgggttatctatattgttgtatacggttgtatactaataactggcggagagagagggattcgaaccctcgataagctttttgagcctatactcccttagcaggggagcgccttcgacctctcggccatctctccgtaaatgatatttcttgcagcttcttacgacggcttataatttaaaaagttaacaatattaacacgatttcacatcaatgttgttcgcctgatccagatcaaaggccttatgcaaaacccggacagccagctccatatatttctcatctactacgacagaaatcttgatttctgaagttgcgatcattcgaatattaatcccttcctcagccagaacacgaaacattttactggctatgccagcataagaacgcatccctacaccaatcaccgaaatcttggctatcttttctccaccaatcacatcacgagcaccaatatgcggcaacacctgttctttcaggatatccattgtccgggtgtattcattgcggttaaccgtgaatgaaaaatcagtggtaccgtcacgccctatattttgaatgatcatatccacgtcgatattggcatctgcaaccggacccagtatctgataagcaatacccggatgatctggcacaccaacaaccgtgatcttcgattcgtcacgattaaatgcaatccctgagattataggctgttccatcttgttatcttcctcaaacgtgatcagcgtaccttcaccctcttcaaaactggaaagaacccttagcttgaccttgtatttcccggcaaattctaccgaacgtatctgcagcaccttggagcctaaactggccatctcaagcatttcttcaaaggtaatagtattcagttttcgagcttccggcactactcgtggatctgttgtgtaaataccattgacgtccgtatagatttggcattcatcagctttgagtgctgcagcaagtgcaactgcagtcgtatctgagccacctcgcccgagtgtagtgatatcacctgcttcgtccctaccctggaatccggcaacgataatcacattgccagcagtcaaatcagcacgaatatgatcttcatcaatcttcaggatacgcgccttggtatgagcactatcagttgtaatactgacctgggagccggtataactttttgccttgatacccagttcacgcaaagccattgccagcagcccgatcgtaacctgctcacccgttgccagaacaacatccagttcacgaggatttggattggtttgaatttcctttgccaaagagataaggcgatttgtctccccactcatggcagacacaacaatcaccagtttgtgtccctgcgcccagaattcagccactcggcgcgcaacctgcttaatgcgctcaacgctgcctaccgaagtgccgccatacttttgaacaaggaacgccacgaaagatatctctcagaaataaataattaaacggtcgggaattctacacagttctttggaataattctatttcaggattctgaacaaaaataccaggcttctctgcatcaaaaccttaccgtagcgtcatcattattctgcaaaaaacggttttgccgactgacgcacactcattacatcacacccagtcagattccatagccggaatagatttattattccccggcaaaaccactatttaccgcagaaaattagaaagtaattcccagttctcgcaacgtttctttggttatttttccttcagccaaaccatgctgtttctggaaatccaccaatgcattttgagtacgagggcccatcatgccatctgccgccccgggatttagacccgcatccttcaacgccttctgaattttacgaatcagatccggtgtagctttgacaacttccaacccatcattgacagtttcttttattgcctcatttacttttggagtctctgccagaacagaatcagctttttcagcaaaattcccagcagtttcttccaattcgtgttttacatcatcacccgcagcattgactgccgatccggttcgttgaataatttcatctgctcttgccagtatggattccaatgattcttctgtcgcttctccagcttcagatagtcccggttcaactgcactctcattactctgagcagctttcgaagttatctctggctgattttgcttggcggtttcttcaggttggtcaccgcaaccggaaataactccaacaagaaacagaaccaaaacactctttgcaaaacgatcagaatttattcttttcatttctgaatttccccgtaaaaaatcgatgcattttttagatactcccggtactaaaaccaagcccgaaaactccatctccctaattgaatcatccccagatcaagtaaacacactcctgatacacattcttccgcaacgtggttattttactctacgtgattatacgaaacctgtttgacaaggttaataatgtatcaggttaaaaaataaaatcacacagaattgacagcaatatgtaatctggtgccagccgaggaaacaccgaattacagtcaacaggccataaaacaatagacagcctgcatataaattataaatgctcgaatttcaggttgatcagattacgctatatagccctatgcatcagtcatttattcgtgtgtttcacccacatcactctggatttcaataattcacaagttaacgtatacaccgcgccaaatcggttccggcaaatatttttaggaaattaccatgaacgaaaccattcttgtcctcaatgccggttcatccagtatcaaatacgcactctatcgaacaacatatgaaagtatatcgataatctgccggggaaaaatcgagatcggcagcaatacttcatcccagtttcaagtcagggattcccgaggagaattactctggcagcagcaccttcacgttccccatcatgaaagtgcgatagaagtgattttacaatggctggagacacaaacagataaacaacgaccaacggtagtaggccatcgcgtcgttcacggcggtatattatttgaccagccagtcatcatcaatgagcaagtcatcacccaactgttccaactggttccactggcgcctctgcatcagcttgacagcctggcgggaattgaaacattaaaacgactcaagtcagatttgccacaggttgcttgtttcgacaccagttttcatcgtaccatgcctgatgaagaacggatttatgcactacctagccatttaacagatcagggaatccagcgttatggttttcatggcctttcctacgagtatattgcccatattctgcacgatcatctaggcgatcgtgcagcaggacgcatcgtagtagcgcatcttggcaatggtgccagcctgtgcgctttgcggcagggcaaaagtatcgccactacgatgggattcacaccattagaaggtttgccgatgggtacacgttgcggcaacctcgatccggcagtattgctctatctgatgcgggagcaacaaatgaatcacgacatgctgacagacttattgtatcggcacgctggcttactaggtgtttccggcatcagcgccgatatgcgtacgttattagccagcgatgccccccgcgccaaacatgccgttgacctgttcatctggcaggtatgccgccaactgggtgcaatgatagccgtactggaaggtatcgatggtttgattttcactgctggcatcggcgaacatgcaccacagatccgagcagggatctgtgctcgcctcaaatggctgtcgatcaagcttgacgagtctgccaatcaagccaatgccattcgtatcagcactgctgaaagccatatcccggtcctcgttttaccaaccgatgaagagagcatcatcgctcaccatacattacgactcatcatggcgtaacttagggcgattccagataacctgaccttaatgaggtattcaacatgactcagactccacaatctctcacgccggatgaactgcaaaaaatagacgcttattggcgtgccgccaactacctttcagtcggccagatctacttgctcgacaaccccttgctgcaagctccgctgacattgcaacacatcaagccccgtttgctaggacattggggaacgacacctggactcaatttcatctatgctcatctcaatcgcgttatcctacgtgctgatctgaatatgatctacatagctggtcccggccacggcgggcctgcgctggttgccaacacttatttggaaggcacttactctgaatattaccctgatatttcgcagaatatccaggggataaagcatctgttccgccaattttccttcccaggcggaattggcagtcacgccacgccagaaatccctggctccatcaatgaagggggggagctcggttattcactttcccatgccttcggtgcggtgttcgacaatccggatctgatcgcagcctgtgtcgtaggtgatggagaagcagaaaccgggccattggcagctgcctggcattccaacaaatttcttaacccagctcaagatggtgtagtgctgccgatcttacatctgaacggctataaaattgctaaccccaccattctggcacgcattagccgtgaagaactgaatcagctgttctacggccacggctatcggccatacatcgttgaaggagaagatccactggccatgcatcagctcatggccagcacactagatcaggtattgactgaaatcagatcgatccaggcccaagcccgactcgagggcgtaacccagtatccccgctggcccatgatcatcctgcgcaccccgaagggatggactggacccaaaacagtcgatggcctgaaaatagaaggctcctggcgttcccatcaagtacccctctcagagctggcaaaaaaaccggaacatctccagcaacttgaagcttggctcaaaagctaccgtccagaggagctgttcgatactcacggacggctgattgaaccactccaggcattggcaccgcttggtaatcggagaatgggtgccaacccgcatgctaatggtggattactgaaagaaccactgcatatgccagatttccgggaatacgcggttgaggttgcacaacccggccagattgaagctgaagcgacccgggtcatgggtagcttcctgagagacatcatgcgcctgaatctaagaagctgtaactttcgggtatttgggccggatgaaacagcttccaaccgattgggaaacctatatgaggtcacacccaaaacatggttggccgaaactttagctgaggatgaacacttggcgccagatggccgagtaatggaaattctcagtgaacacctttgtcaaggatggctggaaggctatctactgactgggcggcatggtcttttttcctgctatgaagcattcattcacatcatcgattcgatgttcaaccagcatgccaaatggctaaaaatcagcaaggaaatcccatggcgcagacctatcgcctcactcaattatttgctgacttcccacgtctggcgtcaggatcataacggattttcccatcaagatcctggtttcattgatcatgtgatcaacaaaaaagccgacaccatccgtatttatctaccgcctgatgctaactgtctattgtatgtcacagacaaatgtctgcgcagcagtaatttcgttaatgtcatcgttgccgggaagcagccacaactgcagtggttggatatggatgccgcgatcaagcattgcacggccggtatcggcatatggggatgggccagtaacgaccaggacggcgagcctgatgtcgtcattgcctgcgccggagatgttccaactattgaggccctagctgctgtgagcattctacatgaacacctgcctgacctgcgtatccgggtgatcaacgtcgttgatctgatgactctgcagcatcacctggaacatccgaaaggtctatctgaccgggaattcgacaccttgttcaccacagacaaacctatcatttttgcctatcacggctacccttggctaattcaccgcctaacctaccgtcgtaccaaccaccataatttgcatgtgcgcggctataaggaagaaggcactactaccacaccgttcgatatggtggtacttaatgacatggatcgcttccatctggttgatgacgtcatcgaccgcgtttcccatctgggttataacgcagcctatctcagacaaattatgcgtgacaaactgatcgagcaccgcgaatatatcaaccgccacggtgaagatatgccggaaatcagagattggaaatggacgacactatcgtgatatcaataatataaccatcaactggatttgttttatgttgtctatagctgtttagtcccacgataagcgaggatatcttacaccagcattcgtgggactaaaggtcgcgtcccagatggttgtatggttttttatgaaagaggtgggaatgagttttataccattctcccatggcctgcattggagttttactcttgagggcagacagcggtagttgcgggtttacaggctggcataacgtatcagggtctgttccagatcttcagcgctattgaatcgatatattttgagtacgtcagtaatatgtctgttgaaacgttcgaccattccattggtttgcgcagtgcgtggcctccgggtcaggtgatgttcgataccgagttcctggcacagttggccaaactgatgattgtcactggggttgcgttcatggctggcgaacagtctgtcagaatacgggaatcctgatctgactggttgttctcacgtcgacaaataccctgtagccgttctctgatgcagtaactgtcttcttgcttcctgtcaccctaatctgctttttccttctgtatcatcatgcacttcgaggcaattacctccatcagatcgcgccaggaatctacaaattttttggctccctcttcctgcagcctggcagcaagagcatcaatatcaatccctgctccagcaaattgttgcagaacggcttcactgtcaccgccatcaacaggcatagttccaccactcaaatcaccatgatctaccagcgcactcaaagtcttctcaggcatggtgttaattgtaaaaggtgcaacaagcgctgtcacgtaaagcacatcagaagccttgggatccttggtacctgtactagcccacaataaacgctgcggccgtgcacccgcattgtagatacgcaaccagcgggcggagccaagctgttcgcataccgctttataggtgcgatgagcaatggcaatacctagtttgttctgtaatgcttctggaaccttgccagccactgccgcatcccaccggctgataaacagggatgcaacggagatcacatcaggattcagtccagcttcgatacgccgctcaattccacgcagataagcctcggctgccgccacatactgctcacggctgaataataaagtcacattgatcggaattccggaaaaaattgcttcttcaatggcaggcaaaccttccctggttcctggaatcttgatcagaagattcggccgctccacctgactatgcaaatcctttacagctgcaatggtactggcggtatcgtatgccaatagaggagatacttctaacgatacccaaccatcaatgccattggtacggtcataaatcggacgaaataaatcagcagcctgagtaagatcctctagcgccagatcgaaaaaaattacctcacccgattttccttgtgccagatcagcacggatggaagcatcataagcatcgctatgcttgatcgcatggttaaaaattgtcgggttcgaggttaaccctgttactgacagctcattgatataacgtttgagtgtgccattaattaataaatcacgtgtaatgttatcgagccagagactctggccgagattatgcaaaagttgtgtcgctttcataattctgctccttggaaaatcgccggaccgataactgcgcgccggcaatacccagtatacgtgcatcagataaaatcgctatggctgacgacctttgaatgatgttgccgcatcggcaacccggcgccaacaatcgctcggctacctcttcctgcgacaatttgtcgcattctcatttcctgcttttgtccggataatttgatccggacaaacaatggttattatgactcttttcgctactgcatcatgtcttcatcggattcccccgtatttacagcactttataaacaataccagtcacaattgatcagtcgcatcacctgtctggtcggttgccgtgaaacagcagctgatctcgcccaggaagcctatatccggttactgggccaccgcgatttatcgaatatattgagtttgtccgcttatctgttccggatcggccataacctggcgatggatcaccagcgtaaccctttaaataaaatagaatacctgctgctcgacgaaaccctgccctgcccgctgctccagccgcatgaaatcgtgagtctccggcagcaatgcagactattactggatacgatcgcctctatgccgcaaggttgccgtgatgtttttctgctgcgtaaaatcgatgagctcagttacagtgaaatctccatccgtctcaatatttccgagaaaaccgtgcaacgacgtctggtacaggctatgttgcgttgccaccgcagcatgaaccgtatgaccgaccggtaatactatatgtccgcttccggccctcctgacgaacagctgctcaaacaggcactgaagtggttttttctattacagtctgaacactgtacggatgaagacaagcggaaattcaaccgctggttctgtaaaaatgaagctcatcaggcagcctatacgcatgctgagcgcttatggtctgaaacagacaaactgaaagaaacacccgatattcccggtttgcatgaagccagacgacgccggcccaaacaccagccggccggcatattcggctgggcactgttcttcctgatttcatctgctttgatgagtatcagctggctggaatacaacgctgaaaccgtcacttattccacccgattgggagagcagcgtctcatctccctagcggatggcagccgtatcaacatgaatacggctacccgtctgcacgtccgcatttcttacctgcaacgcaaaattacgctggatgcgggagaagccgtttttgacgttgcacacgaaacctggcgtccttttgtcgtgcatacagacaaattgcaaatccaggatatcggtacccaattcaacgtacacagacagcaggatgagatctcagtcacggtattggaaggcgcggtggaaatcgatggcgtacgtctggatgaaggatatcagcaatactactcctctcgcagtgatcatgcggtcctccgcccggtcgataccgaacagatcgcagcctggcagcacgggcggctgatattccgccagactcctctggcagcagtcacaaccgagctggaacgctatcacccggtacacttcatttttactgaccccgccattgcacatgagacgctgagcggaacattcggcacccgtgatctgccacttttcctcagcagcctggaaaaggctttaccagtcagggtaaaaaaactgccggacgggcaaaccctgctgatcgaccggataaataaaaaaatgtgaccagttcatcgtgtttttcacgtcttaccagacaggacatcagaaacctttataccttcctgactggagaaaaacaccatgaaatctattgccggattattttcgttactgcttctgctatgggcgaatacggccaatgcgcaaaatgacatcacctattccttcaatcttcctgcacagcctctttcttccacactgaatcacctggccaatatcactggcatcaagctgatttatgcggatgaaatcacccgaaatcatctttctccacctctacacggcaacttcacactggcagaagcattgaaccaggtactgaataaaaaccggttgaagtacgagatggtcgataacagcatggtcgtcatcagccaggctgctgccaatacggttttacctgaaatcaccatcaccactgattcatccgcgaccggtaacgaagcctcactaaccgttccgaataccgcacaggcaacggccaatatccagcacacacccggtgccgtcgaagtcatatccgatgcccgattcaaaagtacaccggcacaaaccatcaaggacatcgtcggctggatacccggtgtcatcgcccaacccaaatcgaatatcgataaccggatatcgatccgcggctccggattaacgcgcaactatggcaaccgtggcatcaatatgtatatggacggcatcccgatcaacactgctgacggcctgttcgatgtcttcgaaatcgatccaggtgcttaccgctacgtcgaagtgttcaagggtgccaatgcactgcgttacggagccaactctctcggtggcgcaatcaacctcgtcacaccgacagggtatgatgcttcccggttcagcgggcgagtggatacaggcagtttcggctatatgaaaggacaggtgagcacgagcggaatccacggcccgcatgattatttcatcactgcatcggcacagcgcgaggatggctatcgtgatcacagcaatggccatatggtactcggtagtgccaacttcggttatcgattcttaccggatgccgagacacgcttttacctgaacgcaaatacatggcgccagcgtttaccaggcgagctgaccaagcgcatggcgctggattcaccacgcagcgccgatcccgagttcgtacggcaggatcagcaacgcaacatcgactcagtgcggctcgccaacaagactacgctacgcttcggccccaccacggtcgactttggtctctttggccaccatcgccatgtggatcatcctatctaccggtacctggactactatgtccatgactacggcggcttcgcgcgtgcaaccgatgaccgtctgatcgccggcttccgcaaccgcttcgtcgcgggtgcaaacgttcataacggcaaaatcaactacaaagaatatatcaacccgggagatgcggtgaaaagtgcactcgccatgtccacggtagataaatcacagaactattcaatctatgtggaaaacagtttctacttcctgcagaatgtcgcgctggttgctggcgggcagttcctgcatgcgattcgcgaccggaatgaccgtttcctggcggatggcgatcagtcgggccgccgtgcttacagcatcttcagccccagaggaggattgttgtgggacattgctcccgatgtacagatctttgccaatatctcacgcagtgccgaagtaccgactttcgacacgaacacctttatgacacccgctagttcggaactcgatgcccagactgctaccacctatgaaatcggaacacgcgggcacagagccgatttcaaatgggatatcgccttctatcgcgcccatatcagaaatgagctgcaatgcctgagaacgtcgccgttcagcccatgtacggtagtcaatgcagatcgtaccgtacatcaggggatcgaactgggattcggtgccgcatttctcaaaggaatcgccgcccggaaagatcttctctggctcgacatagcctacacctacaacgatttcttttttgacaatgacaccctttatggaaacaacaagctacccggcgtaccaccccactacctgcgcgcagaagtgctctacaaatatccgaatggattccacgccggtccaaatgtggaatggatgccacgagcctactacgctgataatgctaataatctctccattggctcatacgcgctcctaaacttcagaatcagctatgacccaggtaaaaaatggtccggttacctcgaaggacgtaatctacttgatacccgctacatctcaaccacgatcacctccggcacggctgatgccacctccgcactcttcaattccggctatggtcgggcaatttacggtggcatacggttcaactggtgaaaacaaaaatttcaaatctatcgtacaggttgtacagcttcacactgctcaccaatccagcgaccggttgtgtcagcagatacataaaccggcatgtcctgcactgtactattgaattctgttctcccagtaaaactttcaggtgtagaaaaaacaccttcagcatggccattccctttaaagcgcggatgatcgcaaacgagtgccacttggtagcgattcccggatcgactggcattgacaaccgtgcatccggactgattctcataaaaattagagggaatatcctgttgtgccatctccggcgtaatacaaacccgagaagtagccgcaccatccttgatccgcggaattttcactccgtactgtttggccagcatggtaatttgctccatctgctcggatggaacatgttgaaccagcccgagtaaatctgatcgagttgtcacttcccataacccggcccggatggtagtttcagcccgaccaaacgtgctaaccattaacagcaggacaatcaatataaccttgaatgtagtcttgtacatagcggtatcagtcaatgatgcccacggttctttttattatcttccttgatttcaataatttcagcatcctcgattatcccgttactctgctcagccgaagcagccattgattgccggagtttgcgccgcagccaccacaatctcgcactaactactgctgccacagccgcaaacaacgccagtacaatcgaaaagaagaacgcacccaacactaccaccacaatcactactggtatcagcgtcagataaaatgcccaccggttaatcggcgatgtattcagtgattcacctgtcggatcagcttgcccctgatgaataatccttctaataattatttttctgtagtcgtcatgcattgcatccactcctctatttcaaccacacttttaggcactgaccgggtaagcacttcatacccggtcgatgtaacagctacatcatcctcgattcttatacccatattccagaaatgctccgggatatcttcggctgggcgaatataacaacccggttctacagtcagcgtcatcccaggaaccagtgtacgccactgtccggcctgcttgtattctcccgcatcatgtacatccaaccctaaccagtgaccagtccggtgcatataaaatcgtttgtaggattccgtttccatcactgcatccgggctaccttcgcataagcgcaagtcaatcaatccttgtaccagtacccgcaaagctgcctgatgcggcatatcccaattattacccggccgaactgcatcaatggcagccagctgggcagcaagtaccaactgataaacatctttctgtgcagccgaaaagctaccatttatcggaaaagtacgtgtaatatccgctgcatagccatgcaattcacaggcagcgtcaatcaacaacagatcacctgctttcagccgtgcatcattctgaacatagtgcaatacacatgcattcgcaccgcccgccacaatagatgtataagcgggagactgagcaccttgctgacgaaattcatagagcagttcagcttctatttcatattcatgcttaccgggacgagtcgcctgcatggcgcgcttgtgtgcatcagctgaaatcctggctgcttcccgcatcaccaccagttcatggtcatccttgactaagcgcatttcatcaagtaaatggcggatatctcgtatttctgccggtgctgatatgcctttcctgatctgttctcgcactcggctgatccacccgatcacacgctgatcccaggaaacatcatgaccgaatgcatgaaataccacaggttgattcgctagcagctcaccggcaagctcatccagtcgggcaatgggataagccgtgtcaaaaccaaatgcttctcgtgccgcatccggcccataacgaaacccattccatatttcatgttcactatccttgtcccgacaaaataaaatctgttgtgatgtgttttcatccccggtagcaatcaataacaaaaccgcttcaggctcctggaaaccagttaaatagtagaagtagctatcgtaacgatagggataatttgtatcgcggttacggtatttctctggtgaagtagcaattacagcaacaccttgctgaatgtgcaacagcagttgttttctgcgatcgatatacgtctggactggaatcatgtcaccggattccagtaatagtttcagaaaacagccgggaatttgccagaccaccgaccatgtatcttccagacatcgataatatgaaaaacccgtatggatacaaaagcattattaactcccggtttctttttatggttaaaatgtaacatttccttatgaggccaaatcatgtatcgcattgcccctagcattctttctgccaattttgccagactaggcgaagaagtcacacaagtcctggattctggtgcggacatcattcacttcgatgtcatggataatcattacgttcccaatctgacgatcgggccactggtatgcgaagcgatccgccctctgaccaaagcaattatcgacgtgcatctgatggttgaaccagttgatcgcattattccggattttgccaaggcgggcgccaacattatctcctttcatccggaagcttcgcggcatattgaccgtaccatcgggctcatcaaagagcaaggatgcaaagcaggcatggttttcaatccggccacaccgctttcgtatcttgatcatgttctggataaacttgatctgatcctaattatgtcggtcaatcccgggtttggcgggcaggcctttattcccgaggcactgaacaaactgcgtctgacaagagaacgcatcaatgcaagcggtcgcgatattctgctggaaattgacggtggcgtgaaggtgagtaatattgcagaaattgctcgcgctggtgcggatacgtttgttgcgggctccgccatttacagtgcaggtaaagacagcgatcctcatcgctacgatagcgttatcgctgccatgcgggccgaattagcaaaagttacctgaccaggaaccaacatatgacccaatctaacatacaaccgtccaatcgaacctcgtttccgattccacttaaagctgtcatcattgatctggatggcactctgcttgacactgcccaggatctcgcgctagcggccaatgcgatgctgcgcgagctacacatggcagaactgccgctatccaccatacaaagttttattggcaaaggagtccccaagctggttaaacgcacgcttaccaacagcccggatgatgagccggatcccgcactgttcgagcaggcattgccgatatacgaacgttgctacgcagagaacttgcatgtgtatacacgcccctatcctggcgtcatcgagggactcgaacagctcaagcagagtggatttcacctgatttgcattaccaataaaacagaaatctttacactcccgctgttacacaaaaccgggctgcgggattattttgaactggtactgtccggtgacagcctcccgaaaagaaagccggatccgctgccactactgcatgcctgcaaacattttagtgttttacccaacgcagcgctgctgatcggtgattcatccaacgatgctattgccgcacgcgcggcaggctgccatatcttctgtgtaccctatggatacaatgaagggcatgatgtgcacaaactcgattgtgacgcggttgttaattcgatcgttgaagcaaacagtctgattacctgccagcgcgatgcctgactggcaatgaaacacataaagctataccggcttgtcaccgtgataaacatgcaacagccggtataacctcattccatcactttaccattttagtaacactctgccttccatggatcattgcatatctgaaagtgaattcaacgatctgaaagcacaagggtataaccgcatacctttggtgctggagacattcgccgatctcgacactcccctttccatttatctcaaactggccaatcagccctattcttacctgctggaatcgatactgggaggagaacggttcggacgctattcgattattggattacccgcaacaaccaggctagaagcttgctccaaccatattcgtataatcagtaacgatactatagaagaaaaaatcgacacaaccgatgtacttggttttattgactctttcctaaatcggttcaaagttgctccttacgccaagttacctcgttttggcggaggtctggctggctatttttcctatgacaccgttcgttacattgaacccaggctgtctggtcgtgcccgtccagatacgttacagacaccggatattttgctactgctctcggaagaactgatcgttatggacaatctttccggcaaactttatctgattatctacatcaatccaacattggaaaatgcttatcagaccgggaaagatcatctcaagaaattattacataaactgcgggagcctctgccggtaccagtcgaaaaaccaacctcttccggaatagctgttaatgagttttccgaagctgactttattgccgttgtggaaaaggctaaacgctatattgtcgaaggcgacatcatgcaggttgtcctctcacaacgcactagtaaaccctattccgcttcaccactcgcattgtatcgtgccttgcgtagccttaatccatcaccctacatgttcaattatcatttaggtgactttcacgtcgtgggggcctcaccagaaattctggtcagactggaaaaggatacggttaccgtccgcccgattgccggcactcggccacgtggattgaatattcaggcagatcaggcgctggcagtagatttactggcagaccccaaagaacgagccgaacacatcatgctgatggatctagggcgcaacgatatcggccgggttgcacggacaggcagtgtcaaggtcactgaaaacatgcaaatagaatattattcgcacgttatgcatattgtttccaatgtcgaagggaaactcaaaccggatctgaacgccattgatgtattacgcgccactttcccggcaggcactgttagtggggcacctaaggtcagagcaatggaaatcatcgacgagctggaaatctcaaaacgtggaatctatgccggtgcagttggttatctcggattcaacggtgatatggatctggctatcactatccgtaccggaatcatcaaggatggtatgttacatgtgcaggcaggtgcaggcattgtcgccgattccattccacagaatgagtggattgaaacatgcaacaaggccaaagcattattacgcgcagcagagattgccgaaaacggactagacagtgcaattacctgaatattctcttgcctgctggcaaagaaattttacttcaagacggattggaacgagtacctaccccgtattcgtaaacaagcttgcctcccagccaaccagcaatacagagaacgatcaaccctaagaccgacaaggcaacagcagccaggcctggttgtcccaaccgggtgccgtccaaccgcagaaacaggctaactgtgtacaacgaccagctggccatcatcaacagcatatgctgattggcaattttcatggcagggctttgctgatcaatttttgcaagctccatcaatcctgccaccatggcaaacaatgcactaatcgttccaataatgagcagcaccccggccatccggctgaccagctcatttgtcgtaaacaaactagcaatatcacacaacgttgatataaaccaggttgcaatcggaaaatgaaccaacattggatgaacggggtgtctcatagcaaggtttcctttttcagggttacgttaaaacaatacgctcaacaatgtgagaaagcctgctacggctatccccgcatgaataaaaacaatatttttagatgccacattacctttcatgtgaattgaggcaagataaaacccgcccaatgctgccacaaccagcagacctaatgcagcggtcagacgattatcacccgacccctccagcaccaccagtatcagcgtcaccagaccggctgcacccagcagcgcatgcacgattgaaacagcccacggcgcaagctgcccggaaagcacttttgaagccagaaacaaacctccgacagcagcaatcgcaaaaattataattgcaatcatagtcattgacatctttactccctcctctttttaataatgggtttttactatattacacgctagaatacttttgcaatttaaatatgtcaaaacttgaaatgatgtttaattgatcatgaaatctgctttatcgttgctgggagaacgccagcagtctttgctcactaccttgctgcatcatcgcaaagggttaaccgtagaggaattatccggtctgctggccatttcccggaatgccgtcaatcagcaccttactcacctaagcggcagtggtttcattcaaagttccttgcaggaaagtacgggcggcagacccggcaaggtatacacgctgacacccaatggcctggaacttttccagcgacggtactcatttctggcaaaactgctactttcctggatagataagaacatgggagaacgcgagcttgatacgtgtctgaccgagctcggaaaagaaatggcaaatgggcttgagcatcgcatcacgcaatactcctcatacaatgacagactgcaggaagccgttaccatcatgagtgaacttggttacgataccaagctacatcagctatctgaaaatcaggcagaaatcgttgcaaacaactgtgtttaccaggaactcgctcagcagcacagtgaattttgccaacttgatattagttttttgaagcatctattgaaggctgatatcgagcatacggaatgtattgtgagaggcggtaaacattgtcgtttcaaaataaccggcacaaaagaatcgtgatcgcgatcgccacactggccccaaacagcagcattataatttttcagcttcattcacaatgagaataagcaacagtggctctttaatccggcaaaataacaagcggaaacaaccaaatgtcctcatcgcaattaagaaaaattggcgctttattattcatcgcatcaagcctgctctcgatttcccttgttcatgcaaacgaagatggtttgatcaaaacattgactggctacaacatcaatgaaatcacaccgactccatccatcaaactgaaatttggcggatgggtggaaaccggcttcagtggtaatccgcgtgatccgcgtaataaatctaactatccggtgtcgttcaatgatggtgccaaccagttcaacctccatcaggtttatgcctatatcgaaaaagaaatagatcccggcagagattcgtgggatatcggcatgcgcgccgaccttttgtacggtacagatgcaaaattcgtcaagacttccagctttgactcaaccattctgggagataacccgaaacatcaactggtatttcctcaactgtatgtcaatctgtatgcaccgatcggaaatggtgtaaacatgtcggtcggtcatttttatacgattatcgggtatgagtctccgatgtcacccaacaatttctttttctcacatgcctacaccatgcggtacgctgagccttttacacacatgggtatcatgcttgcctatccggtcaatgacaacctcaccgttaagagtggggttgttacccgatgggatgccttttccaagcactctcctgactacctaggggggctgaattacatcaccgatgatagaaaaaccatgctttccgcatcactgatcactggtgatgtgaaaaccggccctctaaatcatgaccataatcgtacgatgtatagcatcgagctggaacgaagtatcactgataaactgcattacgtggtacaacatgacttcggaattgaagagggaacaccgagttcttcctccgctacatggtatggaatcaatcagtatcttctgtatgatatttcaaaccaacttggagcaggactacgttttgaatggttccacgaccaaaacggaacccgtgtaatgggtaacggcaatgatgaagatttcattggtattacaacaggattaaactacaaaccaattgccggcatcacgttgcgttccgaagttcgctacgacttggctactcgccatcatgtattcagagatagtagagacaatgaccagatactgctctcggccagtgccatcctgcatttttgattctctggatattttctatctggctggccaaacagaaaaaacagccagccagttaagttactgctctacattcacttcttcggcatgtagagatccgtgatcgtaccttcagccagttctgcggaaaaaaggacagtttcggataaagtgggatggggatgaatagtcagcccaatatcctgcatatccgcccccatttccagcgccagcactgtttccgagatcaactcccctgcatgagaacccacaattcctgcaccaagaattcttcgagtagtcttgtcaaagagtaatttggtcatgccttcatcacgcgccagggtgatggcacgaccactagctgcccagggaaatactgctttctcataagcaataccctgtttttcggcttcggtttctgtcagtcccatccaggcaacttcaggatcggtataggccaccgaaggaatggtgcgcgcatcgaatgccgccttgtgcccggcaataacttctgctgctattttgccttcatgtgaggctttgtgtgccagcatgggatctccaacaatatcgccaattgcaaaaatatgagcaatattggttcgcatctgcttatccaccgtgatgaaaccgcgctcatccacgctcacacccgctgcctcagcattgatcagctttccgttaggccgacgcccaaccgcaaccaacactcgatcatagcgttgtggctccggtgcctgctcgccttcaaaaaacacctgcacctccttaccgtccacttcaatccgactgacactggtattgaggtaaatcgcctcacatccagctttcagtctcttatgaagcggtttaaccagatcagcatcggcgcctggaataagctgcgccatctgttccacaatactgattttgctacccagtgcatgatagaccgtagccatctccaacccgatgactccacctcccacaataagcatgcgcggcgggatctccgtcaatgccagtgcgccggtcgaatcaataatgcgttcgtcatccggtaatatcgggatgcgtgcagcactggatccggccgcaataatgcaatgctcaaatgaaactgtttcgatcccatccgatgtttcaacttcaattagatgcgaattggcaaacttcccggcgccatggataacggtcaccttgcgttgcttagccagcatcgataatcccttggtcagcttgcccacaactgattctttccaggaatacagtttgccaatatcaatttccggccctccgaaatgaataccgtactgatccgcctcttttgcttcagtaagcgtttttgcagcatgcaacagtgccttggagggaatgcaacccacattcagacaaaccccgcccaatgtggaataacgctcgatcaacaccacttgtttacccaaatcggccgcacgaaacgctgccgtataccctcccggaccggcacccagcacaaccacttcagcatgcaatttgccacgcgcagtttcaggtgacggcaccactatcctggaaggtactttgtctgcatctgcaacaacgggttgatcggtaactttagtctcatcataggatgatgctgaagacacagcctccgcgtccttgacttccagcgtggcaatgagcgatccctgtgaaatcttatcaccggctttgacgtgcatttctttcacgatgcctgactgaggcgccggaacttctattgaagctttatcggtctcgagtaccaacagcggcatttcctgttctacccgatcccccggtttgaccagagtttctatgactggaacatccttaaaatcgccaatatcaggcaaaactattgttgtaaattgtgtcatcttcttattccctgatatggccatcacccagcacgataaacttctggctggtcagtccttccagccccactgggccacgtgcgtgcaacttatctgtagaaataccaatttccgctcccagaccatattcaaatccgtcagcaaaacgggttgaagcattcaccatgaccgaactggaatctacttcacgcagaaattgtcgtgcacgcgaataattttctgtcacgatagtatcggtatgttgtgatccataggtggcaatatgcgtaatggcctcatcaatatcagccacaatacgaacactcagaatcggcgcgagatattcagcataccagtcttcctccacagccggcttcatctgagaaacaagtgcacatgctgcctcatccccccgtaattccacctctttttccaaaaatatttggcagatacgtggtaaaaactgttcagcaatcccagtatgcaccagtaacgtctccatggtgttgcatgtgccgtaacgctgagttttagcattatctgcaacacgcaccgctttttccagatctgccgacaaatcaacgtatacatgacacacgccatccagatgcttgataaccggaacacgcgcttcattagtaatccgttcgatcaaccccttaccacctcgtggaacaatcacatccacatattcactcatggtaatcagcgcgctcaccgctgcacgatccgtcgtctccaccacctgcatagtctgttcaggcaggcccgccgatctaagtccctctcttacgcaaatggcaatggcctgattactttgtatcgcctcagatcccccacgcaaaattgctgcattacccgctttcaagcatagaccggcagcatccgccgtcacgttcgggcgtgcctcataaataataccgattacccccagtggcacccgcattttacctacctgaataccggatggacgataatccagatctgtcatcgctccaatcggatcaggtagtgtggcaatctgttctagaccggcggccatactgacaatccccctcgaagtcaatgccaagcgatcaatcatggctgattccaaacctttgtttctggcctgcgctacgtctttggcattagccgctagcaataatgcctcatcacgacgaatagcacgagccatcatagcaagtgcatgatttttagtagcggtatctgcttttgcaactatccgcgctgccgcacacgccgcacgcccgagagcctgcatatcagtatgtattttttcgtttttttccataaggaatacagtcgatcgattattaagggtaatccggtgaatcggcaggaattttccagaatcattatttaccggaatctttggcagtcgatccccgccattttcctgcgcgaatcaatttgtttctaaggcccggcaatggataatcaagtgcataagcctgctcggcataatgacgggctttttcgtagtctctctgcttaaaatacatcagcccgaggttataaagaattgtggcattgtttggctccagactggccgccacctgtagctgttcgagtgcttctctatttctgttgtgatgggataaaaatgcgctgtaaatcgagcgaacctgtgcatccttcgtattcatacgaatcgctcgatcaaaataacactcaaccggccatgttaaacccggaatttgagtagacttctccctaatagaaagtttaaccaggctcaccaatgcacgatgatgattaggccaggcacgaagcgtataatttagacttcctccaagccacctgatacctctcccattaagaactaggttttccatatcagaagtgaagtgaaaagcttcaacaatatccaacttttccttaagatgaaaccgattcatataatcaaacggaccatagccaccggaaatctctaattcgccacagtaaacttttcctttagctactaccactacgggtaaagcaataaaaaacatcatggcgataaaagctgccaaaattttcatagcttcctgatttcccataaaattaaatgatcaccctttacaagcagcacccagtagtctggccagctctttagtcctggcctctctcgaattggacaatattttatccattggtgcaatcggtgccttatcttctctcaataacgcaagaaatcgccgcaatccggtcataatagcttccttcgaatccagcggtgcaatcgtgtcgacccccatactgcgaagcttttctgccgtatcgcccaccagatcggtcaatgccagaatgggtcgttgtgcacgcaggtattcgtatagcttggcaggaatttgattattgcaattcgctgcttgtaaaatcagcagcccatcaaccgtcagcatttcagcaagcgcatcattgtaggaaatgggaggtgcgagcgaaacgacagctccgatttcaaaatgatcaatcagggattgcagatacgcttcgtggtgtgaagcacgcagaataatgtgcaaactttcagcaccaattacatgtttcttcagcaaagtagctaaagcttcaaataaacaagttgggtcacgctccgatggataaataactccactgtgtagcagagtaatcccgccaactttggtaatctgattcacagaacgtgtgatagcagcaaaactggattcatcatacccgttttctatcaaatgaaatcgagatgccgggacatgcgaaaaccgtgtttgataatccctcaatgtaccaggtgtcgtaaaaaccgcactggcgcactgcgcgatcgttttattttccacccgttcataagcacgataggttaacggatcgggtggataatccggctgtaccatcggatccctgaaatcagccacccaggggatgcctgtcaaacgatgtaaggttaatcctatcaaatgcgctgttgcaatgggataagttgaccagatcacatccggcttatattttttgatcagataccaccctgtaggtaccgcacccagccaccagcttatccagcgatccggcagggccagcagccgtggatatcgccctttcagagtcaaatgtcttgccgtatccagcgcaaaggcgcgatagacacgtacctcctgcggaatatccgccagctgaccagaatcagtttgctggtaagctcgcggtgaaggagtcagaacaatcggctcccagccatggtccggtaagtatcgtgcaaaacgcaatgtgcgctgcataccgctactgccgtgcaaaggtggaaagtggtaagcaatcatcaatacccgctttaccatgacaatacgcgatttccggtttgttctgctacttgatcacgccattcgcgagtggagaaagtatgattagcactgtctatatgaaaaacttctgtttgccttgttttcatagcttcctgccaatccaccgacgaatcagccagatccagaaattcacgtgctgtcagatcatttccactggtaataatcagtatttttccttggaaacgtttcaggccgtccagcatacgctccggcaaagggactgtcaggtcacatgatgcaccggcactatcttctgaagcagccgattttttaccaccttgcaaactattcctgccaaatgcatataaagaccggatggaagccagcggattgaattttccaccaagcagttttttccagaactccggttcaaacagacgctgcagataatagtgcttcagatacgccttggcgataccctgctctgttctgacccatggattcaataacaccaatccgctcactcgccgatcctgatacgcatagaacaaagcagccgaggctgcgtcacacaacccccaaatcacgacatcctccagaaaagggcactcgctgaagaaaaaatcagtagcactacgcaagtcctcaccaacatgctcgaacgtcctgatatcaccgtcactatcacccatcccccggcaatcaaatcgcataacggaaataccacgctttgccaaatagcgcgcaagtaatacaaactgtcgatggctaccgacacgatattgcggcccgccgacaacgattagcacaccacgcgccaccggttgttgcggcacactcataatcccatacaaccattcatgctcacaacggaagcgcagtgcgcgctcttgaaagctcatggctggaccccgaaagatgattcaaccgccttggtagtcgctgccagcagctcagggcactcactgatttcctgggttgcccagaacggcaacccaggcatgagcagcacttttggacagataccggactgactccatgtctccacgatcgaagtactcgctggagaaagcccgcgcccggtatcaggcgtaatttcaaaccaatatacttcactatttttgacaaccaattgccctaatttcaatgcatcgatagcagcagccatagcagatgagagggtatagcccgctatttcaagtgcttcacccactcccagtttttcacgaaaatcctgaacatttgtagccttatccgtatcatccgacataagtttactcaccagtttcaagcgcaagaactgagtcagaaatgatttgccattgccaacaggctgccagagcacaaatttcactgggtcatcttccgcttcttcattttttgcataatccaatgctagcaaagctcccaatcgcagtccccagaaatgaatcgatgcaaatccttgctgcatcaaccatagcctggcgtgtgcaatatcacccttccagatttcccatgttgcatccccaaaatctccttcactgtccccacagccatacaagtcgatctgcagtacaccaaaccccattgctgcaaacaccttggcttgtaaagcaaccatgcgccgggatttattcatttcctcagcaaacggatggatatagataaaagcctggcttaatggcacccccttgccgggcggatggtaaaggcagaaacgttttcctggcgaagcatccagaaagaaaggttcggccggttgattattcatgcaaattcagtgcgacaatttatgctcaacaaaaagtgccaagctaccgagcgtttcaaaagtctgcgcactgatttcatcgtcatccaccgaaaaatcaaagtactcttccagtgcagtaatcacgttgactactgccatcgaatccagctcggggatattaccgagcagcacagaatcagctgtcagcgcgtgttttctttccccaagattcaatacatcacccaaaatatttctgactgcttcaagatgctgcataattactccacaaaagaccattactcgatatcagcggcattttaagtcagtttcttaaaatatgccggattgatcgctcccacagccctgctgtaaaactatttatttaatatcgagccgctgaatcggatggtgttacagttgatgacaaacgattctcaaagcctaatcataccaaccacatcatgaactggtcagaactgtattggcaacgtatcactccgctacatctccttttgtggccagtcagcttgctatttgtcctgtttcagtctatccggcgccatctatatcggcgtgcgatattaacctcggttcaccttcctgtgccggtgattattgttgacagcatcactgccacaagcccggttaaaacaccactcatcatccagatagtcaatatgctgagagcaagtggattacggcctgggatcattggccacggctacaccgataactatcactcgccaatgagcgtgaccattgatagtcctctgcagctcgctggtaagaaatcactgttactcgcctattatttgcgtgaaacctgccctgtatggatcggccatgatcggatcgaagtggcaaaagcgctgctggaaacacataaggaatgtaacgtactaatatgtaatgatggcctgcaggatcttcgtctgcagcgtgactttgaggtcgttattgttgataccagtgttatcaattccgggaatggtctgatcatgcctgccgggccactgcgagacagctttgctcgcttaaagcattcgaatgtcgtcgtgcaggcaggccatcaaagacaaattccagatatcggggaagaaatccgaacgttttatatcacaccgctgaaagagcattttttcaacctgtcacggcctgaattaacggccagtgcagcagagcttgcaaacaaacgtattcatgcggttacctgtgatccggatatacaaaattttctggataacctcaaatttctaagattgacggtcaccccttacatcttttctgaagatcatcattttgttgcagaggattttccgtttgatgaagctgaaatcattctgataccggaagaagatgcagtaaaatgctttaatctgcacgacgagcgcatctgggttttacaacaggaatatcgtgttgacctcgggttacgcacaatcatacttaagaagctgagagaaaaattcatggatccaaaacttctggacattttagcttgtccactatgcaaaggccctcttatctacaaaaaagaccggctggagctaatctgcaaggcggatcggttagcttatcccattcgggacggcattcccgttatgctggaggacgaagcaagaagactgcctgacgaagaagaaatcaagtagacgacagactttccgcggacggaacctactcctgctattttcccgacaacagaaactaaactaccacttgctcaaagcaggctggttggcgcagcttggatgcagacgactttagtcgcctatatccgcaccaagctaaatacgcataaatcaatatatttaaggtggaagtccccatctaaagatgggggctgtaaagttatgcccaggcactagattgtggaacgtagcttcgcgtggctggggggaaaaccggcgactgcggaaaaactgtgagcaattacccaataccagcttacagttcattcacttggcatttctggcaatcctgccaaaaagactttgaatgggttcttatgataaagcgctgtatgaactgaggtatctcgtcgaaaaagctttccttcatctcaaaaggtggcatgggattgccacaaaatatgctaaaaatacttctttttttctcgcagctgtgcaaatcagatgtattgctctttgggtaaatatcttctgattacactatctctcgcgcaatactttcttaatcgctaacagatatttgtcaatcacaatccgctcatcaaattcctgttccattttttttctgccccgcaaccccatggctgtacgctcagcatgagataaagcaactattttagagattttattagcaagatccgctgcatctcgcggctggcataaataaccattgatgccatcatccacgacatcacggcaaccaacagaatctgttgtcacaagcggtcgcgccattgcagccgcttccagcaaggtgcgtggaacaccctcacggtaggagggcaggacaacacaatcagccagcgcaatttcttccgccacgttatcactcgcccccaaataacagatgacaccttcctccatccactcatccatctgcgaacgggaaatagcagccggattctgtacatccagaaagcccagcagacaaaattccgcattcaatccctgtcccttcagtacgcgtgctgcctcaacaaactctcctacgcccttgtcccacagcatgcgcgcaatcaacagaaaacgtaaggtttttttattgggtaaggatatgggtacaaagtggtcgagatcgatcccagaacctggtagacgatcagtaatcgcatcagataccaattttcctgaaacaaacagcgccctgtcctcatcgttttggaaaaatatctttaccgaacgcgataacgccagacgatataatccccgtaccagtcgggtcaaccagccctcccggatgaataccgaccccagaccggcgatattgttgatgaccggaacagccgacaagtgcgcagccagcgaaccataaatgttcggcttgaccgtataccccagataagcagctggcctttccttgtgcattagccgcagaaaacgccagaacagcaacaaatcccgcccaggatgcgtacccttattatccatcgacaaaggtacataacgacaacccaattctgccagacgtggtgcataattatccggtggtgcaactgccaccacctcataccccgcagcaaccatggcacgaatgagaccagcacggaaattcaccagattccacgcagtattgagtgtaataatgatttttttgttcaatgcgattgtatttcctgcgctatacctgataccggtaaaattttcattccagaaccacattcttccacgtgaggtggtagctctcgaccatgtgctccagactaaaatgagcttctacctgctgccgggcagcagcacagcgcgcctgccaggcaacctcatcctgcatggctatatgcgcctgcaacaaggcatcagctagtgcttccggatcttttggcggcacgacccagccagtctcaccaactattaccgctgcatccccaacatccgtcaccactgcgggtgtgccgcaggccatggcttccgctactacattgggaaacgcttcactggaactggaaagaacatgcacatctagcgcgttcattacatcaggtatatccacgcgttgccccagcagtttcactttttcagttaggtccagttccgacaaccaagcagtcagttgcgtattgttctggtccaatccacgccccaccagtacacaacaaaaatctacctctcggtatttaattgttgccaatgcatccagtaggtttttatgatctttcagtggatcaaaccgccctaccataccaatcagccagcgattctctgtacccaactctacacgcagttgcgtacgagaaaccgcatcaatattgaaacgaaccagatcgtaaccattgggaatcatctgcaacttgtttgccgcatagcctagatcacgatgtacttccagtgcctcctgcgcgcaacagacgataactgatggcacccaggagctaatgcgagcacacaatccagccacccggatggtagaacgcctggatttttcaacatccaaagtagaatggtgaataccccagcacacctgccttattccggccagacgggcaaccacaccaccgattagatcggcatggtacatccacgtttgcaccacttgtgggcgggtctgacgcagcaactgccatagtcgccacagcccaccaggcgtaactcggccacgcggcatatacaaacaagacactgacactccagctttgcgcagtaaaggcccatatttaccttcatccatcaaggaaatgacatggtgcttctcagtgttatcattggtacataaacggtacaggacagcctcggcaccgccatcgttgaggccggagataacgtgaaagatatggctcatctaatacctagccttaatatcagcattaaactcttgtagaacaatatcgataacattaacaacaaaacaggaaaaacagaggcaataaaattagatggatttgcataaaaaatagaaataaagccgatttttatagcagcataggccaaaaaaatacagcacaacgaatcagattttatggcatcaaaaaaagcctgcaataattttataaatccaccaaatactacgctcgttataaaaactccaaaaacatgtgcctgcataagccccagtgttatcaaatcaacgggaattgtcccggttacaccataatctcctttctttgcacctgaaataaccaaggtatttatctgttccacaccttccatcaagcctgtagtccaggaagagggaagcagatacaatggtgaatatagtaaatcggtaaaaccccgatataaataatctccttgttccaactgagaaaaaaaacctacaaaaggaaaagaaatttctttcaccacatagtacgaaaaattatcagctccctttatttcaaagatattactgatgatatacaacagatataaagcagctaggctgccaaccgctccaccaattacaactattctggctgaaaaacgcttaagataaataaaagccagcaaaaacacacacaaatacacaacgaaaccagctctgccagaccacgaatacagtatataaaccgaaaatagaaatgccagccaaaatcccgagaaattaaaaagtgttttattaccatctcttcttgcagcccaaaaaatataggatgaaaaaagtgctagatgaccgaaaggctgcaagaaactccaaggattatttatctcaaaaattcccgacctgatagccctagaatattcaagataagaaaaaaaacctccaaaagcactgacatacagatatctcaacacaaaagcagcaatgagcataaaccacgctataaacaccagctccctgtagttgagaaagaaaatacgcgacgctattccggtgacaaaagaagtaattggcacgctccaccccagaaatatgccaagaatcgtaaataaaacagataggttatagaatacccaagagtctttatcatgagctatcctttctgccccaagaaaatcagctccggatatggcagcatgcacgacagtgacccaccccaacccatataccagtcctgttgccaataacgaccaggatatcaggggagggtattcctttctctgtgtacacacaacggccagtgccagcgaaacaaaaaaaatcagaatacctgcaacacttgttataacaatcattcaatagtataaaaaattattgcgactgactttcttttcgatctaattaacgtagcctctacaagactatcctggcatcaacaaccttaaataggcattaaccgcattcccaacattaaagaacattgcacgttccgcactattaaccatgccgggcgtttgcagattttctgatatcgctttcgccaatgcgttcacatcccccaccggtaccagctttccccatttccctccttccaagatttcatccggcccactcgggcagtcagtactcactactgcagcaccacaagccattgcctgaatcagcacattcggcagcccctcccacctggaagacaacacaaacaaccgtacacgactcatccatgcaaaaggattttcagcaaaacctggaaactggatactatcccgtatcccaagggatgttgccagcatctccagctccacccgtaactcaccttttcccaggatcacgaggcgacagtcgtgcacagcgcgtacctgggcaaaagcacgaatcaaggtagcaaaatctttttgcggtgtgagcctccccacacccagaataacaggtggtttgccctctcccaaccacggatgatccaatggcatcctggattttttgatcaactctggtgttaccacggggttgaaaaccacagatatccgatcacgtggcaagttgatggcttttgccagatcatccgccacgcctccggagactgccgtcacaccatctgctctgcgataggcccaccgcatcatgtgaaacactacgcgcgagcgcagattctttaaggagctgccagataatgaaacgttgttacgttcacttactaccaaacggacaggtatcccagccagcatccgcgccacaacagcaatcacattcgcatggttaagggcagataacattgcctggggtcgctcccggcgcaggtatcgcaccagagcaggcaggctagtcagtacccgattggattgcaagtctactacacgcactccgggtgaaacttcagcaagataaggaccctcagcacaggccagcacaagatccacctgcaaccctttatcagaaaaaccattggccagtgtaaccatagcccgttcagcaccaccaccacgcagagacgggagatatatggcaatatgcattagttcctctctactgaagacatgatcaaatcatcaatcatgaaatcttccagatagaaacttccccctacccacgtcatgtcgtttttccaatagccaggacatggtagataaccgtgagatgcgaatgcatagctcatctctacaaccagtggcttgctttcaagaaaaacaaaatccagagcaagggactgcgactcggttttttttgcaagatcaaatgtcaacctgatacattcttctgggatcatttctgggtcatacaggatttctccacttccggatgctctaaaatcccctgtgcgcaccatccttttgatgccaaaagctctttctcctataactatcacacgaatatcggaatcgttatctggaataaaatcttgaaaataggcataattcttttgaattggcagacgtttaaggatgggattcttaatcaacgcacgaaagactcccctggagatattgaagaaagaaataagagttttatctcttctaaactgccaccagcgctcactcaaagcattccaacgcgaaaccggtgagaaaccgattgaaaaagccttgttaataagattttctgccttattaacatcgtttaccaaaataacattggtacttccagctccacttctcagcttgaaaactttcggatattctgttttcctggcccattccagcgccttggcccggtcgagaaaaacataactcttaaccataggaacacctaaagcttccaacaggtatttctgcgtcaccttatcatcaaaatgccagcaggtttcaaagctcggaaaaacctgaactcccatcgattccgcagcttttattagccctggtgcaatcaacatgtcttcagcataggtttggctccagttccacatcaggaatgaacaaccagccagttcttcaataatatcggacgaatgacaatcaactgttttgtatggaatattcttttgccgacaatacaccatccaacgatcactaaagctcccagggcggttatgtatggctatctttttcatagtaaatttccaaatctaaagaatgtttgcagcatattttctataaaaaaagaatccccacgttgccattatcacccgcgcacccaccagcatgatcactgcaccataaataccaaaggtcggaacgatacccagccctaataagaagaacagaccagacgtccatgtggcaatcagacgaacgtatttatcttttcccgctagcaccaagccattattgtgaaatgaaaggatcatgaaataggcaaaaatcccgcagctcatcaacttgacgtaataagcaaccccgatccccttatcagaaaacaaaatcgccacaagaaaatcagaacaaataaagcaaagcacgaacagaagaacgcccgctatcaacattaacttatgaaactttggtattacgctcctgtttcttgctaaatatggaaaaaatgcgctggaaattatgattcctgcggaattgaatacatcgattatttttgctgctgcactaaaaaatcctaccgctattggtccttcaaaaattcccagtagaaaaaaagcggaattgttatacaaatttggtgtcagctgggtgacaaaaatatttgctccctctctatatgcattttttacttttattagtgagggtactttgtatgtaatcttgtatcgattctcaatccagagcacggaaaagactgcacaccccaccatggctgctgcatataacatcggaacccggtagtaatctgactcgtctctgataaatataaaaataccagccaacatcaagaactttgatgtaatgctgataatggcactttgtcgcatttgctctaccccctggaagaaccagagaggaaataatgcttgtgcggaaacaaagcagaatgagaatgcgtatagcaaaaagtgctgatgaaaatcacttatgagtagcactatcggaaaatagatcagtgcgcttgctacaacgagcaacaggatggcggtgatagtctcgctataaatactagaaatctcttcaggattatcacgattttgtgcaatttttctaaccgctgttatcgagaatccatactgcatcactgctgaaaaatacaaagcgaaagacaaggcataattgatcaggccgaaaccttctatccccaacacacgaaccaaatatggcagggtaatcaatggcaccagataatccagaccccgcaccgccgcaagcgataacagattactcagtactctgcgaaaatcatttttttttctggaggtagcagccaaagaaatagatcgggatcagttcagtgaattatcagctcggtacaataccaaatatacttgttacatcccttttgttttagcactgcatcatatctgttttatattttaaacactataatgcacgtattggatgatcaaaagcagaaactagacaaaattcatccccttatttaatacagaaatcagccttgttccgcgatatattgattgtttgcacaggaaatatatgcagaagccccatggcagagggaattctgcagcatgcactgcccttggcaggaaaaacagatcattcagtcagctctgctggattgggagcattgacaggtcatgaagcagatcccatagcttgtcagttaatggcacaaaaaggcatggatatttctgctcaccgcgcccgacagcttgctgacagcatgattcacaaagctgatctcatcctggtaatggaaacatggcagaaaacagcaatcgaaacacgcacacccagcgcaaaaggaaaagtgtttcgcttgggcgaatggaaaaaaattgatattgatgacccctaccagaaagataaatcagtattcatacattcaataatgctcattgagcaggctgtggatcaatgggtaacaaaattgtaaaaatctgccagagaaatatttcttgacagaaaaccatcagcttcattcaattatgaatttacagcgtacaagagcatcccttgttctcttggtattattcgaacttgctgcctgctccattattcccggacagcacatgagtccgttttcccggcagtccagcacagaaatgcctacccgggaaaatgacgaagccattttaaagaaactcaatattcagacaattgatgccgagctgatcattaagttagaaaaaaattataaaaacttcagcctcgctcctgataacgttgccaaccattattttgattaccgtatcggcgccaaaacgatcaaaggtattcctatagaagatgaaccctatacacaataccgtgtagggccacgggacattctcaatattaccgtctgggatcatcctgaacttactatcccggcgggcgaatttcgttctgccgaatctgcaggaaatgttgttggcgaagatggtacattcttttatccctacgtgggtgtcgtacaggcggctggaagaacagtagaggaaatccgcgaagaactgaccaggaagctatcaaagtacatcgagttcgttcagcttgatgtacgggtagccgcctaccgcagccagcgggtttatgtggtaggcgaggtggccaaccctggcgttcaactggtgaaagatatacctctgactgtcctggaagcgattaacaatgcaggaggagcaagccaggaagcagatttacgtaatatcatcctgactcggaatgacaaaacctacagtatcaatctgctcagcctctatgaaggcggcgatattacgcagaatgtgttactccagcatggagatgtattgaatgtaccggatagtgcgttaaacaaggttttcgtactgggtgaaaccaattactttgtcgcagggggagctaccgggcgatcgcgtagtttggtaatgaataaagcacgtatgacacttactgaagcattaagtgaagcaggtggctttgatcaaactacttcagacccagccagaatttttgttttccgtggcgggctgggcaagccggagatctaccatctggacgccaaatcacctgatgcattactgcttgcagatcgctttccgctacaaccacgtgatgtcatctatgttgatcgcgccgaggggatacgctggaaccagatcatcggacaaattcagccgacaattaatttgctgaattcatttgatggctcgctgagaattcaaccctttctgagacactagttacgtggatatatgccacacattactgcgacaggatagtcatacccgaatacatgactcattcattacctgacatgccatctgatcaaaacagtgacgaaatcgatctgggagaactgctggatattctggcagacaacaagcaactgatttttatcatcacctttatcacctgcatgatcggtgctgccatatcacttttaagcttgccgatctataaggcggacagcttgttacaggtcagagaaaatacacaatccatggttgaacaactggattcattatcaacattctttgaaaccaaaacgccggttcaagctgaaattgaattgatcaagtccagaatgatcctgggaaaaacaattaggaatttgagtctggatattattgcaacacccaggttttttccgttcataggcgccgctgcagccagatggtttcaacgcttccacgagagcggcaccctatccaatccaccatctgaatggctatcacattatgcctggggaggcgaggtcattcaggtagatacgcttgaaatacccgacaattggaaaaatgaagaaattattttgcaatcactcggcgaaaaccgcttcgagcttatttatcagaataaagtcattcttgagggggaagtcggcaaattagctgccaagcagccagaaggctctctgcacccaatcaagctatttgttactcatctgaaagcacgtcccaacactcatttcactctgatacgccgctcccaaggagaagcaatccgacaactaaaggaaactctctcgattgcagaaattggcaagggaaccggcattcttcaattaaccatcgaatcagacaaccgagcgaaagctgttcaaattgttaacgaaattgccaatacctatcttcagcagaatgtcgaacaaaaatcagcagaatcccaaaaaacccttgaattcctggaaaaacagctgcccgctctcaaggaacaacttgaaaccactaccaacgcccttaacgattacagaattcgcgaaggttcaattaatctcgatcttgaaacccagaatatactgacaggtacggtcgagctaaatacccagattacacttctgcaacaaaaacgggatgaactgagacagagatttacggaatctcatcctaatgtcgttgcaattgacaagcagatcagcagactgcagacgcaaatccatgcacttgacaaaaaaataggcaaactgccggaaacccagcaaatcattctcagattatctcgggatgtggaagtcaatgccgagctctacaccaccttgttgaatcacgctcagacgatacgagtagccaaagcaggtacggtgggtaatgtaagaattgttgattacgctataccgcccgatctaccgatcaaacccaaaaaaaccctgatcatgggtattgcgctcatggcaggattaatgttgggagttatattcgcctttattcgccgatcactcagccgcggggtagaaaatcctgacatcattgaaaaatccctgaatattccagtttatgccacggttcagcgcagtagacaccagaagctgatcgagaaaaaactaaaaggcaaacctgtagcaggcaatcatcctccaatcatcctggcactggaaaacagagaagatcttgccatagagagcctgcgcagtttgcgaacaaccttacactttgcatttctggaggcgcgtaacaacatcctcatgatcaccggcccgagtccagaagccggaaagacattcatttcgatgaatcttgctgccgtcatggcagatgccggcaaaaatattttgttgatcgatggagatctgcgcaggggtgacatcaacaagtccatgcgcacaggaagagagaaaggcctgtccgaattaatcagtcaatcgatcgatctgaaggatgcgaccagatctgtgccccaggcaaatttccacttcattccaaccggagcaataccgcctaacccatccgagctattactacacgagcgattcgagcaaattctggaaactgtcaacaagcagtatgatttgatcatcatcgattcacctcccatcctggccgctaccgacgcggccattatcggtcgcctggcaagcgtgacattgatggtggttagggctggaacccatccgatgcgtgagctcgaacaaagtgtaaagaaacttgtactggcaggcgtaaatctgaagggtgtgatattcaatggcattcccgaaacttcatcacaccacagatatacacagtatagctaccaatatgattatcgcagcaagaaatgacagaattcgatctcccgaagcagctcgcactatttattatcagcacgatactggctggccttaccatccgactggcaattcctctggcacatatcagcggcattctggatcgcccaggagagcataaacaacacaaacatctcacaccgtttgtggggggcacaggaatctttgtttctcttctcgctgcccttcctctccttggctacctctatccggaacaatccgtgaaatggctaggactagggatcagctccagcatcatctttatcatgggcctgatcgatgacattatttatcttcatttcaaaacacgcctggtcatacaagccctgtcagcattaattatcgtactggtaagtgaagtgatattgattgatattggcaacttaccatttggcgagatactcgcattacctggcattgcagcaactttcaccatttttgccatcattggaagtatcaatgctttcaacatgatagatggaattgatggtttatctggatccgtgtcactaacaagcttgctgctgctgggcatagttgctctcgctaccggccaccaatccagcctcattattatcattgcactcatcggtggcgttgtggggttcctgtttttcaacttacgtcgccctctacaacctcgtgccaaagtatttctgggcgataacggcagtatgctgctgggacttctgattacctggcttctgatagacctctcgcaaggcagcagccgtgccatgacgccggtaacggccctctggctatttgctgttcctctgatggataccatcagtatcatgttgcgccggatttggcagcacaagtcgccattcaaacccgaccgcaaccattttcaccatatccttctcgatgctgggtatcgtgttaacgacgcagtatttaccattacttctgtgcaactactgtttggcctgacagggttggccggcctgtatctgggtatccacgaacaggtaatgcttctggctttcctggcactttttttcgggtatttctatctgacactttacccatggcatctgattaccgctttacgctatttgcatactttccggggcctgatcccgaccgaaagtcgtggctttttcctgggtagctacacagcagaggaagctaaaaatatagtccacatgatttcgcaagaattacggcccagcctggattcattgatacatgtaatcaaaaataaaaccgctgccaacgacacagaaaaatatgcagtaattgtcaacatacgattgctggatacggataccaaaacgatgaaaaatgaaattggaagcttcattgcatcggcacaaaaacatataaatgaacgctgccatattcagttacgcccttttatagagcgaaacccgcagaatgatcgaagaaaattatctgagcgtgataattcttatggaggaagacgtttggctgactcgcgaaaagataatcagaaattattaatattcgaagcaatatatgaccaggactcaatcgctgaacaaaattccaccgacaatcagcctaataaagaaaattcataatctgcatacctccttgcagacatagcaccaaacctgatcaggtttccttcgcagcaagcagcacgagatttatgcaggctcctctgatccagaatccaccacatctgccatcaccttgccgatatccactgtcaccacccgcgaaacgccctgctcgcgcatggtgacaccgatcagctgctgcgccatctgcatggcgatcttgttatggctgatgaagaggaattgagtttcatcggacatacgcctgaccagctcgcaaaaacgccccgcgttactgtcgtccagcggggcatccacttcatctagcaggcagaatggtgcaggattcagtttgaacagcgcaaacaccagcgccaacgccgtcaaggctttttcaccaccagaaagcagttgaatggagctgttgcgcttgcccggcggatgcgcattcagctgtacgcccgcatccagaatatcttcaccgctcagcaccagttccgcagaccctcccccgaaaatggaagcaaacaattcgccaagattgtgattgacctgattaaaggtctcctccaaacgctgccgagtttcacggtctatctgccgaatcgcctgctccagtgtgtcaatggcctcccgtaaatccagcgattgttcttcaagatgcatccggcgtgatttcaatgcgtccagctcctgcaacgctgccagattaaccggaccgagggcagcgatctccccactcagtcgattgatgcgcatttgcaacttagccggcgattcatttatggattgctgcaacatttccgacgtaatttcactggattctgccagcttgcctgcaaactgggcttcagtcatccccgcttcctgctcacgcagtcgcgcttgccccaccgcctcgccgcacttatgcagctgttgctcagcctgcattcgggcctgttctgtctcccgtaatgtattgtttgtattttccagctcatgtcgaactgccatcagcgcctgttcgtgctgatggcgttgtatctgccaatgcgccgcatctgctgccaacgacgattcatccagatcagcgcgggtatgctgcaacttttgcatgttttcagttagcacaaccttgttccggataatcatgtcgatacgctgctcgcaatcggccaccttgctctggcagttctgctcactgaaagcagtttcacgcaatttgtccaataaacgctgtaccagtgaccgctgcgataccagcgcctgcccggatagctgactggtggattccgcctgacttgcttgcgcttccaacactactctttctgcttcacaggcagtcagctccatttctgcctgatgcttttgggataattcttcctcaatctgtactgccaagtcagccaactcagtttcaagttgggcctgctgttgcgccacgcgctcagttttctgcatcaactgcacaatctgtatctgccgactgtattgttgtgttctggttgtctcgatcgccttgcgggtttgtacgatctcggccacaatatgctgataattctgctccacctcggccagcgtctgctgtttggataaaacagagtgttcgatttgctcacattcctcactgatctgcgcaatttcacgctggcgttgcaggatgccgtgtactgccgaatccggtgcgaaataactcactccgtgcccggtaatactgtgcccttccgctgttaccaacatctcgccagctgccagctgtttcctgattgccaagccagattccaggtcgtcaattacaaatatgccatgcagccagttctccaacactgcttgtacagccggactatgacaattcagcaatatactgagtggtttccaggttgaccgatccggccttattagattgtggctaccggctgactgatccggttctaccagttcgcataccgaccattttgctgatggccgttttccttggccaacctcccaatccagcacctgctccagccgatctacagccactgcctggatacgctcgcgcagcaccgcttccagcgccgtttcccaaccggattcaactgaaatctgtaaccacagccttggcagtacatccagctggttcctggtcatccacgcattcaattcctggttatcttcaatctggttttgcagacgctgcaaaacatcacggcgggcattggcctgggcaaggtcacgttgtaacgattggataacttgtcgaatagcatcacgttcctgttgcatgctatgtatttgtgtttcctgttcaccaagcaaacattggcgctgctccaacagggcagccaactctgcagattccatctgcaattcatccagttgcaccggatcaatctccggctggctcaactgctctcccagcaaacgctcatggcgcattatcaactgctgcaatgttttttcggcatacgcctgttggttctgctgcaatttttcattctgtctggccaatgccagtttttcccgcaatccggtcagttgtacctgatctgattgcgcggccgattctatttgtggcaactctccggcttctcgttcatgttcttctctgcaggaaagatgatcatcctcagcctgtgtcagcttgttctgccaggacatcaggctttcattcgctttatccagttgctgctcatggttttgcaattgcagctctgcctcggcaatttgacgatcgagttgctctctgtttgcacgaatatgttggatactttgttcgatgcgtacaatttcgccttcagcagcatacagtgctccctgggcctgatgctgacgatcattcacgatccggtgatgtacgcgcagctcatcctgtttctcagctatttccggcaaactggagcggataatttccatttcctgcgtcaggcgttcaacctcttcctgcgccgcatgccgagattccgttgcctgctgcttgcgtagggtccagaacgcctgttgtgcagcagctaattgcttatgtaaatcctggtaacgtgtcgcatattcggcttgtgtctcaagatgctgctgttgcttgtccagttcctgcaacacatcgtctacgcgctggaggttgccacgtgcatccgtcagacgcaatccggtttcatggcgcttttcgtggtaacgagtgataccggccgcctcttcaagaaacgcgcgcaattccagcggcctggcttcgataatacgggagatcatcccctgttcaataatggcgtagccccgcccgctaacgcccgtccccagaaacatatcggtaatatctcgccggcgtacacggatattattgatgtaataggaggattcaccatcgcgctggagcacacgtcggatagcgatctcgttgtaggctttccactggcctgctgccttgcctgtgccgttatcgaagaccaactccacactagcgcgcccaaccggtttgcgcgtaaccgatccactgaaaatcacatcctgcaatgattctcctcgcaatgccgaagcacgcgattcacccaatacccagcgtacagcatcaatgacattggatttgccgcagccattcggcccgacgatcccgaccaggtttcccggtacaggtacgactgtaggatcaacaaatgttttaaaaccagctagttttatttcggtcaggcgcaatttggaaggcaagaggttataatttcaggttgcctggttattttaaatgatttacctgtcataaagaagaaccgaaaatcgggagaactgaggaaactatgaccacacagccttcaaagcaactggaaacctttgaaaaccctattcagacacgcgattaccggattcacatggaaattccggagtttacctgcttgtgcccaaaaaccgggcaaccagattttgcgcgactaacgctggattacattccggataaaaaatgtatcgaactcaagagcctcaagctctatatctggtcgtatcgcaatgagggtacttttcacgaagcagtcaccaaccagattctggatgatctggttatcgccatgaaaccccgctttattcggctgacctcaaaattttatgtccgtggcggaatttttaccaatgtcgttgcagaacatcgcaagaaaggctggcaccctcagcctccggtatttctggaatccttcgatgaacagttcaatacccgtagctgatcgctttctttcatacaactcgtcaatctctctcgggaaatagccataatggattcgtatcgcgaagaacatgatgcaatgggtacggtgcaagtacctgtcaacgcactttggggcgcacagacccagcgatcactcaccaatttcaccatttccggagaacgcatgccaccagcactgattcatgcgctggcagtggtcaaacgcgcagctgccagcgtcaatcaggagctgggattgctggaggaaaatatcgctcgggcaatcatcgccgctgctgatgaagtgctggcaggcaagcatgccaacgagtttccgctggtcatctggcaaaccggttccggtacgcaaaccaacatgaacatgaacgaggtgctagccaaccgtgcctcggaaattctgggtggtacgcgcggcaaagatcgcaaggtgcaccccaatgatcatgtcaaccgaggacaatcttccaatgatgtgtttcccactgccatgcacgttgctgcagtaggagccatccgcagccgactgattcctgcactggaagcattgcataatacattagcatccaaggcaaccgagttctcagatattgtcaagattggccgcacccatttgcaggatgccaccccattgacgctggggcaggaattttcaggttatgtatcacagctcgaccacggtcttgctcatcttgaatccgccctgccacacttgcttgaactggcgttgggcggaactgccgtgggaacaggtcttaatacccatccggaatttgcgcagcgcgtcgcagcagaaattgcacacctcaccggctatccttttatcactgcccctaataaattcgaagcgctggccgcacatgatgcattcgttcatgcgcatggcgtgctaaaaacgctagccgctgcgctaatcaagatcgctaatgatatccgctggctggcatctggcccgcgttgtggcatcggcgagatttttatcccggagaatgaacctggtagttcgattatgcccggcaaaatcaaccccactcaggcagaggccgtggtcatgctggcgtgccaggtcatgggcaatgatgttgcgatcaacctcggtggtgccatgggaaattttgaactcaacgctatgaaaccgctgattatccataattttctgcaaagcgcacgcctgctggcagatggcataaaaagcttcaatacgcattgcgccgcgggcattaccgccaatacaacacgtattcagcaacatttacaaaattcactgatgctggttactgtgcttaatccctacatcggctacgacaaggcatccgaaattgctaaaaaagcccatcatgaggcactaacgttgaaagaagcggcaatcaagctcggctatgtcaccgcagaacaatttgatgcgtgggttgatccacaaaaaatggtgggaaataaaagaagtctataaaacggaggaagtaccacctactctaccgatcagataataacccggcttaatagctgaaaaaaattaggcatcctgaattcttgaaattcaggatgcctaatatggtgcactaagtgctataaaattagtatttaccgccaagtccaccaaaccagattgttgcaccaatcgcaataaaagctaccaaagcgattaaaattactttccatgcttgttcatttttttctgcttctctctggcttactgctacatcactgtatcccatggccttatcctcctaattaaattaaatacttttatctcttctcagataaactcccatttgctcgggaaactgatgatgactttattagttcagacacccggcactgctcaccttatgtgcctactattacttctgtaaatccataaagctgaaaaagattctaacccagtttttttgacaatggaagtaaaagtggaggctcggttaaggaatctctgcacgaatcctttagtaaaatttgttattcatcttttttctattgtcatcctcatgcagccagatgagtttcagtgatcttgaacaagccaacaagaagaaggtcacgcgacgagagcaattctttgcacagcatgcccggatcagagtagttgtagacaatttgggcaatatgcacgcacaacatacttttcagtggcagtggttgctcgccacgacacccacttgttgagtagtacagttcgatcagagcaacaagccctgaccaaggaagcaaacgctcatggaagatacactttatgagattgccagcctgcgccagctccgccgttcggaaccgacggcgatgtacgcgtcccacacgaacgcggcactgcgcaaggcggaggtcaatcccatcctggtgaacctatagtggcccccgattttcagacaataaattaaggtggtaacctgctgcaacaactgaggagcaggttatgagcgaaacgaagcgcaagaattttagtggcgagttcaaggccaaggtagcacttgaagcggtccgtggcatcaagacggttaacgaaattggccaggagtttggggttcatccgacacaggttggtatgtggaagaaggagctgcaagagcaggcatccagcctgtttgattccaagcgcggcccaaagcctgccgacccgtcagctagcccggagcgcctgtattccgagatcgggcggttgaagatggaactggactggctcaaaaaaaagtccgggatcagccagtagaaaaccgcaagcaatgggtcagcgccatcgaaccactggcgctgacccggcaatgcgaactggcgggagttaaccgctccacggtctatgcgccgcacatggccgcaaaaccggacgagcaggaattggcactgctgggactaattgacgccgaatacacacgtcatccgttttacggcagccgcaagatcaagcattatctgcgtggtttaggttacaagatcaaccgcaagcgcgtacagaggttgatgggcatactgggccttgccggcatggcgccggggccgaataccagccgcccgcacccgcagcacaaagtttatccgtacctgctcagaggcgtgaatgtgatccgccccaatcaggtatggagtacggacattacatacatccgcttggcacgcgggttcgtgtacttggtggccgtgatcgactggtactcgcgtaaagtgctgtcgtggcagttatcgaatacgctggatagcggattctgtgtggactgcctggggcaggcattgcagacatatggaacgcccgagatattcaacaccgatcagggctgccagttcaccagcgaagcttttactggcgtgctgttaaaaaaagaaatcgccatcagcatggacgggcgtggccgggcactggataacatctttgtggaacggctctggcgcagcgtcaaacacgaggacgtgtatctgaaaggttacatcacgatgcctgaattgctgataggtctgacagaatactttgtgctttacaacacagaaagaccgcaccaatcgctgggctacgacacgccagatcaggtataccgtacagcgagtggtgacggagcaaggattgtggacaaatatagtgagaaagaaaaatctcacacagaagtagaaacaaaaaaagaaaccgaaaaccggggcagcgccgttccgctgcatgaagaaggttaccctcttaaactcgatacattattgtcttgacggaggggtccactataacctgttgatgcactacgccttcggcacgtggatgcagcgcaccaaccccaactgtccgttcgcctgctacgcagatgacgcggcgattcactaccgtagctggaagcaggcaaaatatgtaatgtgatccatcacatcacggttgacggactgtgggttgacgatgcattctgagaaatcaaaggtcgtttactgcaagggcaacaaccgcgccgaacagcatccgcatatgagcttcgccttcctgggcttcacgttcaaaccgaggaaggctcacagcaagtaagaccaactcttcacgagcttcactgccgggagccagtgacgatgccgatgccttgcagcaaatgcgccagagcggtgcacccgctctggcgactcaaccgccagacacacgtgacgctgtggccgacgtggctcggctctacaaccccgtgatacaggggctaaactacctcgagtttctcatgcgaagcgactaatgtatatgattggcccaatccagggcatcaagctctgcttttgccaagctggtttgatccagaaattcaagctcagccataatgctctctacttgtttcatatcccctttttctctggcttcaatcagtctcaatttgcagccaagtcgtccttcacgatgcaacagcgcacgaataacttcatctggcatttccagtttattcactatctgttgaatatccatactaaacaatgtatccagtaaagacattattccagtcatgaaagctcgatcttggtaattcttatcatgcgggcgatcaatggtagcaatcagctccatcaaccttccgcgaatggcagctgtttgcatcaatgcattgttattggttaattttccggcaggatcagcagcatagagcagtaactgaatccatctttgtaaaggacgataacccatcactatcaaagcctgtcggatagagccgattttatgaggtaatgctgctgccacagaattaaccacacgtaaaagactatagctcaggcctggtttgtgcttgaataaccgctcaatctcatcaatctcggcaccgtgcatcactaacgacaataaacgcaacagaaataatctgctggatttgatcttgctacctgaaacaatgataggtttggcaaaaaagtagccctggaacatctcaaatcccaaatccatacatatcctcgcccgctccggactattcaccttctctgccagcaggataaccggccatgctttcagtttctggatcaattgactaatttctgcatctgtcaatgctaatacatcgaccttaattacattggcaaacgggagcaatgcttcggttctatcatcaatacaagtcacgtcatccaacgcaaggtggtaccccatccgtttcaattcggcgcaacgctgtaccacttcaggggtcgccgggatagtctccagcagctccagaactacatgtttactgggtaacaacaaaaccacatcatccagaagcaatccatgatcgatattgataaacccgcgcagattaccaagaacctgctggatacccaggtaaccgtatgcgttcaccaccacgttggccgaggcatgaaaaccatctgaaacttctgcctggttaatatccattgctgtccgaaacaggagctcataagcgatcaacttctgattgcgatccagaattggttgcttgcccaaaaaagcattttccattaaatatctgctattaagaggcaatcatgatgcgatttttaccggattttttggcctgacaaagcgcttcatccgctcgttttagtaaggatttctggctttcacgaagctgccgaaaagcaataccaccactgaaaacaattggaacaggactgccatccatgtctggaagcgcttttttggagaaactattctgcaggcgctgcatcacccaaaccgctgattccagggtggtatccggcagcaatatgacaaactcttcaccaccgtagcgggcgaccacatcacttggtcgtagcgatttttttgctagctttaccagatgaatcaggacatcatcaccgaactggtggccataggcatcattaatacacttgaaattatccagatcaatcataactgcacataatatattttcattccggtcggcacgtgctgcctcccgtaaataaacagcatccagaccgcgccggttgaatgcccccgtcattggatcgtaatggatgagctcccgcaactgttcaagctccagcttaagtgattcgatctgattctcagcaagccgcacctgttcttgtgcgctatatatttcgttgctgtaacgcagactcttggtttcacccagcactgtatccagaatatcgataatctcatttacatcactggtttctcggattcgacgagcgtattgttcaacctgttgactatactcatctgcaccggttacaagtttctggctctttccttcagccttggttctttttttgcctgtagtcgaagatttgaccagctgcaatacctttttctcatccgaaatctgcacaattatcctcctgaaacggtaccgcaatcgttgtaatcacccggagaaatccggaaatccacctaagaagagtgccaaccgggatttagaaaaaccttaccgaagcattcatttagtaacagaaaggctaacagaacctgtttagtgcaaaagaaggaattaaaggaaaaccatgccggtattcaaccatacaaccgatcagatgtttttataaacatctggcaggatattagagatatcctttatttgatacataccgcacgtacctgatgaatatcggtaattccctgcagcactttttctatcccgtcctgtttcagggtacgcatgccgtcacccagcgcggtagtcagcatttcagcaacacgcgcgtgttcctgtacattttttttgagtgcatcagtagctgtcagtagctcgtgcaaaccgacccggcccgcataaccggttcccgtgcaatgctcacaaccggccggctgatacaacgtaatctgccctttttcatccccatattgttggatccagcgggcttcaatttcacgataggctgcatcaggatcagccttgaagtgctcaatgtttttcagttcctcacaatactctgtcagtaacgcacaaatttcctcccggctggccgggtgtgcttttttgcatttacacaaccgcctggccaaacgttgcgccaaaatccccagtaatgcatctgaaaaattgaatgggtccatccccatatccagcaagcggatgatggattccggcgcactgttggtatgtaacgtggcaaataccagatgcccggtaagcgaggcttcgataccgatcccggtcgtttccttatcacgcatctcgcctaccatgatgatatccggatctgctcgcagaaaagatttcatgatggtggcaaaggtcagaccggccttggtgttgatttgtacctgacgcaatcctttttgcgtgatttcaaccggatcttccgccgtccagattttggtttccggccggttcagatatttgagaatggaatgtagtgttgttgttttaccagaaccagtcggcccgcaaacaaaaaataatccgtagggtttactgataattgatttcaattgctccagattggcaggagtaaatcccattttttccagtggaatcggctcacctgccgccaaaatacgcatcacgacatcttccacgccaccggctgaaggaatggttgcaacccgcagctcaatatcgagcggcgcaaatttccggaacttaatcttgccatcctgcggtttacgtttttctgagatatccagatcacacatgatcttgagacgtgtcactaacggattgcggtaactggcgggaatttcgatgtaaggcatcagtgcaccgtccttgcggaagcggacactggtttttcccttaccgggcaagggttcaatatggatatctgaaacccccattttataggcgtccatgataatgcgattcaccagtttgaccagctcgttgtctgcagcggccgaggcttcatctgtttcagcttccctggtttcttccacgacctcttccagattggagagcatatcgtcaatgctgccccccagattttcagcctctgtggcgccataaaatacatccagcgtagctttgaattcacgctgggtacaaaccgtatagatgattttacgctttggaaaaatctgattgacgatacgcaaggccttgatacgctcgggatccagcgtcagcactaccaatccatcatttccatcatctatcggcaaccagctattgctttcgacaaactcccgtttgagatttttcagcagatccagcggcctgatccgatccgccctgtaaccttcatatttcacaccgaagaagctggccaaagctccgcctatctgtatgacgctgataccaaattcatcaatcaacacatcttccagatcacggcctgtttcgcgtgcccgtctggtcgccagctcaaactcaccggtgctgatcacagcattgacgatcagctgatcataacgggtcttgcccaacagctgctgcatccggtgctgcttaaaggcagccgccagcacctggcaaatttcacccaaactatcaactgtcttctgtgaaaaaggctcgtcagacttattgttaatgagctgcactacacccagcaaatcattatcaccagcactcgggatcggcaccacgagcatctgtttggtccggtatcctgtccgtttatccacttcctgtaaaaaccgcaggtattccccctgtttcctgagttcattccgatcataaacatccctgaaattgacagtttttctgtgtaaagccacgaagccggcaatactctgttcattaattggcaatttcagatcctggcaggagtccagcccggttttaatacgcgaaacaaggctggctctatcaccacttacggtataaattgtcagacgatctgcattaaacacctcgcagatatcccggttcacctcaaacatgatttcgtcgatattccctgctgcgtgaatcctgtcaatcacggaacgcagacgattggcggaattgagtgaaattcccgctgcggagacaatgcccgagccagcttgaaaaacctgagatgtactcatgtttacgctatcctaaaattcaaatatctgattactcatcaatctgtgggggctgaaacgcgtaacgcccgcaagaatctcgcgcatggccacttccgcctctccttgccgtaggtgggtaatatatatttcggcattatgctgcagtttattcagttcatttgccaacatagccggatgaaaatgtccggcacgtgctgcgatatcctgaccggcgtcactaaaggcggattcgataatcagatagcgcaggtttggaatctggttgatagcttcccataacgcatcatcagcagtggtatcgccggtgaataccaggctggattgcccggaatcaagctgaaaacctaccgctggaactatatgacacgccggtaaaggcgtgatcctgcgtgaacccagcgccacagcttcacccacagtaatcggctcatagcgcatataaggatgaactgcatcaggaatacaagaaaaatccggccagatatgccagttgaaaatatgtgcctgcagacacgccagtgtagatggcagagcatgcacaatcagtggtcggtcgcgcagactgccagctgtatctaccaggaaaggaatgaaagcaatgtgatccaggtgggcgtgcgtaacgaatatatgatcaattctcagcaggtcatccagagtaagcgtgccaactccggtaccggcatcgatcagaatatcttcatccagcaacatcgcagtagtatgggaatcactccctattccaccgccacaacccaatacttttaatctcaagactaccaatcctccattccggatttaacggaaaattgcagcagatcatttactgcaataaatggaggattacggcttatttccgctattatttaagtaataataccggaacagttgaaagctgaatcagcttgctggcaacagagccaagcagcaagcccttgacagcgcccaacccgcgcggaccaataacgatctggtcacattttatttcttcggcaaattgcaagatcatggtctccacctcacccacaacaatatggtgtcggtaagcgattcctctttcttccaggtaatcacgagcctgcttcaggcctttaagcccttcctctcggtaataatccccaatctcctccttgctgacaaacatggaaacattaccagtcagcggaattcgcacattcaataaatgaatctccggtttttcacggtaccagtcgagccgttttacaaattcctcaactgcccgttcggaagcctcggaaccatccactggcagtaacatttttagcataagacccccttttcacgtgtaactcatcacaaacaacactttgataatcagctgatacttaaaatttactgcttgaccattctgcaacatatgccacctgattacccggattcaatctttccccagcaaatcgactgaaacacccatacttttatgtatccgggctgccagccactttccaataccgatcaccagcagggaacagcttatcggggcaagccaatgcagataagcagcctgtgtatccacccactcctggctaaccgtatcagtcgtcagcaatccaccagcaatccagccaagcaaaccggcaccgacaacaacgataacgggaaaacgctcaatccatttcatcaccagtttactgccccagacgataatcggtacgctgaacaacaagccaaatatcaccagagcgagactgtccctggctgcgccggctatacccataacattgtccaggctcattaccgtatcggcgacaatgattgttttgatcacactgggcagggttgcccccccccccttcacaatcggtccgctttcgctggtgcccggttctggtaacaacagtttaacgctgatccacagtagcaaaaaagcaccaattatttttagataaggtagtgctaataactggagggcgaaaaaaaccagcaggacacgtatcccgatcgcccccaccatcccccagaatattccctgattacgcttgttctcaggcaaattccggcaggccaatgcaatgaccacggcattgtcagcgccgagtgcaatatcaatggcgataatctgaaaaacagcaacccagaattggggatcggccattcccatcatttttactcctgttgtccgaaaataaatgcaagcacttcatcccgctgccgcaacgtgtcctgataacccagatcaatcagcgcctgacagaaaggtgcctcaaacaatacatagctgagcatggccgaaccttttggccccattgcgccggcagcatggaaaaaatagcggattgtacgcggtaaactgctggcatatgcctgcgccagttcatcaattctttcacttggtgtaattaccatgcagtctatcgtacgtaacaaaggcatatttcctgtttgtgtttcaggaatcaagctgagtgtctggttaatacgtcgcaagcgctcaagatcggcatccagaccgtcaacaaaaatactgttcatcacatgtccggcaatctgcgccggaggtggatagccagtcaccttgatacgttcgcaatcagcttctttcttttcattgacgctgatcaccagcaagcgatctgcccccagatgtaatgccgggctcaacggcgcaaactgccgcatggaaccatcaccaaaatattcgcgattaacccggattgccggaaaaatcaatggaatcgaagcagacgccatcaggtgctggataccgatacgtgatggaacaccgatacgctgtgcacgcttccagggaataatgctgggattagcctgataaaaagtgaccgattgctcggaagcataaccccaggctgttatgccgagcgcatgcagcgccccggcatgaatactcctgcgtatgcctctgaaaggcaaatgacaggccagcaattgtctgagcggagtgttgtccagcagcgaaaccggtttccccgccattctgcttgatacaatcgagccaaaatagcgcaacattgtatgtaacacgccgatcagatcagagcgataaatctggccagtatgaagattgctccatacggcttccagccgcttgattcctgtcaaaaaatgggttgccgccatggcgaggcctgcggcgttgatcgccccggcagaagtgccacaaatcaccggaaaagggctgcgtgcatgcgatggcagcatttcggcaatggctcgcaatgcgcctacctgataagccgcccgcgcaccaccgccggtcagaaccaggcccaaccttggctgctgtgaatcatttcggggtatttcactcacgaacaactcattttaggacattctttactctgattcctgccaacatcattattctcgttcctgcttacctttcattaccatgcccacactcgcgcgactatacagtaactctcacatcagtgagatattctcatgcatcctgcgtcagcaaaaaccggttaacaacatcctggccgaatcacaggttacagccctaacaaggcaaagtgctaaaataccctagcacagacacaatcagcattttccctaaaaacaaactgacacatcactcactatggcacacaccgagcttttcccccctattgaaccctataatcacggcacattgccactggatggcattcacaccatgtactgggaacaatcgggtaacccggaaggtattcctgttctgttcctccatggagggcccggtgctggtgccacgcccggtcatcgccgtttttttgatccggcacattaccggattgttattttcgaccagcgtggtgccggacgttccactcctctgggtgaaataaaggacaataccactactctgctcatcacggacatcgaaaagctgcggcaccatcttggtattaaacaatggctgatctttggcggatcttggggcagcacattggcacttgtctacggtgaggcgcatcctgaacgctgcctgggatttgtactacgtggtatttttctttgtcgccccagtgaaatccactggtttttatatggactacaaaatatttttccagaagtctggcacgaatttgtatcccgcctctcgatagacgaacaacgcgacattctcacttcctactatcgtttactgattcatcccgatcctgatatccatctgccagctgcaaaagcatggagtcgctatgaaggaagctgttcaaccctgttacccaacccggatacagttgattatttctccagtaatactgttgcgctggggctggcaaagattgaagcacactatttcaagaataatatttttctgccggaaaatagcttgctggacaacgtgcacaagattcgccacttgcctggtgtcattgttcaagggcgttatgatgcggtttgtccgattgtcagcgcatatgatctgcacctggcttggccacaggctgagtatatcgtcgtcaatgatgccggccattccgcctgggaacttgggattcaggctgaactcatcaaggctaccgagaaattcaggcagatactgtaatcaggcctgaatcacccggttaccgtaatctggaaagatcaagatattgcgcaagttgctgcacgtcaggttgcgcttgatacggcaagatacccaataatgggcaatccagccattcgaccagtgtttgcaggtttgcttccggctgcaacatatccggatcaattctgtttgccacccagcctgccaatttcaaaccggctgattcaactgcgcgagctgtcagtaatgcatggttaagacaacctagccgcattcccacaaccaggattactggcagccctaacacacaggccagatcacgcgtgtcgtatcgatcgcctgacaaacctgatagcgacagcggcaccatgaaaccaccgacaccttcgacaatcgttatctctgctgctgtttgcagcttctcgcaagcctgccgaatcacttccagatcgatacggatattcgtctgctgtgcagcgatatgcggtgctattgactcgacaaaggcataaggattaatcagtttacgtggcatgctgaccgtgctggctgcctgcagattttccacatcctgccataatccatcttcacgacctgacaccactggcttcattccggcagcggtatagccatgcgtcgaaaacgcatgcaacagcgcacaactcactgtagttttaccaattccggtatccgtacccgttacaaagaatcctgttgccattattacggatccagccccagcttgcgccgcgtctccggctttagctgaactttacgcatctccggtttccaggcgtgcccataaactacttcgtaggttgctggcagcctgccatccttgcgcaaggtttcatattgattgatcacttgctgccatgtcgtcttgcccatcaagccgcgtctgcgcccttgtgtcacattgcgggcaccaattgctttgagatcctgcatagcgcttttgacatcatcgtaggtcaatgtaatatattccatatccatcaccggcaatgaaaagccacaacccaccagcatatcacccacatcatgcatatccgtaaaacgattgacatgactaaacggatccactgacttgaaggcttgccgtaattccttcagtgtatccggcccaaacgtgctgaacatcaacaaaccaccatcctccagtacgcgatgcgcttctgcaaatgtccgcctgagatcattacaccactggaatgcaaggttggaccagatcatgccaacgctggcttcgcgcaggggcaactgttctatgtctgcgcagatatagcctctgggttgatgatgcttgaatggtagccagcgctgccaaccaggtattttctccagcatggctgcacgtgcacgatcatgcatcgtcagcgcaatatccatcgacatgatttctgccgcaggatagcgttcgatcagcttgcgcgtaccgtaaccggttccactgcctgcatcgataattttgccgggaacatatttgatatattccaggcgtgacaacatacggtcgcatatttcccgctgcagtacggcagactggtcataactggtcgccgcctgttcaaatgaccggcgcaacatgcgcttgtcgagtacatgatcataaagcatcgaaacaacccacaaattgctcaggaaaagaaagaaacggcgcgtggccgcaatgaggaaacagcttcaattgcgcctgggacaagtgctgctgcgtccattcagcagcaccaacaggcgcgataacatcattctggccatgaatcagcagcacaggctgtttaatttgatccagttcagctcgcaaatcactcgtttgcagaatctttaatcctgcctgcaacgttgcaaactccggtgacaaaccactcaacatactcttgcgcagccgtgccagtacccgggtctgatcctcgctaccgctaacttgcagtgtcaagaaacgattgagggtttgcatatagtcacgtgccagattttccataaacagggtcagggttaatgattccatcccccatggccagttggcacgtttgacgaaacaaggggtactggcaaccagtactaattgttgtacccgttccggcatctgtaatgccagcctgatcgccacttgcccaccgagcgaccagccgcacacaatgctgttatcaggcaaatggtctgcaatcacttcggtcatctgctccagagaatccagcgcacaatcacggctagcaccgtgccccggcaaatcaatgcagtgcagatggaaacgccgggagagcggctctgacacacactcccatacaccactgtgcatggcccagccatgcaacatcaccagatcaggcccgctcccgcttgtctcaatatgcaaccgggtcatatcagcatccagccagatcatgcaaggctgcactcaattgatcgacatcttccccagcatgagccgcagacaaactgatgcgcaaccgtgccatgccttgcggcactgtcggagggcgaatagccggcacccagataccacgctcacgcaacgcctggtccagccggacggcctcccggcttccgcccaccagcaatggctgtatcggtgtatccgatagcaatagttgccaggggagagattgcagcttttgtcgcaactgctctatcaattgaacaagccgctcccgtcgccagacaccctgactgattaattgtaaactggtcagcaaggcatgtgccagcaacggggctgccgccgtggtatagccataggtacggctatgctgaatgagcgtttcaatcattgacgcttgcgctgccacgaacgcgccggatactcctgctgccttgcccagcgttgccatgtaaatcagatgtggtacatttcgctccacctcctgcggatcatacaaactgcctttgccctgttcacccagcacaccaaatccgtgcgcatcatccagcaacaaccaggcatcaaagcgctgacacaacgccagcagctcggcaaccggcgccctgtcaccatccatactgaatactgcgtcggtgacgatcagccgccgccgggcttgtatcgtcttcagctgcttctccagggtaacaagatcaagatggggataacgaatgaagcgggcacgtgacagcaaagccgcgtcattgagtgaagcatgattgagacgatctgcaaaaatcgcatcttcccgccccatgagcgcagtcaccaccgccatattggccatgtagcccgtggaaaacagcagggtacgtggaaggccgacgaactccgccagtgcctcttccagttcatgatgtgcgcgggaatgaccactaatcagatgagaagcgcccgaacccacaccgtaacgttgtgcacctgctgctactgcttcgatcaaggctggatgattagccagccccagataatcgttactgcaaaaagccagaaaatcccggccatcaatggtcacacgcggggattgcggcccttccagcacctggcaaaaacgatacaacccttcctgcctgcgctgttgcagcgcttcagccaagtccggcagcatggtggttaaagtgcatgcaatcccagtttttcgagcaaagctgcgtcctgttccgtatccggattgccggtcgtgagcagtttgtcaccataaaagatagagttggcaccggccagaaaacacagtgcctgaatagcttccgacatctgtcggcggccagcagaaagcctgacctttgctctgggcatggtgatacgggctgctgcgatagagcggacaaattcaaacgggtcgagctcaggtataccatacaaaggtgtgccttcgacctgcaccaggtaattgatcggcactgattcaggataaggatcaaggctggccagttgtgcaatcaggccggctcgggctgtacgtgattcccccatgccaacaatgccaccacaacaaacattgatattggcaccgcgcacttcgtccaatgtatccaggcgattctgatattcgcgtgtagtaatgacctcgccataaaactcaggagaggtgtcgagattgtgattgtagtaatccaacccggcctgcttgagttgaacggcctgcccgggtttcaggatacccaatgtagcacaggtttccagccctaaatccttaaccgcactgatgagctcggtcatgtgctcaatatcacgttgcttgggtccccgccaggcggctcccatgcagaagcgcgttgcgccactttccttggctttggtggccgccatcactacttcctcacgcgacaaaattgcttgattttccaccccggtatgataacgagccgcctgcgggcaataggcgcagtcttcagaacatccaccagtttttactgacagcagcgtagacaattgcacgccattagcatcgtgatattggcggtgcaccatttgcgcctgaaaaatcagatcattaaacggcaaatccaacagtgattcaacatctgccaccaaccagcgtgacgatgattcttgctgtactgccaaatcagggttggaatatgtgcatccgcactgtttttcagaaattaaatcggttcgggattccatgatcattctcggcgatagcctgctccaagttataataaatgataggcgatcattacggataccttttaggttgtcaattttttcttctggaattttgaacaggcgattaaattttgtgcaattattccaacataagcattgcgtgttatgtcaagtgtctgatcatcgagatatctgcgcagcctgcctgcatgatcttcccagactgtctcaagtacactgcccttcttgcctgctaccagtgccttcctcacagatttgtggtgcctgtctgcgcaagccgcccgcctggaaccacgtcagagcagccgtgcgttacacctatccggttgatgcactgatacaggcactgaaataccgctccgaactgtcgctggcaccaatactggcagatttgctgctgacagaactccaggaagattctttacctgactatgtcattccggtaccgcttcatccggacaggctgcgggatagaggattcaatcaggcgctcgaaatcagtcgtcatctgtgtagaaagacaggatgcaaattgctacctgccgcctgcgtacgcacacgcagcactccttcgcagactgagattccatggaagaaacggaaacagaatgttcgtaatgcctttatctgtacccagcatttttccggaaaacaggttgctatcgtggatgatgtcatgaccagcggcgccaccctgaatgaactggccagagttatccttcgccagggggcaggcagtgttcgcgcctgggttgtcgcccgggcatttccgagttaatcatccgaaaataatacggaccgacaatcattcaatctgacaaactgatcaacatgctacaggtaatcctccatcagccggaaatcccgccaaataccggcaatatcatccgcctctgtgccaacaccagcacacagctgcacctgatcaaaccactgggattcaacttgagtgaccggcaactgaagcgcgccgggctggattatcacgaatgggcacgcctcaccgtgcatgaagatctggcatcctgcctgagcctcatggatggatgccggatttttgctgtcaccaccaaggcaacaaagcactacgataaagtggattatacgactgatgatgtctttttgtttggctctgaaacttgtggattgcctgttgaagtactggaagatttctctcaggatcgccgtatccgtattcctatggttccttcttctcgcagcctgaatctctccaattcagcagcggttattatttacgaagcctggcgacaaactggttttgatggtggtgtctagagtgtaatattcatccggttgttcaccctcctcatatcaggcactatgggaatgtctccttacagcagtacaaacaggacaggaaaatgaatctccccttttacaccatcggacattcaacccgtacattggaagaattcgttaatctactgcgtacggtacaaatagaactgattgcggatatacgcactgtgccacgatcacgaaccaatccgcaatacaatcaggacacattacctggcaggctggcagtattggggatcggctatgaatacatcacgcagctgggaggattgcgcggtaaatccaagactgtattgccagatacaaacggcttctgggtgaaccagagttttcataattatgctgattacacactttcagttgctttccaggaaggattaaacagactgattgaactggggcgcacgcatcgttgtgtcatgatgtgcgcggaagctgtttggtggcgttgtcaccgacgtatcgtttcggattacttactcgcacatggcgaaattgtctttcatctgatgggacacaatcgcgtagaagcggcacacctaactgagggtgcgcaaattcaggctgaccacactatcatttacccattataactattgacaagatcacctacaaaaatgcgccccttttcaggaacaagtcggataaagctgtcagcattatgacaatctaataggattatcaaataagtatttatgcacacacttcatttacagcattttcttcaatcatactgataacgctagaaacccttataaacttaaccaaaaaacagaaaatgaatcttctttacaagttaatctcaaagctaccaaactatatcaagtcatttggattattccatggttttcgtttactactcttgattgaaggtaccattttcaaaacatctacaataaccaaaaaatatactgtaccgggttatccggaaccaatatatttacggaaaacaactagtgattattcaattttctggcaatgcatcgttcagcgtcaatataacatgttgcgatttccgcaaagcaaccggttaatgtccacatatcaagaatacgttaagaaaggctataagccattaattattgattgtggtgcaaatattggcttatcagcattatttctggcaaagttatttccaaaagccactatatatgcaatcgagcctgatgaaaataatttcatgatgcttaagctaaatatagcttctctggaaggccgtgtagtcgcgttacgagggggaatttggcacgaaaatgctaacttacgtattattaatccagcatcaggatcagcaagtttccgtgttgcaactacgactactatcgataactcaaaagaaataattcgcacttatacaattgatgaaatctgcactttagccggaaccagtaccccatttattgttaaggtggatattgagggagctcaaagtaatctattcaaaaataataccagttgggtcagtaatactcaccttattatgcttgaactggatgattggctaatgccttgggcaggaacaagcagatcatttttttcatgtgtaagccaatatccatttgactaccttatttctggagaaaccattttctgttttcgcgattttggaaactaaatatccaccggttaaagtcggtaggtttaagttacggactaaaaatattattgtagtctatctattctgtcactttgtctggatacaaccactaaaaacattgaatgccagtcaatcaggtaaccgaatctgaaccagcttcagcagagcatctttattcacaatccatacacgatagcgcataaaaaatgatcaggttaaagctcattacgccaaacctgatcatcactgtcaaacaatcggttggcttcagccggcccccagctgcccgcaggataagttgagatatattcacgctcaaccgtccagaatttcaagattggatcaatgactcgccacgcccattcagcctcatcaaagcgaataaacaatgaacgatcgccttcaattacatccagcagcaaggtttcataagcacccagcgtttgctcatccgtcctgaggaaacttgcattcatttgtattacgcgggtattcatatccaagcccggttgtttaacgtgaatttccatatgcatggattcttccggttgaatcgacaacaatacccagttagggtcgattgactccagtggtgtttcacgaaaaagttgctgcggagggtgtttgaaacgaatcgcaatcattgaatgccgcctgggcatacgttttcccgttcgcagataaaacggaacaccgcgccaacgccaattatcaatatagaatttagctgcagcaaaagtttcagtaattgaatctgactcaacgttttcttcctgttggtaacccaccaccggctgcccgtcaatattgccatgtgtatattgtgcgcgtactgcatgtgcatgcactgcgcgtttagcaatcgggcgaatcgaacgcaacaccttgactttttcatcacgcaacgcatccgcttccagagcaggtggaggttccatcgctaccacagttaacagttgcatgagatgattctgcaacatatcacgcaatgctcctgcgcgatcataatagcctgcgcgtttttcaataccgattgactctgcaaccgtaatttgtacatggtcaataaaattgcgattccacaatggctcgattattgtattggcaaaccggaaaaccagcagattttgtactgtttccttacccagaaaatgatcaatacgataaatctgttcttcatcaaaatactggtgtaatacacggttaagcacttgtgccgattccagatcttccccaaatggtttttcgatgaccacccggttcataccgcgtggctcattcaaaccagcaactttgagatttttaattaccgttacaaaatcagctggacggattgccagataaaacactgtgcgagaacaggctgatccaggtgctatgtccgcagcaagtgcgtgataggaatctacctctttaagatcccctcgcaagtaacgaaagcgcgccagaaaacgttccagtaacgcttggcaagacggctgatcaagtttgttttttagtatcgaacgtacgtattcaagccaatcgtccgttgtccattcccgccgtgaaatagcaatgatggaaaggttatcagccaagcgaccggcatgctccagatcaaacaaggctggtaacaatttatgtgcggcaagatcccctgttgctccaaaaataacaaacgagcaaggtaaattttgggattgatccatttttgcaccacccattatttagtcctttttaacagcatggccgccaaagccatgacgcatttttgctagcattttagcggcataatcatttttcccctgtgaggcaaaacgcatcatcagtgcaagcgtgatcacgggcacaggaattccttgctccagggaagcaagtgtcgtccaacgcccttcaccggaatccgccacgaaaggagcaatatcattaagcgcctgatcttccgccaagaagtccgcagacaaatcaagtagccacgaacgcaccacgctgccatgccgccacaattcggcgattgcagcaaggtcaagatcaaatccaggtttgtccttcatcagcgcaaacccttcggccaaggcttgcatcatgccgtattcgattccattatgtaccatcttcacgtaatgccccgatccaaccggcccagtatgtagccagccggtcatcggggttggcgccaatgcttccatatagggtttcaggcgtgccgcagcggcatttgatccaccaaacatgatgcaatagccgttttctagcccccatacccccccagaaacccccgcatcggcaaattcaataccttgctctgcacaacgtgctgcacggggaatatcatcttgccagtgcgtattggcaccatccacaatcagatcacctgccgatagcaacggcaacaatgcagaaagtgctgtttcagttacttcgcccgctggcagcatcagccagatgatgcggggcttttcaagtgaagcaaccaggtcagcataacttttgcacgctgtgtgtcccatgtctctggccaatgcttcggttacattaaagctgcgattcgttattgcaatttttttatctttctcggcgagacgacgtgccatgttgccacccattcgccctaaacccactataccgaattccatatttttctcctttgagcagatacaatcaggaatactggcctatcagatacggaatcaagaacgtcagtctcaggctgaacccgccatagctgcaagttccattgctaatttaccaagtgttactgaatcgtcgagtccatccagcaaacgttgcgggataccggacaagccggtttgcgcgcctacgagtgccccggtcaatatggcgcgcgacaaattttgcccaccaccattaattgcatgtaaaacagccgattcaaaatcatcatgaaaccgggcagccagataataagcggcaggtagtaagtgataaattgcacacggcatgccatacacaatggataccttccaggctggctcaatccgaatatcaggatccactgccgccgcagccatataagaaggcgtaagcaatgcatctggagaagcaaaacgcccagcacgtggtggatccggatcaccagggcgtggtggctgcagattgtcccccgtcacggcgtgaaatggcagcgcaccactcttcacgagattcatgagctttccagataagctggtatccagcgcatgcccctgaatcaacagtcccagcacagcaccgtaagctacagtcatcgccgccaccatctcatcagactgggtcagtgtcgtattgtctgtaatggctactgcgagtttgtctggtcggaacgcataacgaacagcaatggccagcgtacgctctgctgcctcggtggtatcggcatgacctccggtctgcccccaatgcagcttttgctgtacgcgtcgccgccaggtttcacggattgattggctggtgtaaccacccgggccattgacaggcgtaccgtcaagcaatggaaaaagtgtttcatccatacggcggcaaaaatcctctgcctcgtaaccaccccgctcgaccagcgactgaaccattagcttcaggatgaaacccgcctgtgatagctgccctgcttttaatccggcatggtagcgatttggtttgggatcagcatagtcggcaatccagtcaccataatcacgacgcaactcggagagatcatagtaccaatgcggccccagccccaatgcatccccgatgaacgcacccataatggctccggcggcacgatcctgtatatttttgtctgacataaaacctcctgtttcatatcctgaagaaataaattctgcaaactcgaaattcaggccggcttcacttgaaaacactatgttacgcccaacaaaacaaacattgggtacaactgcgggttattcggctcttatttcgttgaacaatacttcggggccattgaccggctggtagatctcaacgactttatgccgggattgcgcaccccgtttcagggtgatgcgcttcagggggacattgaagcgttttgccaaaaatactgctaaagcacgattggctttgccatccactgggggagccgccagttttattttcagctcctcaccatgcacaccgattgcttcagtctgcctggcacccggctggatatagagcttcagtatcagattgtgatcgcgatcaagacaataccagtccatcaaaacgcatgcacaatctgacgctgtaagttctccacaaccatcatcagcacctgcagcagaatcaaggcaaataatggagaaaggtcaaaattggctatgggaggaataaaccggcgcaacggttccagaacaggcccggtaaaactttccagcacgggcgccaacgggctgtgcggattaatccaggataatagggcctgcgcaatgatcgtgataaacagaatattaagcgtcatgctggccagcttgatgaatgccagtaagataaatgcgaatatactgacactcgcgccagagtctgccaacagattgatactgatcaaaataataaattgagctaaccaggccagtacaaaggtggagagatcaagcccccgccagctgggaatcactcggcgtgctggccgtacaataaaatctgtcacaatgaccagaaatcttgaaaccggatgaaaataaggaatgcgtgaccactgcacatagaaccgcagtaataacgccagagaaaacaggccaagaactgtgtccagcaaaaatattattatttgattgggcatggttttttccattgaaagttataattgtttctaccccattatctggatacagactgaagagcaccttaagtattacgtatgtctaaacatttctcccatttcccgggaacgatcattggcaatatgtatagcgcgaataaatgcacccctgatatcggactgttccatactgagtaacgcttgttcggtcacccctcccttcgaagttacacgtgttctcagggttgcaagcgtgtcatcactttgcacagcaaggtatgtcgcccccaggaatgtttgcattgccaactgtttcgcggtatcagctgtcaaacctagctctgccccagcctgctgcatcgcctccagaaaatagaagacatatgctgggccacatcctgacaaagctgttacagcatccagctgagcttcttcatctacccagacgatagttccgattcccgccagaatcctcgttgcttgttccttctgccgggtatccacacgaggcagagcgtataagcctgtcaccccctttccgattaaagccggtgtgttaggcatagcacgaataataaactcatgccggttcagccactggcttagatcgtctgcacggacacctgctgcaatcgaaataacaagcttaccttgaaaaagttgtgctgattcgcttactgcggcatgtaattgttgtggctttacagccagaacaacgatctcgctgccccgaattccatcagctatagatgcagttactgtcatgccatattccttgacaagtcgctgttgctgctgcgcatcgatctctacaacactgatctgtgatggcgtatgtccatgacggatcagaccgccgatcatggcgccagccatattccctccaccaataaaggcaatattcatgaataaccctgatttatctaaatgtacagcaccgataagattagccaaaccctggcagatggcatatttacaaaaatacttatttcttgaacagattgataatcacactcaaaacgatactaacaatcagcatagaagtaatgggtatgaatactttactgtgtcgagtttcaatatggatatctcccggcagctttccaaaccaattaaataaccagggtgccagatgtaatactgccccgataacaagcaaaacgataccggcaaccatgagccatcgtacaatcggttccatataaaaaggtcacataccaataaactgcaataacattaactcataactaatcaaacaagcataacccgataaaaatatataaagaaggtggcgacagcgaattccagcacaaagccgtacttcatggtgtatggtcaacataatcaccgccagagaggtaagcgctagtttagtgaaaacaaatttctgcatgccttcctcaatcaggatcgccataaaatagttaagttctgtaccacctccagacaatatatttatcgtcaaaaaggcatctgtcgcactgaataacacgatggcaagaacacagactacaagacgccatccgtattgatcaacataaaccgcgccacgattggagcgccgctgtgcaactcgcctgccctgtttgattcccaactgatagggacacacaaacgaaatctcagcccgcctttcccactgccgctgatctattactaattgattcgtcgtcattatcttccctcatacctataacccgatcagcttcccgaaaatttacccgataccttacctcatttacacgaaaataaagtgtaaaggtgccggcccagtcacgcaatattactaaaatctgttacctgcaatccgacaacggacaaaagtcgagttgtaccatttatgtttcgttttcataacgtcctactaaaaacacgtgtggcgaaaacctgccagattaagatatactattcggccctgaaaggagtaggtgggcaatatttttatcattaatttgagcgattttccgacttctcttcgtatttttatagcaaaaataggcattttataaaatgaaacgtacctatcaaccatccgttatcagcaaaaaacgtactcatggattccgtgctcgcatgaagacacgtggtggcagagctgttattcgtgcacgccgggcaaagggacgggtcagactcagtgtataacatggacaaatccaggtttactgtccgagctgtttcttgacaaccgagcatgtttactcgttacccaaatcgtgcagactgcgaaaagctgatgaatttcgcgctgtactgagacatcggactgtgttcgaaagcctttctttgcgattgcatataaagctgaagccgatcaacgacggttatgcgcgcatcggcttaatcgtagccaaaaagatcgagcggaaagctgtcagaagaaaccgcatcaaacgattgatcagagaggcatttcgcaagcatagacaggtgattcaaggtacggattgcgtcatgcagctacggcgttctgtggaaccgtcagattctgcgcgcatctatcaggaagctgtaacgctgttacataaagcagccaggcaattatgaagcaactgattattggccttattaaactctaccaatacagcatcggcctcctgattccaccttcctgcaggttttacccaacctgctcgaattatatgcgggaagcgttgacaaaacatggcttgataaaaggattatggctgggtacaaggcggatactccgctgccacccctggaatccgggcggctatgaccctatcccataaaacagccaacacgcccataataaccaacttatctatcacattcttaaagcgtttttactaaaacttttccgcatccccgagcttcaaaaaatggacaataaaaaaatcgtactgcttatcattttttcgacatcgctgctgtttttatgggatgcatgggtaaaagaacaggaaaagttcaacgcccctccacccgttgtagctcaggctaattccgcagccggagtcacacagtcaaaaaataacgacggccttcctattccaggcagtgaactcacagcatcacaaacaggatcggatctggacgggataccttcaagtggagatacagctgattcggttaccccacgcctgttgccttcaggcgaacaaatacgtgtcgtcaccgacaaggtcattgcagaaatcgacacgatgggaggcgatttacggcgactggaactactgcaacaaccttctcctgaagacgagaacgtaccttactctctattgcatagcgaagcttcgcgtacctatgtcgcacaatccggtctggtaggcgagggattgcctaaccataaaacggtttatcaggtggaatcaggcatacgcaactacgaactgactgccggcgaggataaagttgtcatccgcctgctggcacctgaaactcagggagttcaggttataaaaacctacacctttcaccgcgacagctacgtaatcgacatcggcttcgagatagcaaacaagagcgatgccacaatccgtccgtttgcttatttccagatgttgcgtgacgacactccgccaccagcacacaccatgatgattcgcagttttctgggggctgctgtttacactgacgaagagaaatatcagaaaattccgtttgatgacctggacaaaggcaagacagattatccggccaatgcgaacaatggctggatcgccatgctggaacactatttcctgactgcctggttgccgccacaacaaacaccacgcgaatattttgccaagcgacaaagcgataatctctatacagccggggtaattgttccggccggagttatcactgctggtgaaactgttacaaccaccatgccactttatgcaggtccggaagagcaagataggcttgctgaactagctccggggctggagcttactgttgattacggctggctgaccatgatcgccaagccattattccgtttactttctttctaccattcgtggacaggaaactggggaatagcaattatccttctgaccataaccgtcaagctgctgttcttcccgctatctgcggccggctaccgatccatggcaaaattacgcttggtaacgcccaagttgaagcgtattcaggatcaatacaagggtgatcggcagcgcatgcatcaggcgatgatggatttttataaaacagaaaaaatcaacccaatgggggggtgttttcccatactggtgcaaatcccggtttttattgcgctgtactggacaatacttgcagcagtagaactgcgttacgctccttttgcactgtggatcactgatttatcttctccagatcccaaatacctgctgccggttctgctgggcatttccatgtttatacagaccaggcttaatccgaccccaacagatccaatccaggcaaaaataatgcaaattatgcctgttgccttcagtgccattttcttcttcttcccggccggtcttgttctttattccctggtcaataatattctgtcaatcgcgcagcaatggaagattacaaaaatgtacgggactgcccccagtcaagacgctcctgaatcacccgctagtaaagatgctcctgaactacccgtcagtaaccaggttattaacgattcagaaaatacagaagcacctgccagtggtccggctgatagtcctaaaaaacctgttaacattccgagaagaatgcacaaaagaacgagaaagaaataaatatttataacttcaactgctctgtgtcccttttgataaagaaggtatgcaacgccctgccacctccttggtgaagaataatgacaccattgcagcaatcgccacaccacctggccgtggcggcattggaatagtccggatttcagggacaaatctagaacagcttgcccagacaatcctgggcaagcttcctgatccacgtcacgccggtttattcaactttcttgatcaaaacaatcaagttattgatcagggaatcgtgctgtatttcccttcccccaactcctataccggagaagacgtactggagctgcacggacatggcggccccgctgttatgaacctgctgttgacccgctgccttcaactgggtgctcgcctagcggaaccgggtgaatttacactgcgcgcttttctcaacgaaaaacttgatcttgcacaagctgaaggagtagccgacctgatagaagccagcactgccaatgccgcacgttgtgcagtgcgctcattacatggggaattctcatcggcgattcatcagcttgtaagcgcgctgattgatttgcgtgtgctggtcgaagcaacgctcgatttcccggaagaagagattgattttcttcagtctgcccatgccgtggaacagctggcttcaatccagacaaaactggaacaagtattgtccgcatcccgtcggggaaatttattacaggaagggatcaaagtcgtactgacaggccagcccaatgtgggcaaatccagcttactgaatcgacttgctggagacgagatagctatcgtcaccgagatacccggtacaacaagggataccattcggcaatcgatcgaaattgaaggaataccactgcatttgattgacaccgcaggattgagagaaaccagcgatatcgttgaacaacatgggattgcccgtgcctacgctgcaattgaacaggccgatctggtattactattggttgacggccgctatggcgtgaccaaggaagatcactctgtactggctcgtttgccgaaagaactgccagtattgactgtacacaacaaaattgatttatccggacagctctctcgcatagaagaagatacttcaggaacagctatctatctttcagtaaaaagcggtgaaggcatagagctgctacgaacagtactgcttaaaactgttggctggcagaccaacattgctggagaaggtgcttacatggctcgccagcggcatttgcaagcattgctgcatgcaaaagaattactgaaaagagcagaaacctggttgcacactgcagatcatttagaaatacttgctgaagaacttcgccttgcgcaacaagccctgtcatctattactggcgaattcacaagcgatgatctactgggtgaaattttttccaatttctgtattggaaaataaactggataaaaaactgcaatacatgcttctacgaaaattcaataaattgtgacttgtcagtggcaaacgaatatgggttcaggatattcttaatagagatagaaatctggtgggtaataaagcacgattgcttccaataccttgattttatttggcaagctatttattaaagagtaaaattgcgactggttaagtatatggattaattacaagcaggagaaagtaaatggctgtaacaaccgatcaaaaaagccaggttatactggattatcagagagtagcaggagacaccggttcgccagaggtacaggtggctatattgacaacgcgaatcaatagcctgattgatcatttcaaggaacatgtcaaagatcaccactcccgtcgcggcctgttgcgtatggttagtcggcgacgcaaactattggattatctgaaatctagaaatagtgacaattaccggatcctgatcgaacgcctgggtttaagaaaataaaaaaatcatgtggtagttaatcgtactgcactccacaaattatcgcagatgattgcaaagctgcagatgaatctggtcagtcgtctgcactctaatttgaataaccctgatcgatttgcacttaaatataattgtgcagtcgatcttgggcatgatttgatcaaagaaggattattaattgaaaccgataaaaaaaagcataacttacggacaccatacgctcaccattgaaactggagaaattgcgaaacaggcacatggtgctgtcatggtttccatggatgacacggttgtgctggttacagtagtaggagataaaaaaaccaaacctggacaggattttttcccgctcacagttgattatcaggaaaaattttattctgccgggcgcattccaggaagcttctttaaacgtgaaggtcgtccttctgaaaaggaaatactaacatcccggctgattgatcggccgatacgtccgctcttccccgatggtttttacaatgaggtacaagtcatcgcaatggtattgtcatcagatgctgaaatcgatgctgacattcctgcaacgatcggcgcatctgcggcactgatactctccggtatcccatttgatgggcctatcggtgcagcacgcgtaggttatattgacaacgaatatgtccttaatccgaccactacccagctcaataaatcgcaactcaatctcgtagtggcaggcacccaaaaagctgtgctgatggttgagtcagaagctaatgaactctccgaagatgtcatgctcggagcagtaacctatggccatgatcaaatgcagcaggtgatcaacatgatcaatgaactggctgatgagactggtgtaaccgcatgggattggcaaccggcagaaaaagatcattcactgattgaaaaaattactcaactggctgaagcggatttgcgcgatgcattccggctgaaacaaaaatcggtcagaacagaagcaattagtgaaatctggcaacgtgtatttaccgaattgaaagcaggtactgaggaaggccccagtgagcaaacgatcaaggaaatcggttttgcgcttgaagccaaaattgtgcgtaacagcatccttgatggtgaatcccgcattgacggccgcggaacacgtacagttagaccaattaccattcgccatggcgtattaccacgtactcatggttcagcactgttcacacgaggtgagacgcaggctttggtagtgaccacactgggaactgcccgagatgagcagaaaattgatgcactccaaggggattattccgaacgtttcatgctgcattacaacatgcctccttttgccacgggtgaaaccggaagagtgggatcacccaagcggcgtgaaattggccacggacgattggccaagcgtgctctgcttgctgtcctgccgccagtagaagaattcggctatgcgatgcgggtagtctctgaagttacggaatcaaatggttcaagttcgatggcttctgtctgcggaggttgtcttgcactgatggatgcaggagctcctctgaaagctcatgtcgctggtattgctatggggctgatcaaggaaggcaatcgatttgccgtactgactgatatccttggtgatgaagatcatctgggcgatatggattttaaggtcgcagggactgaagagggtatcactgcattacaaatggatataaaaatccagggaatcacgaaagaaatcatgcaggtagccttacttcaagcaaaagaagggcgactccatattctggatatcatgaaacaatctctcccaatagcaagagatagcgtatcggttcacgcaccacgtattatcaaattcaaaattaatcctgaaaaaatacgtgatgtgatcggtaaaggcggggcagttattcgcgcactgaccgaggaaaccggaaccactatcgatatctccgatgatggttctgtgacaattgccagcatcagcaatgaaggtggggaacaggcgaaaaggcgtatcgaaaatattactgcagatgttgaggttggcaagatttatgagggaacagtactcaaattgcttgatttcggtgctattgtcagcattcttcctggaaaagatggtctgctccacatctcgcaaattgccaatgaacgagtcgaaagcgttgctgaccacctcaaggaaggccagattattcgggtcaaagtactggaagcagacgataaaggtcggttacgactcagcatgaaggcagccagcacagaagcagcagccactcctgaaaacggtgaaaaataagctggtgttatccgtttaataaatcacaatctgtctccacttcgtaatgttctccggagaccatgtttatttcaatcaagaaatagcacctccggagaaatcttccccattttttaattcattaatttggttggcttgtaccgtaccaatgcggaagaaggcttgcaacagctcccactgcatgcatccgaataaaagatacatcaggttctatctggtcatatcacaagaataaggtatgaatatttatcttgttatcaattttatcgaccatgcaagtagtatcatacaaaagtaagcatcagccatatcttcaacaggtttgtttgttcacaatcctgttgtattttagccaagcgtaaaaaattaaggcataataaatttttatacattcaaggtttaaaaaggtaatggcatgtcgccacacttaaatttccatctccagatactcggaatcgttacatctatactgcctcggctaactgcaatatcctatttcaaaaatagaagggctatttcaaccaggccaaatcgtcgtcaaacacctgttctgctgttatgttcgagcttgttaataacatcttgcgccatgggccctgactattcacgccctcagatcgataccacagaaaaatttcgtctgtctcaaacagaggggcggtccattgccaatcttccttggtgggagctgctccgggatgaaaagctgcaattgctgattgatcaagccttggccgaaaacaaggatctcaagcaagcagcagctagtgttgaagaacttcaggcgcgcttgggtattacacagatggacttcattccgaacattaccatcgatgggaatgcgccgatagaaaccttaggaggattcagccgcaaaggatttccgacaccctataactatttcggacaaaccattttgaactgggaattggatatctggggcagaatccgccgctccaatgaggccgctcgggcagatctgctggcacgcgaagaaaatcgtcgagccgttgttctgacgttagtaagctcagtagcacaatcctatttcgatcttttgcaatttgatacgcaactaaaaattgcccatcacgcattaacttcatgggaagaatctgtcgccatctccagtgcgcaactggaaggtggattgactacccggcttgatctggatcagtttgaagcagagcgtgctgcagctgctgcccaggtggcagagctggaaagacagattgcacaaaaagaaaatgagcttagcgtgctggcgggcagaacccccgcgccggtagcacgaggatactcactgagcggacaatccacccctcccgatattccacccggcctgccttctgaattactgcaacggcgccctgatattttacaggcagaacaaacgctgaaagcagcaattgctagaatcggagtcgccaaggccacgcgctttcccagaataacgctgacaggattttttggattttccagcccggcactggcaagtctgctggattctgacagtaaatttggcgctgctggattcgggcttgcgggaccactgctaaatgcacaaacactcggatacgaacaacgtgctgcagaagcacaggcaaaacaggcattggcacagtacgaacaaaccatcctggtagcgttcaaggaagttgaagatgcactagcagccattcgaacagcaaatgatcagtacaaagccaaacagaaacaggttgaagcattaagttcggctttacagatagcaaatttgcgctatcagggcggaattacaagctacgttgatgtgttgcttacaaagcgaaaattatttgatgccgaatctgcacttgtgatcgctcgccatttacatctagtttctgtcgtccaactttacaaagcactgggtggaggctggctcgctgatggtaccgatgtaccactgccaatatcaaccgggctgctgcgcaacaactgaaataaactataaatagtactttcatgacttttatcccaacttaagaatatcttttgattatttcttcagagctatcgagaataacattatgtatcaaacgcttcgtcaaacaactacgcaagccaatgcggttataacaagtttcttgttgctccttgctcttctggccggttgctcaaaatcatccactgattctcctcctcctgctccgcaggttgaagtcatcactgtcaccactcgtacaattgcggaagaacctgaattcattggccaaaccgaatctttccggccggttgaaattcgttcacaggtaaatggcgttatcaaaaagatattctttatcgaaggccgaaatatcagaaaaggtgacaagctgtacttgattgatccaacacccttcaaagcagcctatctgggtagcaaagcaatggttgcccaggcacgtgcccgattggagcaagccaacaaggatcttgcccgggtgcaacccctgctgaaacaaaaagcagtcagccaaaaagatgttgacgatgctatcgcagaagtacgtagtgcaaaagcaactctggatacggcacagaacgacgtaatcaaggccaaatttgacctggataacacgctcatcaccgctccggtagaaggccggatcaaccgcagtcaattttacgaggggcgtctgatcgaagcccaaaccgatctactgaccaccattgatcagctagaccccatgtatgtcaacgtaaatgttccggaaagttatttgctgcgccttcgccgcgaactttccgagcacaaacttgaaagacctgaaagtattttccagttgcgcggtgtaatgactttctctgatggcagtatttatccggaagaagggctactggattttcaagatattgtaatacgacccgaaactggcatgctgctaggacgcttcgcgtttcccaaccctgctagtaagaatgctcccggagaagctcatttctatccaggccagtttgttaaagttcgtattaaaggttacagcagagcagatgccattctgattcctcagcgtgccgtgcaacaacgaccaagcggctcgttcgtttatatcatcaatgaaggaaaggttgaactccgcccggtactggccagcgcatggcgcggcagtgaatggctgattgaaagcggcctgcgcacgggagaacaagtggttgtagaagggattcacagaatccatccgggaatccaagtaaaccctgttccctaccagagagaagaaagccagacttcctcaagcaaccatccagaataaaccgcgtaaggcgtgccatgaattctcgtttttttattgaacgaccgatttttgcatcggtactatccatcatcattgttattgtcggcctggtttccttaagagatctcccgatcgcccaatttcctgagattacgccacctgtcgtacaaattgatgcggattatcccggtgccagtgcggatgtagtggcggaagccgttgcgcgcccgatagaagtgcagcttcctggtatcgataatcttctgtattacgaatccaccagcacaaatgatggccacatgacaatgaggctcacgttcgaaatcggaacggatgtcgatattgcacaagtacaaactcaaaatcggcaaaaactggccgaaccgcaactgcctgatgaagttatccggcaaggtataacggtcaagaaaacctcacctgatctattgctggtagttgcactgagctctactgaccccgctcacgacaccatatttctgtcgaattatgctctgctcagggtactcgataatatcaaacgacttcccggtgttggagatgcttcaatcttcggtggtcaaaattactccatgcggctgattctcgatcctatccggatggcacaacttaatttcacgccgagtgatatcgtcgctgccgttcgtgaacagaatcgtgattttcctgcaggtcggatcggccgtgaacctgtaatcaatgaaaccgagctcactattcccgttatgaccaaaggacggatgagcgaggtaaaagaatttgaagatatgatcatccgggcttacccggatggctctatggtgcgattaaaagatgtcgcacaagtagagttgggagcacaatcctatgatctgcaagcccgacagaacgggcggccaaatactttcctgctgacttatctttcgcctggtgccaacgcacttgaaacagcacagcgtatccgcaacgaaatggatcgacttgctaaagactttcctcccggtgcatcctatgatgttccttacgacaccaccacattcattgaagtttctatctatgaagttgtaaaaaccctggcagaagccttgctgctggttgtactggttgttttcatctttttacaaagctggcgtgccacgctgataccggctattgctgcacctatttcccttattggtacatttatcggaatggaggcgttgggattctcggtcaatacgctcactctgtttggcatggtgctttccatcggtatcgtggtggatgatgcgattgttgtggtagaaaacgtcgagcgccatataaccaatggtctcacgcccaagaatgctgcaataaaagccatgcaggagttattcggagcactgattgctattgttttggtgcttgcttcggtattcttgcccgtcgcatttctgggaggtatcaccggcgaactgtacaaacaatttgccatcaccattgcattgtcagtcatgatttccggattcgtcgcactgacactgagccctgccttatgcgccctggtactcaaacccggccatgattctcctaatagattctggaaaattttcaaccgaacgtttgattgggcgcagactcgttacgtcagtatggccggcacaatcataaaaaggtcggtactatcaatcttcgtttttttaatagcaatattttttgctgtcagtttattcaaaacagtgccgggaggcttccttccagaagaagatcagggctattttattacgatagtacagctgccagatggcgcttccatttcccgtaccaagaaggttctggaaaaaatagagaattattttctgtcaaatccagctgttcattcaactgatgcaatggctggtatgaactttgtcttcagcagccgtggtccgaatcacgctacgatgttcgtgccgttgcatcactgggatactcgaaaaaattccgatgagcaagttcaaagcctgattgccaacgcctttggtgaatttgcaaaaattcctgaagcattagtgcttgcctttaacgcaccttcaatccgtggactaggtgctaccggcggcttctcaatccaattgcaggatccaagtggaggagatttttcagagtttgccgaaacaacacaggtattcgtaaacaaagccatggaacacccggctataggaatggccggcaccaattttcgtgtcagcgctcccaggctatatgcacatgtagatcgcgagcgcgccaaagctttaggcgtacccatatctgatgtcttcgatacgatgcaagcatattttggcaacttgtatgtgaatgactttatcaagtttggccgcgtctaccgggtacaaaccgaagcaccgcctgagtatcgatccagcccgaacgatatcagcaatatttacgtccgcgctcaatcgggaacaactagcacaatgattccacttgattctatagtgaccgccgagttcaacagtggtccggatccagttacccatttcaacggattcaactccgcactcgtgctaggcagtgcagcgccaggctatagttccggacaggctctggatgcactgcaagaagtggccaatgaagtactggtgccgaagggctataccatcgactggagcggaattacttatcaggaaaagaaggcagccagtggacaaaaaatatggatactttcctttgccctgcttatggtatttctggtgttggcagccctgtatgaaagctggtctattccgtttgctgtgattctggcagtgcctttcggtatattaggagcattgctagccatctggacgcgcggactgactgatgatatttattttcaggtcgggttaattaccctgatcggattatctgccaaaaacgccatccttattgtagagttcgccaatgatctgtatgccaacggtgcatcactgaccgaagccgctctggaagcagcccgggttcgcttccgcccgatcatcatgacctccatggcctttatcatgggggtatccccacttgtgatctcatccggcgcaggggccgccagtcgtatcgctattggtacaactgtactaggaggcatgttggcagccactttcctcgctatatttttcgtgccactctttttcgtattaatcggaaaaatcacacatcgaaccagacgccccattcctgaagttgtacaggttgaaactgggaatcagacaaccctcactgataaccagaaaaatactaatgataactgatagcctacccatcccaaacctgcgtaagaattatctcgctgcacgaggagctgaaaacaatactgatacccaaaaccgggataaagaggaacctacaataatgctgttggaatggatccaccggcatgccctaacgcttgataaagaattgaaagacttacaatatttatttacagacaaatccattactcacgattcccatgggtaatggatgcaaaacaatggcttgattacaatcggtgtgtagctggtatccatcaaagtgattttcaggcgtcaggaggtgagagcccttccttgacaacctccagcccggcaccacattgccaacatagttgaaaattactcggattttcctcaccacactgcaagcagaaaacactatcagttacttgtggggcctgttcataggccgcaacaatcgctcgcccgcgatcatagtcaagatcacgtactacccaaacttccggataagcatgggtaaacggaatttctcctacccctccctgcgcatactcattgaacaacctggatggaatataagcattagccagaaaatcttggataatatgggcctccaacaaattattagctgtataaagttttttcatgcgacaaattgttatccaacgcccgaaatcatcggcgtaaacttgtgtaacgggcgggcatcggctggattacgttgttagctgccggagcgtaatcgattgcaccatccggtataagatcggcaaaatagaatccatcacgctctactacttcgccgacgcttgcacagagtgactcctggaacatcggccctgcaaggacgcacgtgtgaaactctccgttttcgccacatggatcaacactctccggcaaatcgttcagaaaggtatgatcgaatatccggccaacgaatgatggtgaaagttgcttcggatcaacgcacgtcaccacagcgacgacctcggcatcaatcatacgatgcgccagggaatcggtgggttgatgccagataggaaacaatggttgaagaccagagccttcgagctgcttgacgcggtacgcacgaatatctgccagaaacagatcaccaaaggcgatatgcgttgcgccgctctcaacaacacttttgacagcgtcgtgcatcttgcgctcatacacttcattggaacacggccacggcaacggaatgatatgcagcggaagttcaaccgcacgagcttgcgcctcggcgagcgcgagccgagttgagtgcattgcaacccgctcgtatgtagtattaacggtcgtcaggaggccgataacctctacctccggatcttgccgcagtacatgcaacgaccaggcactgtccttaccggtactccaggagagaaagacacgttgcttcattgaccaatgccctatcgtttcaggtgctaacactcaagatataatcggcacaactcgcgtagttggatgacattatgccagccgcttgcgggcaccggccggattgaatcgttatgcattcttgacctcgataaaccatttgggttgcatcgcatcgaaatcctggcggatattggaagacagataactggccgaatccagcacaaaaagttgatcattcagcttgaacacaacccagtctcagaagtttttaccttcttcttgatcatgcttgatagacaacaacgccaaatcaggtaatgtgtccccaggactcaaacggaatttcaccactagacgtttctacacgcgcgagacagcatatgccgtacatactgagtatccaaccacagtgatttggctacccatcgcattggtgatagagccttcatctctaaataggtttccccacccaagaattggcaactgacgcaattccacatccggtagtttcttcctgtactactggcttgagcactgaattacccttaatacataacgcaatgtacaaaacaacttatccaataaaacttgtacagatatttgtatacgatatatcttcaactgagttgataccacgaacaatttaataagtttaacgcaagttcttgttcttggaatcaaccatatttcttgcgattgcgacgacgacgactatgtgcgcgtcgcgcttcttcctcggtcaaaggtggcgcttttttgccagcataaggattatggcctgtcctgaactccactcgtagcggagtaccctttaactcgaacacgtctctgaaggtattttcgagatagcggcgataggtttggggaacatgatcaagcatcgagccgtgcacaataatcagtggggggttttcccctccctggtgcgcatagcgcagttttggccgtgatactccaccgcgtggcggctgttgcttagcaacagccgccaacatgacgcgcgttagcttaggtgtcgggatatgcgccatggctgcagtgtaggcagcatcaaccgaaggcatcaatgctttcactccattgccgtacagagcggaaatataatgcaggttggcaaaattcagaaaggcaagcttgcgttcaaactctcgtttggtggtatcacgctggtagtcatccatgccatcccatttgttgattgcaataaccagtgcacgaccagtttccagtatgaatccggcaatatgtgcatcctgttcagagataccgctttgcgcatccagcaccaggacaaccacgttggcagcttcgatcgattgcaaggtcttgaccaccgagaatttttccacggtttcccaaaccttgcctgatcggcgcaaacctgccgtatcgatcaatgtatagcggcgttggccatattcaaaatcaatataaatactgtccctggtagtacctggttgatcaaaggcaatcatccgctcttcacccaaaagtgtattgatcagtgtggatttgccaacattcgggcggccagcaatggcaatgacggggtgcttttcctgaccaggctcggcttcgatatcttctgcatacggataatcttccagtgcaaaatcaatcagctcaccgagatgttctccatgcaaagctgaaacaacacaaggtgtgcccagtcccaattcatggaattcaactgctgctgttgaataaggcatcccttcggctttattgacgacgagtattatttttcggccagttttacgcagctgatctgcaatgattttgtcttgtgaagccagtccttgacggccatcgacgataaacagcacaacatcggcctcatctacggcctgcagggtttgtctggccatggcatgcaggatgccagatttgactacaggctcaaaaccgccggtatccaccacgagatagggttttagacccagcctgccgtggccatagtgacggtcacgtgtcaatccgggaatatctgccacaatcgcatcacgactgcgagtcagacggttgaataatgtcgattttccgacattcggacgcccaaccagtacgagagtgggtttcatgataaaggagatatgaaaaatgctttacccggaaagcatagaaaaatccggttattgcaaggaaaaagcgaaaacaccgcctttgagtgtttgtactacaaagccatccggtagatattcagcacgcgacaaaattatgcctccatccgtgggtgaacgggcaagcagggagccatcctgacggttgatcagcgtaacaaacccttgatcatctccgactaccagccggttacctctgacgatcatcaagccagagagcttccgactgcccagctttccacgcttccagacggccgtaccactacttttgtcgtaagcagcgacgattccatgttcttcgctgatatatacgtgatggttatcaatcaccatccccatgctgcttgacgcatctctcgcccaaatctgattaccgctggaaatttcgaagcaagcagcacgtccgcgataagccactgcgcacacctggttttcatcgacaatcggcagactgctgatatcagtcatacgttccagctcggtaacaccatgcggttgtgaaacagtttcttcccagcctacattaccggtaagcaaatccagcgcaattaatttcccgccggggaatccggcaaagacagcaccccgggtaattgatactccgacaaaacttctgactgtcagcggcggtgtgacactttgatagctccagatacgttttccatccgttgcattcagaccaaataatttactgtcaccggtacgcacgactacaatgccactgtctgtctttggcgggctcaagacttcaccaggaacccgggattgccacaaggcgttacccgcctcatcaaatgccagcacttcacccttgtaggttccgagcagaatcattcctccgccagcaccgactcctccagaaagctgggatttagtctctacacgccagatctcgcgacctgtcaccgggtcgagtttgaccaaacgtccatcttcatcagcaacgtaaagggctccgttatcgtagactggcaaaaaaactgcagttttactttctgccagcttgacctgccagagcgggttgatcggggccaatgtctgtagcgcagcaatctcggcttcatcgatttcaacctcatcttcttcactactgaaaagatcagttaaatgtccccctcccagttcgctcaaatttgcgcaaccgcttagcaagatcagtaaagaaaggatacagacacgcagtgtccggctgcctgcatgaaaaacataatcaaggatcaataacagaatatttccagccactattaacgttctctcaatgcatccagtttcatctgtaccacattccggtaggcaccctgcgtatccaggctgtccagtgccttctgataggctgcacgtgcttcatctattttcccggaagcagccagcgcatctccccgcaaatctgcatagagcccggtaaaagaagcaccatgctgtgcgttcaacagtgacagtgcctgatcatatttaccctcatccactagcacatttgccagtcgtatccgggcaagatctttcacttcgggttcttcggtatgatcaagcacccattgcagcatatctctggcagactggttattacctgcctgcactgcagaatgggcagcaatcagcgctgcacgcgaggcataaccactcccgggaaaaccttggatgagcagctgcgctgcatctgttatcttttcaaactcacttcccttttcgacctgttgctggagaacggtatataaatcagccgcctgtctagcctgctcgcccttgtaatgattccatagccgggtacccaccactactgctgcaaaaacaactatagtaagcaataacgttgcgccattagcagaccaccaggccttcagccgatctattttttcctgttcttcaaagttgtatgcagacattatttcttaccttccatcttcattaaatattttccagaaacacggcgactttcatcaaatcaattttgacttgctccactgcctcacgtaatgacttgatactgacctgcccggttgcagcctcatcgtccccgatgatagcggcaaaccgtgcgccactggcatcagcttttttcatctgagccttgaagcttcccccgccgctatgtagcacaaccttgaagcctgcatcccgcaaggattctgcgactttccaggaaaacccagctgcaatatctccttgatgaacaacataaacatcaggaacagtgtgtatttcagcagccacatcagtttcactgatcagagacagtatccgttctattcccatcgcaaaaccgcatgccggagctggtttgccaccaatctgcgcaatcagtccgtcatatcgtccacctgcacagatggttccctgagcccctaatttgtcagtcacccattcgaacaccgtgcggttatagtaatccagccctctgaccagacggtggttgatttcaaaactgatcccctggttacgcaaaatccgctgcagtgcgtcaaaatgaataagtgaatcttcatccagatcatcgaacagatggggtgcaccttccagtatttcacgcatgcccggatttttactgtcaagaatacgcaacgggttggttttcaatcgccggcgtgcatcttcatcaagctcatcgtaaaatttttccaaatagctgatcaggcgcgcacgataaatcaaacgtgattcaatgctgccaagcgtactgatttcaaggcgcacatccggaatacccagcaaacgccacagccgcgcgcacataatgatgagttctgcatcgatatccgggccaacaaatccgagtgcttccacaccaacctgatgaaactggcgataacgccccttctgcgggcgttcatgccgaaacatcgggccgctatagtacaggcgttggggtccggaatacagcagattatgctcaatcactgcacgtacacaggaagctgttccttctggacgcaatgtcagattttcgccattgagttgatcaatgaacgagtacatctctttctcgacgatatcagtgacttccccaattgaacggacgaacaaatcagtctgctcaacaataggggttcgtaaattacgataaccgtaggcagccagccacgtgcggatcgtatcttcgaaaaacccccacaaatcactttcatcaggcaggatgtcgttcatcccgcgtactgccctgattgcttcaggcattagctacttttttccggtatttggtgcgcacgtattcatcaacgatcacacggaattcgccagcgatgttgtcgcctttcaaggtaacggtcttttgaccatccacgaaaaccggtgccaccggagtttcacctgatccgggcaaactgataccaatattggcatgcttgctttcacctggcccgttgaccacacatcccataactgccagcgacatattctcgacaccttcatattgttcgcgccagatgatcatttgctcgcgcacatagatctgaatactttcggcaagttcttggaaataggtactggttgtgcgcccgcatcccggacaggatgccaccagcggaacaaacgcgcgcaaccccattgtctgcaggatttcctgagcgacgataacttcacgcgcgcgatctccgcccggctctggcgtcagggagatacgaatcgtatcgccaattcccttgaacaaaagcaccgccagtgctgctgtcgaagcaacaataccctttgaccccatgccggcttcagtcaaccccagatgcagtgcataatcgcactgcgcagccaactccccataaaccgcaatcagatcttgcacaccgctaaccttgcatgacaacacgatgtgatcccgacccaagcccagttcttctgccctggccgcactttccaacgcagaggtgataagtgccttgtgcatgacctgtgaagcacctaacgggtctggagaacgcgcattttcatccatgatccgcgccagcatctccggatcgagactaccccaattcaccccgatacgaaccggtttgtcatatttgcaggccatttcaatcagtatggagaactgttcgtctcgctttttcccatgacccacatttcccgggttaatacggtatttggccagtgcctttgcgcattccggataagcagtcagcaacttgtgtccgttgaaatggaaatcacccaccagcggaacatggcaatccatatcatccagccgcgcacggattgcgggaactgttcgtgctgcctccatggaattgacggtaattctgacaagttcggaaccggcacgcgcaagctgttcaacctgctggacagtcgccagctcatcagcagtatcggtattggtcattgattgcacaacaatcggtgcatcaccaccaatcatcaccgaacccactttgacacccacacacttccggcgcggggcaggtacgttattagaagacatggttaacactcggatctcagaaatttatacaggttattcaagcgaaaagcgtgcgacatcatcattgccgcgggtatagggtgcaagatcaaccttgcgtccgttataggtaagactgaccccggctgcattgccgatcacgagatacaagggcggctctccttctatcgtctgctcagttcctcgcgaattaattttttcgagaatgacctgcccattactatccttgatttttacccaggaatccttggaaaagacaaagtgtaatgattttttaccattatctggagccttggctgtatccgcaaccggggccgatggggcgggcaaagcaggcaagactgccgcagctggtggcagattgacactcgccgatgcaggcggtgccataggagaagataccgaagcagttggagacaagggtagtgccaaatctatcgccacctgatcattctcactgctggaaccggactggataacttgatctccctcattcagcatatagggtgccatcttctccggcatttcttcatgataaaatccataagctgcaaatgccgccaatattaccgcaacatacaacaacagccatccgctccggccaccacgatcagactggtaaacaggttctattgctttgaaacgctgcgatggattcttgctggtaaaaacactgtctgctggccgagattgaggcacagcctccacaagcagagtcgtatcatcgagctgcaacaagttggcataattacgcacataaccacgcagaaatacagcagcaggaagcctgggaaaatcttgcgcttcgattgcttctatttgttgttcagacaaacgtaaccgatgcgccacttcaccaatattcatgccgcgcctgattctctcatcacgcaatctttgtccaaaattgggcgttgctgcaccacctgtcttttctgtatcagttgggggatccgcctgaatggtttgaaatgatgagattatttctgtgcgttcaggttgaaacgatccagcttgatcagaattctcctgagccgcaccaatattattatcagccaccgaattctggtccatacctggcgtatcttgtttatctatttcattatctttcatgattcaatctgcctgcacgcaattccctggcttcactggaatcgggaaaacgcttctgtaattgaaaagcataattggtttctgcattgatatccccgttcgctcgcgcgatacgaacagccaaccataaactacctgacgtaggagaatacgtttgcagataccggataatcgatgaccaggctttcttcacctccccccggctgaaatccagctccaccatcccaagctgggccagagcatagtcgggacggatcaccagcgcttgctgaaagaaagcttgtgcctgctcaaaattattttgcttcagaacacataaccctgcattggtataagttctctcgggagtttcatataagggatcacgcacagctgccataaaatgatcaatcgcttgttccattctatcggactttctctggcataaaaaccagccaaaattgttgcgtatatccggatcattcggcgtaattccaagtccacgctcaaagttccactctgcctggctgtcctcttgcagatccatataaaccagcccaagcatattgtaagctggcgcataatcggatttttttcgcagtgctatgccggcttcttctatcgctatccggtactgaccacggtgataatactgccccgccagttcggtatgaatttttgcactctgcaatgcacgctgcttcaattcctcaggagttggtttttcctgaaccggcacatgctcacaacccgccagccagaccagaaacccgacaacacccgctttaatcagcttgcccatattgctcgcaattgctcgcaattgttcaccaccaacactggatttataaaccttttcacccggtaaccacggctcggccagatccacatgtacccgttctgcgcgtcttatcctttacttgtcctgccagttggccacaagcagctgcaatatcatccccgcgcgttttacgcacagtcgtgacgattcctgcttgcatcaatacatcccggaaattatcaataacatcagtatttgatcgctcataaccagaacctgcaaacgtattgaatggaatcaggttaagtttacacgggatatttctgactacctgcaccagctcgcgcgccagcgctatgctgtcattcacatccttcagcataacatattcgaacgtaataaaatctcttggcgcggccggtaggtagcgctcacaggctgccagcaaatccctgattggatactttttattgattggtactaactggtcacgcaaggcatcattcggtgcatgtaacgaaactgcgagcgccaccggacaacgctcacgcaaacgatccaacgcaggaaccaggccggatgtactcaccgttacccgacgacgtgataaaccataggcatcatcactcagcatcagatcaagtgcggtcaccacgttttcgaaattggccagcggctcccccattcccatcatgacaacattcgtaactggtcgtcttgtgtctgtattatctgcccgaatctgcgcgacatccggagaaaataactcaccaacctggccttcgagtagtcggttagcccaccataattggccaataatttctgccacgctcaagttacgattaaaaccctgccggccggtagaacaaaaactgcatgccagtgcacagccaacctgactggaaacacaaagtgtgccccgattaggctcgggaatgaaaaccatctccactgcgttccccgtacccgtcgataacaaccatttacgagtaccatctcccgcagtatagtcgctaataatttcaggtggatgaacaacagcacgctccatcaatttttgacgaaacgtttttgccaggtcactcatctctatgaattccgtcttgccgaaccggtgtacccatcgcaacaattgcctcgcacgataaggcttctcacccatttcttcgcaaaaatggataagccctgttttattgaaatcaagcaggttaatcattgtatccggccttttagatcggcaaatctacaggttttcagcgtgaatacacttctaaagatgggaagaaacaggctatttccacagcggcagtttccggcgcatctgaaccatgcacagcattggcatcaatattttctgcaaaatcagcgcgaatcgtacctttttctgcttttttcggatctgtggcacccatcaactcacgatttttggcaattgcattttccccctccagcacctggatcatcaccggcccggaaatcatgaattcaaccagatctttaaagaaaggtctttccctatggatcgcgtaaaaattttccgcttcaactcttgataaatgcgccatgcgagcagcaacaaccttcaagccagccgcctcaaatcttgcatagatctgcccaataacattttttgccactgcatcgggcttaattatggataaagtcctttcaactaccatcaaatacctcatagaaatagttcgtcacaagctggtattctaacaaaaaacctttatgtggtttaccaaacagtaacttagggaactagaaagagaaacgcacaaaaggtgcagttgggtgcttgcaaaaaaagaagctctgatgacacctggtatcaggttttcaaaacacagtaaaaatatatatctacgatacggtagaacaccgaatcaatttcaaacagatgtttgcacacacttacaaaaaacaggccggactaatccggcctgtgttctcatctaccgtgattccaaaacttaatctacaacgttaagggaacctggcaagtgaatgttttgtggatgaagctggcaataaacattgaaagcaccttttttgtcagcggtaaagctgatggtcttggtttcgccagctttaagtacttccttgataccgtaggcatcaattgagaatccttcactgataggtgatttgttctcaacaacgatgctgaccttatctcccttttcaacaaccagtgcttccggctcattcaatacattgaatgcacggatatttttcactgtcacaccttccacgttcagttcaggaatagtggtgtcataagcattgataaccactttaaactcgctatgatcgtccgcctgagcagcacctgctaccagcaacgatcccaaggcaaaaccagcaagcattgtctttgttatcttcatctttaccttcctctacttgaatttatattttattcagcgaaatacattcaccggcccagcgacattaatatacagttccctgcgatgatcagttaatgaacatatccttgtaaaagaaaatatgcacgtcgtctgtcaagaaagttgcttattatcaataactcgcccagccaactcgggaactcactatctttttaaccaccgagtcccggtccagaagtgtagatagaataaccaaaaatgtcaatgtcacaatgccgatccaattattgaatcacacagatcttctccgtttccgcaaacatgcaaaatgcagcatgacacagcactccgaaattgccgtcctgtctgcagacgcataactctgcttagattaatgtagaatggcgctgattttttatactcttatactcgcttaccagcatccgtctcgctccggagtccccattcatgaaaatccaggatcttatccagaatcgcggcagagaaaatttctccctgcatgacaagtacctcaacagccagatggtcaaggtacttaaaacaatcgattttgaccgtcattatgtcagagctcagggcgcttacctgtttgatgatcaggacaaccgctacctggatttgttgagtggttttggtgttttcgcattgggacgcaaccacgcggagatcgtcgaagtacttaaaagcacaatggaagctgatttacccaatctcgtccagctcgacgtatcgttactggccggattgttagcagaaaaactggtcaagttgactccgagtggattaaatcgtgttttttttgccaactcaggcactgaaacagtcgaagcagcgattaaattcagccgttatgccaccggaaaatctaaagtcattttctgccatggttgctaccacggactgagcctcggttcgctctccgccacaggagatgatcattacaaaaaaggttttggcccactggtacctgatttcattgaaatcccgttcaacgatcttgaagcgctggagcaagcacttgcccaaggagatgttgccgcctttattaccgaaccgattcaaggacacggcgtgtggataccggatgatgactatctgccgcaggcagcaaagctcgcccgtaaatatggtgccgtattcatcgtcgatgaaatacaaaccgggctgggtcgaaccggtaaatggtgggcagttgaacactggtcggtcgagcccgatattatatgcatctccaagacactgtccggaggattcgttccggtaggtgcattggtctgcagggaatggatctttgatcgtgttttcaatcgcatggaccgtgctgtcgtccatggcagtacatttggcaaaaacaatcttgcaatggctgccggcctggccacactggaagtgctggaatcagaaaacctgatcgaacattccgctcgcactggcactgccatcatggaagcactaacccctctgacggagcaatatgaatgcttcaaggaagtacgcggcaaaggaatgatgattgcactggaatttaccgagccgacaaaaagcctttcgctgaaactgtcatggaaaatgcttgaagctgccaacaaaggattgttttcgcagctgataaccgtcccattatttagacagcaccggattttgtcccaggtggccggtcgcgatatgaatatcgtcaagttcatcccgccactcatcctgacggaatcagatgtgcaatggattgtttcagcagtcagtgatgtcgtggccagcgcgcatcgaggccccgctgcagtctgggattttggtaaagtactggcaacccaagcgcttcgtacaaaactacatacctaaagaattccaaattaattttgactgttccataaacaatttcccttgctttccgtattaatacgctccaacagccgatcatgcaactcaagttctgtttggctgacgggctgaacgatcaatgtaagattttctgttgcacgtagccttgaatcgcaagacttccctgcttctggaacttccggctccatcagcaaactttcctggccgcgcgtcattgccagataaacttcggccagcaattcagcatccagcaaagcaccatgcagtgttctgtgagcgttatcaatctgataccgctcacataacgcatccaaattatttcgtttacctggatgcagctcctttgccaacaccaacgtatcaacaatctgcaggcaataattatgcatgggttccaaccggatcaaaccaagttcacgattgatgaaacctacgtcaaatggcgcattatgaataagaatttcggcatcttctatgaattccaaaaactcgctacaaatctcctggaaagcaggtttatcccgcaagaattcccggctcagtccatgcacccgcagcgcgccctcatcactctcccgcccaggattgagataacgatgaaaatgacggccggtcgaacgtcggttacatacttctaccgctgctatttcgacaatacggtgccccagcgccggatccaggccggtcgtttcagtatcaagaaagacgtagcgcataatctgtccgatcaatctgcttttttagataacaccgattccactccctgatttgcaagcctatcagcccgctcattacctgcatgtccgttatgtccccgcacccagaaccattcaacctgatgacgctgagataaatcatccagctctctccacaacgcttcattcttgactggttttttatctgctgtccgccacccacgcttcttccagccgtgtatccattcactgatccctttctgcacatactgcgaatcggtatgcagctgtacctgcaagtgttgctgtccgttatcttccagggattccagctcctgcaaggcacggatggcagccagtaactccatacgattgtttgtggttacgggctctcccccgaaaaattcccgtgtttcgccattgaaatgtaaacaaaccccccatcctcccggacccggattacccttgcaggcaccatccgtaaaaatttccactcgtttcatatcacttttcagttgcatacacttattcctgttatcaacccatccactcttttcgcatcggcccgcaattccagaaattatctctctcctccgagccctatttgtggaacgactgccgctctccttttgcttacagatggattttcccagcgaggcttgatgatgtgcataccacattcatgcttgaccgcctgcaaaaaatatacccccccggcaacaggccaccagcgatctccggctgcctccataaaacgcaaccgggaaagccacttttccccggtaaacggcggaacataacagccaaactgcccggcaacgatttcaaaatcaagcaattccaaccagtccttcacacgcgacaaatcaataaaacgaccgcgccacggaaaatccatcccagattttgtcatccgccagcgtatcccccagagactgaaaggattgaatccgctgatgatgaccctgccctcatcaatcaacacccgctgtacttcatgaaaaatctggagaggatatgaattaaattccaatgtgtgcggcaatagcaccagatccagactattgctcctgatcggtagaaaagcagggtgcacactggctgaagctcctttttccacaccgagcacaaacttgaaaggcatccggttgttccgcaaaaaatcaaatccggcaaagccaatctgggccgcgttatagccgaaaatatccgccacaacacgatcgaaataacgctgctcctgctccagcacgtactgtcctaatgcagtttccaaccactgttgcatattttgctgcaatgcagaatcaaacatattgtcagaatgattagttatgatgatgattcgcttgtcatttactgtaaggaaaaaaaatgatcgatgttttccccgtccgcgcctttaaagacaattatatctggatcgttcacaatcaacagtttgcactcatcatagaccctggtgatgcaacaccagttctcgcctggataagccaacagaacttgcaaccaattgccatactctgcacgcatcaccatcatgatcacacgggtggcattccctcactggtgcaggaatttgcgatacctgtctacggccctgccaacgaaaaaataccgggaatgacccatccattaacgggaggagatacactcagctttccggaattgtcgctggaattcagcgtgctggatattcccggacatactgctggtcacattgcttactatggccagaattacctgttttgtggagatacactgtttgcatgcggctgtgggcgaatctttgaaggcagcgcgcaacaaatgtttgcttctttacagaaactggccagtctgccggatgaaaccctggtttattgcgctcatgaatacacgctggccaatgtccggtttgccagggtactcgacccagacaaccctgatttaatcaaactggaaagtactgtggaagaaaaactgaagcagaatatacccacactcccctccagtctggctgtcgaaaaagccactaatccgtttttgcgctgtgatcagccagctattatccacagcgccagccagcacgttggccggcatcttaatgacccagtcagtgtttttgctgcaatccgtgactggaaaaataactttcagtagacaccccgtcatcgcggtcacgaaggcaatgattacgtggtggcgaactgcttcataccaccttttacaaaggtaatttaagccaaaatatttccgcctttgtgatgaggccagaccgacatggcaatccagcgccttcgctaccatgatcactggattgcttcacgccgttggcgttcgcaaagacgacatctgtaattacctcatccacacaccattccaccaccgtgtaaaaccttactcgctgcgtcatcgcaaagcccgcagagaggctatggtgacccgataatcactccatttgcatcaaacccggcagccctcatcatcgcaccctggctgtgtatcgccggattgatctgctgctgaagccgctgccagttccttgtcggagacttcttcggccagcaatgtcccgattgaaactcccagcagaaaatcgctaacgtggccaaatttgtgcaaacgcaggtgaccggttttatccaccagaatcatggttggcgtgccctgcatgtggtaagtcatcattgtatgcggaatggaatgctgctcgttcggtttgtcgattccgatcggaaaacgcagccggtattcataggcaaaaacctccagcgcatcgcgccccataacttcatgatgctcaaaaaccgtatgcaggccaatcaccgccacccgttccggatcaaattcattaaatacctgctgcgcctgcggaatcccctgctgcacgcaaccagggcataacatctgaaaggcatgcatcaataccaccttgccacgcagggaagccagcgtaatcggttcggatgcattcaaccagcctgaagtaatcaactctggcgccttgattttctcaacagttgtattttttttcatggtttaaattgagatacgttactgaaaaaaaaatattttttgctggttgatgatagcacgcgcagctattcccaaggaaaccgggtccatgcctgtcacacactgatcatttgtctcgctgtgcggcaaccctggaagtgacaaccttcttcttcgtgacaactgcccgagctgtctttgcagctacattcttttcgggttccgaaacggttgttaccgccgctgcttttgttgcctttgctgttttcgtcacagtcgccacttgtcgcttcccgggcgcctgctcaaccggagcatcggtcgaaacacccaacgcagccatctcgataccaaatacatccgccaatgcagcatcatcaagcacctttgccttcgcggactccttcaccttagcaggaataactgcaacctgggcagtcagcaagtcattggcatccacctgacgcagcacgaacagcaactcgggctgttcatccagccgtgcaccgacaccatagagcactgcggcaacatgtttacacatcgttgcccaatcgggacaggagcagccaagactgatctcctgcagcaatggaaacatcccgctctttggttcacacaggcgcgccataacagctttggaaaattttccttgcagcagctccagcagtgtggcgatggagcccgtacagtcctcaaccagtttcttccacctggtggcaggaagcggtacgataccgatctcgacccggtaacgacgagaacctattacctgtgcaatcacccgacccggctcaatctttaaatcaatcaccgcaccattacgcacataggcacgtccgcgcggcaaacggctttcatagtcgctataagtctctagattagcgcaccaggctttgccccagaaagttctggcgatggtgtgcgaagctactacaacaggaaataaatccttgccggccttccttgccttctccacaacgcggctggcctgttcacgccgtttagccactggcacatagggtttccagtcccagtcactcataaatcatccccctgctacatgaatgtccagcttcaccagatcgagcaatgcttcatcgctcatctcagtgagattgatttctccgtttccttcaaccacatcctgtaccagttgttgcttggcgtggatcagctcgtcgatgcgttcctcaatggtgccacgacaaataaatttatgcaccagtacatttttgtgctgaccgatacgataggcacgatcagttgcctgattttccacggccggattccaccagcgatcaaaatggacgacatgtgaagcggccgtgagattaaggcctgatccgcccgccttgatggacaacacaaaaaatggaacgctttcatcttcctgaaaacgcctaaccagttcgcgtcgccggactaccggtgttccgccatgcagcaccagcccttctcgcccgaacacgctgccaagaaaggcggccagtggtgcggtggtctcctgaaactgcgtgaacacaagcaacttctcctgccgggccgccactgtctcggcaatttcgtgtaagcgcgcaaatttgccgctctcttcaggtttccagccgccatcgttcagccattgcgaaggatggttacaaatctgcttgaaacgcattaaaaaagacaacaccaatcccctgcgctcaatacctccaaccgatgatcccagcgcacgagccagcgcctttaccgcctcctggtaatggatcgcctgcactgtgctcagggaacaccaggcagacaattcggttttgtccggcagatcagaaatgatgtgcctgtccgtcttgaggcgccgcaggatgtagggtgcaatcagtgtgcgcaacggcccgaaatgccctgttttcgatagccgtttggtaaacctggaaaaaacgcgttccgagcctagcaaaccgggatgcgtaaaatcgaaaatcgaccagagatcggaaagccgattttctaccggcgtgccggtcaacgcaatacgcgcatcagccttgagttttttcacctcacgtgtctgtttggctgctggattcttgatcacctgtgcctcatcaatcacgaccagtcgccagctcacctccctcaattttggtagtcgcggcagcgtgccataagccgtcaccaccaaatcgacaccaatcaattgttgcgtatccagtgcctgcaatgcctcgcgcgtcattcccgaaggatgagccagcacacaacgcagatcgggtgcaaaacgcgccgcttcctgcatccaattggccagcagggaagccggtgcaacgagcagactaggacgcgcagtgagtgtgccatctgtcccgtcccgcttgaataaaagtaacagcgccagcacctggatagtcttacccagccccatgtcatcggccaggcaggcacccaacccgagacgggtgagaaacgacaaccagcgcacgccctcctgctgataggggcgcagtatcgcattgagcgcagggccgggatccacggtagccagcgtaccaggtgcccgcagaccacgcaatgttttggccaaccacggccctgccgcaagttccgcccaatccggatccggtgcttcttcgtcgagtgtcgcgccagcaagcaagcgcatggcctccgccagcggcaagccgtccgccgcaccggcctcgatttcccggaaacgatcgatgacgtgcgagagttgcttgcgatccacctcaatccacttaccacgtatccattgcaaaccgtcagcaccagccagcatggcgcgaatctcctcggccgtcagcgcctctccgttgatcgtcacatccatacggaaatcgagtagtgcgtccaaccccagacgggaaggtgcaccggcacccagagcggcgcgcgccctgggacgagccgggcgtccagcctgccactgagcgggcatgcgcaccacaatgccggcagcctcgatgcgtggcagatcgtcaagaaggcatatggcatcctccacctgccagcgcaagggatgataaatctcaccggattcgatcattgcagcgatccattcgcactgctccgccgcgcgctgtatcggcatcagcaacgcgagcagctgtgccttcttgcgactgctggaaaattcgataagcgcctgcgaaagcggcaaatgttgcgcctggccgtaagttgagagccgcgtggtatacgttgccaggaaagcaaacggcatatccggatccttgcggttttcggcgagattaaaatgcacgcgcccaaccagattccaggccggatgccgtactttcagaaattccgctagcgataatccgctggcagaacgctcgctttccagcgccgtaccaattccgccccacagcgcagctaatatttccggcgagagatattcagcaccaggcataggcggcacatcgagaatcagcgtctcaagtgtcagcgtatcgggtggtgggattgttcctgcatcaggcgcaacacacagtgcggtcaagtaacgtaccgcgaaatcgcgccagtacgcccacactggcggcagcgccatggcaacatacgcgcttcccagctgtaacaagccatgtcccgcatcaactgcaaaagctgcgacaacttcttcggctattgcgacaggtaatgatggcgcttccggatcaggcaggcacgacagacgaccggcaggagtaagtgacaaagacaatgcaacagttgcagattttgatcgggttgtcatgttctgttgaatagctcctttctacggccctcatatatttctgcaaatcccatcttccgatttctcgcaagcaccccgcttgtttcgtgtcccatggcgcccccccaaaaaaccagataaatcacgcgcagtaagcccagatggtgtatttgcttgtttgttatgtttgcttattttatttttgataattgaaataagaataattaccataacaggcacttaaacagtacattacggagtcggtatagcatctgccgaatcacaaaaacgtaaggtcggcaaacgttcgactccgactatgagctaaagaagcaataaaaccccgcaccagttaatagcttcgtttcttctctccgcttctacagcatagacaaaacgggcactacattctccgcccaaaccccttctgattacaaagtaggccatctccccatcggacacctcacctgcagcatagacaatttactgaggtttcaatcagcaaacacttacttggctgctaaaaaaaatgcatatttttgcatttaatttattttcccagccagatctttacagcttaccaattttgcgcctcatgacctgaaaatcatacaatgtcagctatttcctcattttttaggactttgctgctattttttgactttcgagcgcataaatgggtacaacacttgcagtaataacgcgcgcaacaaatattccggtaaaatcaataagtaaccagtattcataacgtacacccgtctccagacgtagaatactaagaaatatatcgatagccttcttcaaccgcctgctgatgttttaattcctccatttccgagaaaaaccatgactaccacactttttgatccgtttgatctttctggcctgcaactggctaaccgtattgtcatggcgccgctgacacgcaaccgttcacctggcgctgtcccgcagcccatcactgccacctactacgcacagcgcgccagtgccggtctgatcatcaccgaagcaacggcaatctctgcgcaagggcaaggttacgccaacgttcctgggctttatacgcagcaagcactggatggctggcgcaccataaccgatatcgtacacaccaggggtggcaaaattgttgtacagctgtggcacgttggcagaatttcacacaatagccttcagccggataaccagccgccagtagcaccttccgccattcaggcacagagcacaacctacttaattgatgccaatgggcagggtagtttcgtacctacttcgctaccgcgcgcactggcaaccagcgaactgcccggcattattgatgattaccgtcgtgctgcgcgggcagccattgaagttggctttgatggtgtagagattcatgccgccaacggctatctgattgatcaattcctgcgtttgagttccaaccagcgcagcgacaattatggcggcagcattgaaaaccgtgcacgcttcctacttgcagtggttgaaggggtcacggaagaagtgggtacaacgtgccctactgggatccggctatcacccgttactcccgtttgtgatgtatttgatcctgaaccgcaaccactatttgaatatgtggtacgcggccttgccaagtatgcactgtcttatatccacattattgaaggagcgactggcggtgcccgcgatcatcaacagggcaatacgccattcgactatgccaccctaaagcaagtttaccgcgatgccggtggcaaagccgcctggatgctcaataacaactacgatcctgcacttgcccgtcagacgattgaaaccggcctggcagatctgatctcttttggccgccttttcatcagcaaccctgatctggttgaacgactacggaaaaattcacccttaaccacacccgacaccagtactttctatggcggcaatgaacatggttatacggattatccttttctggacgcgtagattatcaagagagttaaactgtagaagatcaaacctgtaacacaagcacataatttcgtagcaaaagcgcgcaaacaggcggatagggaagaaacagagcgatcaaactggtggatgccattgccaccgctgcccttgagtacgatgccggccagattcagagcccggagcgcatggttgtgccctttgggattggtggcgcaatgctgagcatgccggccaccgcgcatgatatcgggattcacaaactcgtgactgtacaacccgcaaacaaggagcggcaactgcccaccatccacggcacggtaactgtgtgtgatacggagaccggcgaacccatctgcctgcttgacggcccggagatgactggacggagaacggccgctgtcacgatgcttgcaatccgtaccttcctgaagcaagcacctcgtgaaatcctgctgattggaacagatgtacaagcgcgccaccacgttcaggcgctctacgtacagaaaggggctttgtatgagcaggccatgcccgcgatcaagcagcccgacatgtcgctctaaagagtcgacctatagcgagcgcacaacatgacctttaattttaatgacttccaaaggggcacatattgattaccacatggcttaatgcattttattcaattcaacctgatacatctaatcccgcgcaaagggttagctttggcacgtcagggcatcgcggctcatcgcttgctggcagttttaatgaattgcatattctcgccattgcgcaagctgtggtggattatcgccagcaagcagatatcagtgggccgttgtttctaggtcttgatacccatgccttatcgcgtccagcgtgggatgtggtgctgcaggtgttagtcgccaatcagattgctgtatttgtcgctacagagcgtggcgtaacagcaacacctttggtcagccgggcgattctggcgcataacgcgcagcaccccacagacttggcggatggcttaattattactccatcgcataacccgcctgaagatggcgggattaaatacaacacctctgatggcggacccgcggacagtgatgtcaccaattggattgaagcgcgagccaatcagtacttgcagaagcagtgtgctgaggtaaagcgagtggatttgcaggatgccctgagtcaagtgcaagaatacgactatgttgcgcattatgtggcagagctggggcaggtggttgattttccagcgattcgccagtcgggcctcaaattgggtgtggatcccatgggtggcacaggcttgccggtttggcaggcgttggcacttgatccagcgttcaatattactgtggtgaataccagccaagcagcagattttgcttttatgccgcctgatcacgatggccgtatccgcatggattgttccagtcccgctgccatggctaatttgctgaagattcgtcaacagtttgatttgtccttggccaatgacccagatgccgatcggcatggcattgtggatgccgctggcttaatgaatcccaatcattttttatgcgtgtgtgttgattacttattaacccatcgaccgctgtggtctaagtcattgaagattggcaaaaccttggtcacctcatctttaatggatcgcattgtggcagcgcatgatcgtgagctgtatgaagtgccggtgggttttaagtggtttgttgaaggcttgcatcaaagttggttggcctttgccggtgaggagagtgccggtgcgagtttattaacctttgacgggcaaacctggaccaccgataaagatggcgttgcgctgtgcttactggctgcggaaattagcgcagtcactggcttaaccccatcgcagtattacgccaaactaacagagcaatatggccgtccgtattaccgccgcattgatgcaccggcaacagctgagcaaaaggcggcgtttaaaactctgaccgttgcgcatattactgccacagaattggccggtgagccgatagagttggtgttactcaatgcacccggcaatggtgcgttaattggtgggattaaagtctgcaccgaaaacggctggttcgccgcccgacccagcggcacagaagccctgtataaaatctatgcagaaagttttatcagtgaacagcatttgcaacagttgattgatgagggacagacgttgcttaatttataggatatttctgtagattgcttctgtaggttgggctttagcccgacatgtgcattgtaaatgccctgaggtcaatacatggactgatgtatttgtcggcttaaagacctgcattgttttgttacctgcagggagtataggaaaaataaacaccctttttcataagaaccacatgtaccgggaaacggtttggtcatcaacctggccgggaagtcacccgaaattcttaaatttgtttttgatcagcagcaaaaagtgttgagctgcgtcggtaataatgttggcatcacaaccaggcctgaaactgaatcgtcccgggtttcgtggaggctgtttggttaaagtcaagccaccggaatggcttccttggcgaattgcctatagtagtttacctcagcttctgcgggagggatgtaaccgattggttccagcagccgctggttgttgaaccaggctacccattccagcgttgccagctccacggcctccctggttttccagggggcgcgcttgtgaatcaattctgttttgtacagtccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggcatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaacccgatccagtggacacggcagcgccttgtccggaactgtggtgcgcacaaccttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccgctgtatctgcggcagcagttcatcatcacgcaggacgcgggcactgcgcaaagccggattacgctgctgcgcggaatatcgccgataccctgatggggcgacctgcaaaaccttgcagatcggctcgaccccatgggcgtcgcggtgctggtcgatgaacgatctcaggatttgagtttgcggtcgagctccgcctgagcgaaaaaagcgctggccagcttcagaatctcattcgccttgcgcaattcctttacttcgcgttccagggctttgatgcggtcgcgctcttcgctggtcacaccgtctcgcaagccggtatcggtctcgtgtttgcgcacccattcaagcaatgtgtgggctgaacagccgatcttcggcgcgatggattcaatcgtcgaccacaacgagggatactcactgcggtgttcctgcaccagacggactgcgcgcgctcttacttcgggggaatatttatttgatttgttcatggctccatcttctcagatattggagcctcctcaaaacccggggcggttcacagccgacgcatgggcggtgcttatttgattgacgtacatattgttgtgagcgagcgtttaagtgttgctgaaggccacaggattgcggagtatgtgcgtttaaaattgattggctcgcatgaaaatattactaatgtcctggttcatattgatcctgaagatgattcggtcgcagtattgtgtgcggacttgccgttacgacgtgaggtgctgagggacttgcgtaaggcatgggctgcagattttgattcattcaagttagacgaggtgacattgcactatctaaacggcaaagtgcatgtggatctggtctgtacagccaatgctgtcaatgcaaatgctggacaattaagccaacgattacaagagcaggccgaggtgcttgattatattggtgacgtgcgggtgtacaggcagtgttaaggagttagttaaacaagtgctccagttccttgcgccatacactgctcgaaatctcgtaatacatcgcattgtttacattcctgatttttaacgagtacgacctacttgcaatttttgttgcgtataaagatcggcagtgatgtcaggtgctggccatggcagcgaataacaaatatagcgagtgattaaattttagcgttggcgaacatacgatgcactcaaaaacttgaagtgtccggataataacaacctcaaaatcagctcgttattcgtaaaaccacgtagacgctggctttgctccagtatagctcaccaactatcccgtaactcacgcagcttcaaaaatacagtttcaggatcaggctggtcgccgatgtctggaaactctttacgcaacgtggcgatcaccgaagggctatgcagccgaaaaaaggtattaatttctttttcctgcgcgatcatcgtcaccagcgcgtttgcggcatcttgatgctgtacttcggttagcagtgtctttgccaccgcgttatcaggctctctgttcaacgtgaattttaggttattaccaatataatcatgacccggatagattcgtgtattgtcgtctagacatgccagttgggtggcgaatgtctcgtgcattttctgcgggtgccctccattatggcaattaccgacaccggcgttgaataaggtatcgccgcaaaataacgccggttcatcagtttttggcaacaaacaaatatgtgtcatggtatggcccggggtatccagtgcgagcaactcaacgctgcgccccacggttattacatcacctgcatccaggccaatatcgatacctgcaatcgtatttctggcattgtggtgagcaagtagtttggcaccggtggcggcaatcatgggcttattaccgccggtgtgatcgctatgttcgtgagtattaagtatttgggtaatcgtccaaccattctttttggtggttgccagacacttgcggtgatcaagcgggtcaatggctagagcatttttgatttaaatatatacatgtaataaactattttctatcataactgatggggaaggttatgcatgcctattcacaagatcttcgagatcgtattctgggtgcgttggatcgtggcgaaggtccaacggcaattgcccggcgctttgaggtgagtcgcgtgcaggtgttatcaggtacgcaagcgatggaaagaagagggccagcgccatagcttgccgatgggaggttatcggcgatcccgcattgcgcacaaggaaccgcagattcggcaatggatagaagccacgccggatctaacgcttgtcgagcttagtgaacgtttggctgcggaaggcattcagatcaaggtgccggcgctatggcatcaactgaacaaatggggttgagttttaaaaaaaaccctgcacgccagcgggcaatcgcgcacagacgtacgtcaggcacgaactgagtgggcccgcgagcagcagcattgggattgccgtcacctagtctttctggatgagacggcaacggccactggaagagcaccaccttcattgcgggactgcgtcacgatgcgatcaccgctccgttagtgctcgacggcccaatgaacggggccgcgtttctcgcctatattcaaacctgcctgtgccccacgttgcagccaggtgacattgtggtggccgacaacctgtcttgtcacaagaggttccaggcgtccgcgcagccattgaagcggcaggtgccacgctgctctacttaccgccgtattcacctgatctgaatccaatcgagaaaatgttctccaaactcaaagccctattacgcaaagctgccaaacgaaccatggatgccttatgggcgcagatcggcaaagtgttggatctgttcactcctgaggagtgtgccaactactttgcttcatgcggatatataaacaaataagtcaaaaatgctctagcgcctctcccgtttcttcacaggcgataagatagttaaaattacggtaggcattgccggtccatatttgttcaataatcatcattagctcccaggattctgctatcaattacgcagtgggtagtcattgtacttgaaaccaaattctgtgctggccgtggctgttcgctctgtatctgaaccgagatacttgattgtattgggtaaagaaggaaatgacacaatgcgttccaacaccaggggatgtaccgaggaactgtagagaatgatggtgtcgcgcaagtgggtattttctcagaggcagaagcgccggtaactgctttcccgattgctttgccgtgaaaatcaattgataggaatactggcgggtgatatggttttttctgtagattaaagtcccggcgatacaaaaatcggctttctcccacttagggcttgcggttaggttgcgacagcaagcctccctattccagtgggtcaagcgtcatcttttctattcttccaaaaactgccgaagcacatactgcaatataccgccgtgtttcacatacgctacttcaactggtgaatccaggcgcgcgatggcttggaattgaatggtcgtcccatccggtttcgtcgcgatgacctctagttttttattcagttccaagcctgattcaataccaatgatgctgatgacctcctgacccgataaaccgagcgaattcgcattttcacctgtttcaaatattaatggcaaaacacccatcccgatcaaatttgaacggtagatgcgctcgtaggaggtagcaataactgctttgacaccaagcaaactagctccttttgccgcccaatcccttgatgaaccagaaccgtagtctgagccggcgagcaccaccagcggtatcttattttcaacatacttcatggcagcatcaaaaaccgtcatctctgtattgtcgggaaaatagttggtgtaaccgccttgccttgaaacaatttcattttggataaatacgttggcaaaagtgccacgtatcatcacttcgtgattaccacgccgtgaaccataagagttgaacatattccgctcaatcccttttgatatcaaatactgaccagccggactatcttcagagaaagaaccagcaggagagatatggtcggtcgtgacagaatcacccaactttaccaaaacccgcgcatttttaatattaacgagcggctggggtttggtgctaatgtttttgaaaaatggaatttccttgatataggtggaatcgcccctccattgatagtccaggcccgtcggtgctggcaaattttgccattgcgcatccccgtcaaaaattacatcatattcttttgcgtaatcatctttggtggtcgatgattcgatgacttgctgaatttcatcttgtgtgggccagatgtctttcaaatatacatcgaggccattggcatctttggtgagcggatcttccagcaaattgatgtctacccgccctgcaatggcataagcgacgacgagcatcggcgatgccaaaaaattcatctgtatcttaggatgaatccgcgcttcaaaattgcggttgccactcaatactgctgacaccaccaagttactgttgtcaatcgcttcttcaatatgtggtggcaaggggccagagttgccaatgcaggttgtacacccataaccgaccacgtgaaatcgcaatgcttccaaatcttttagcaagcccgctcgctccaggtagttggtgaccactttggaaccaggcgccaatgaggttttgacccagggtttgacatcaattcctcgggcaaccgctttgcgtgccaccagacctgcccccaacatcaccgaaggattggaagtgttggtgcaggaggtaatcgctgccaccacaatcgaaccatcacttaatacatattcctggttgccttttcgcacacggacagatttcatgttacggtcttcgaccgtcacctcgacatccttctgcttgctttcagatttcaggttttcagtccgggctgtccctgaaccaccttctgcaaaccagtcttcccggtcttccacggacacataagccctcccgtggacttcgttcattagattgccaaattgccctttcaggtcctttaccaggattttatcctgtgggcgtttcgggcctgcaactgaaggttccagtttggacaagtctactgagacgacatcagagtattcgatcgcctcttcgttttcccgccatagcatattctgcttgcagtattgttcgaccaggtccagttgcgcttttgtccggttggttttttccatataccggatcgtctgatcatcaatcgggaaataagtaactgtacaaccaaactcgggagacatattggcaatcgttgcgcggtcgggcacagataaatggtcgaggccatcgccaaatacttctacaaagtcatttacgacaccgtatgcacgtagctgtttggtaatttccaggaccatatccgtggcagtaatgccttccggaagtttacccgtcaatttcaaaccgataactttcgggcaagaaaaataaatgggttgtcccagtagtgcggcctcagcttcgatcccgcccactccccagcccagcacaccaatgccattgaccatcggggtatgcgaatccaaaccgaccaaagtatcgggaaatgcccaattatccttttcgacaacgcatttcgccaggtactccaggttcacctgatggcaaatccccataccaggaggaaccaccgtaaaatcttcaaaggcattttgcgcccatttcaaaaattcgtagcgttcgctattgcgcttgtattcgtattcgacattcttcttataggcgtagtccgtcccaaaataatcaacttgaacggagtggtcaataatcaaatcgaccggcaccttggggttaattttagaaccgtcttttcccttcttgattgcttctgaacgaatacttgcaatgtccaccacggcgggcacgccagtaaagtcctgcatcaacactctactcggtttgtaggggatagatttgtcactcccctttgggtcccagttaaattaaggtatcaagatgttcctcattcaccagaaaatcatcgaaattacggagtgcattttctaataaaatgcgaatcgaaaaagggagatttttgacttgcggaaaagagttggccactttctcaagactgacaatgcgcaattttccctttttggtttggaggctatcctcatattctttttttcctttttcatatcgctattttatgatgattagtagaacacaaatgcattcgtgttcggggtataagaaaaaaatacttttttcataagaactacatgtactgggaaacagtttgattgtcaatctaaccgggaaatcactcgaaactcttaaatttgtttttgatcagcagcaaaaagtgtcggtttgaggctcttttttgctgttttcgtgaaaggcacccaagggcaggcaaaggtcagcccagtaataaagagaactgataggagcgcacgggatcagattgacttgaacagatcaaagatttgcgcaggtgctctaggtgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatggcttataacttcgccaaaagactaaaagctctcaaaggcctaacaccctatgaatacatctgcaaaatctggaaaaatgagccagatcgttttatctttgacccattccagcacaccgtgggactaaacagctaggcggcagggagggcaagccaagatgatcaagatgcgccagattccaggatggcagcgatgattttcaaggtttccccgcaacgcgggcaatgctcaatgtcaatatcgaacacctgcttgagcaagcgtggccagttgctgcatgaatgccagcggcgacatgacgatatgcgtgatgtaacaacacagaacacaggtgctccagctccttgtgctgattcgacatctgggaaataatgcgatcaaccaggtgagcagccgtctacgccatgcattgcccaccgcacgagaggcgaaatccacgccgtttgcagaaaaaggccaccagtttctcatagacgcagcttgtacaacgcagacgtaagaactcatgggtcagcatgccacgaaatgccccaaatttgtctttaacaaagtcaggcaaccctgaaccggcttccgtctcaacctgtataaagaaagtatcgatgtgctcttgcaccaaccaatacagagtggtttcttccggtcggtgccgtccatagtggagctgattttcaaccgctgcgtgttgagttggttggcgcaggttctcttggtggaattgagcgcggggtgtggccgtcgatatgatctttgagaacgaatattttcgttctcaaagtatcgacttctttctcttgccaggccttgagctgctacaatcaatgaagacccggaatctggaattcattgcggaacatgttgatgaggcgtggattcaaatcgccgagcaccagctcgcgcaatttgaatccggtgcggtgaaaccggttagccgggagtccgaagtttcatcaaatgaaaacatgaaatcgaaaacaaagatggaattaccgcgaacacgctatagcaaggagatttatgaatacttgggataacgggtttcgtggcaaacccggacaggggatgtcgcatactctaagtttcgggggtgcagctagtttttttcgcgtgccttaccaggcagatatcacaggagttgatgtggtcgtaaccggagtgccgttggatatcgccaccaccaatcgatccggcgcgcgactggggcctcgcgccattcgaaatgcatcgttatcgctggcatgggagcgcccatggccttggaatatagacccgatgactgcgttgcgtgtaattgattgtggtgattgcgaacccgttaccgacgatttgttgagcgtagctcatatcgaggcacatatcgccaatattatcggggcaggagcagcagccttggtgctcggtggagatcattttgtcgcttacccaagcctgcgggcacacgccgctgtgcatggtcctatcagcctgattcattttgatgcccatactgatacttggccttcctccggtaatggtattaatcacggcactatgttttatcaggcaacacatgagggaattgtaaatccagcatcatccacacaaattggcattcgcaccactaatgatgacacactgggttttcatatcgtttccgcagcagatgtgcatcaaacgaccggtcgcgacatagctagccagatacgcgcgcgagttggtggagaaccggtgtatatcacctttgatatcgattgcttggacccagcttttgcacccggcactggcacacctgtaccgggtggactgtcatccttccaggcactaaacattattcgtgaactaaaaggcatcaatctgataggcatggatgtcgtcgaagtggcgcccgcgtatgatcatgctgaaattactgcgctagcggctgcacagattgcagttgaattgttatgcctttacgctgaaagtcacagacaaagaaattgaaagagtaatcgatgaccaatgaagcagtagcaaaacacgattggtcctgtgaggattcgcaggcactttatgccatgagtaaatggggagatggcttttattcggtgaacaagatggggcatgtttctgttcgtcctatagaaggtcaggatctgcacatagatatcatagatgtaattcactcggctcgctccgaaggtgcttctctaccaatgctgattcgttttcaggatgtgataagttcgcgcgtgcgacgcctgaatcaaacgtttcggaaggcgattcatgaaagtggttacgaagggacatatcgcagtatttatcctattaaagttaatcagctgcaagaagtggtggcagaggtactggaagctggccaagaatttagcattggactggaatgtggttccaaagccgagttattagctatgctgccactgattgccgataaaacactgctgctttgcaatggcgtaaaagaccgcacgatgctgaccctgatgctgaatgcacagcaaatcgggcagcaagtgatgcctatcattgaaaaatactcggagtttgagcaattgatgaatttggcagaagcacgccagatgaaaccgcggctgggtgtgcgattaaaactgaacaccaaaggatcgggacgttggtttgagtctggcggtgctagttccaagtttggattgactattccagagctggtacaactgatacgaacattggaaagtcgggagatggtcgggcaactggaactgctgcattttcatctgggaagtcaaattgctgatattcaggtactacgaagtgccgtcagagaaatcatgcaggtttatgctgatttgatgttgcgggggatgcagatcaagtatctggatgtcggtggcggactcggagtgaattacggcggtgattacgacaacccggaatcatccattaattacggattgcgcgagtatgccaatgtagtagtttatacggttaaggaaatttgtgatcagcggcaagtacccatgccgcaccttttgtcagaaagtggtcgcgcactcactgcgcatcactccgtgctggtggttcctgttttgggtgtacacaagccggacagtccgtacatggctgaatctccggctgaactacctgccgtggtgttacgaatgacgtcggtatatagcgatgcacaatctgcggagaaaatgagtatgctgctggaatgctatcacgatgcgcaagaaatccgtcaggagaccgaacagatggcgcggttgggttatctgtctgttgaacacatggcgcaatcggatagtttgtactggagtatttgccgcgaagtgctgcgcaagctaacggcgattgggtcgattccggtcacagctgagcagattgagttggagaagcagcttacggacatgtatctgggagatttttccgtatttcattcgattatcgaccactgggccatcggacaggtattccccgtgatgcctctccatcggttgcgggataaacctgaacgacgcggtcaactggttgatttgacctgcgactcggatggcaaggtaagtcagtatgtaacatcgtccggcaccagtgattggttgcctttgcataattttcgtcaagatgaatcctattatctgggtatttttctcgtcggggcttatcaagagatactgggagacgctcacaatcttttcggacgtgtgggcgaagttcacgtttatgcaaaagcagaagaagcaaacggtttttggatcgaggcactgctgaagggaattagtgtgaaggaaatgctgagccaggttcagtattttcccaatgacctggatcgccgtatgtcggagtttatccgcagacagataaatgctggacgtatcaagcctgcagaaggaacacgaattcttaataattatactcagcgcttgggagataccacttactgtgatgtttcttccaatgaaccgttatcgtagcgcagcgacgacgagctaagcaggcatagtgggcgccatggcccatccgataattttgcgcggatacaggtccatgacggcggccaggtaaagccagccctggcgggtgcggacatacgtgatgtccgacacccaggcctgattcggttgtgctacgttaaactgccggtcaagtaaattcggtgtcacggggtagtcgtgtttgctatcggttgtgttaataaatttacgtttccatacaggacgcagtccattctcgcgcatgagccggcgcacacgaaatcgccccatgggaacgccacgctgcgccagtgccttgcgtacacggtgactaccgtagctcttgccactggccataaatgccgccttcacctgggcactcgcttgcacctccctggccgatgctttttttaacaagtcgttatcagagcgcaattgtcgaacctctgcctccagggttcgaatccgttgctgctcaagcgtcaacggcttaccgatgccgcgttgaccgttaagatctgcctgatactgcgcgacccaacgacgaatcgctgtttcccccacccccatcgttttggagacctcgctcacactaaggtcgtgatccttgatcatgtgaacaacttccaatttaaattgagtgtcaaatttcctgcgtgctttcattagtatgtcctcttaaagtggattttatccacctatcgaggtgtctgtttaaattagaccactacaaggcaccgaggttgagcgcgagcgcctggatgggtaggctcgagcccgtccgcttgtagagccgggtgcaggcgtcggcgaatttgatgtcatggtcattgagtccggcagccgctttctgcgctagcccgtgaaggatgtcgagttctgaccctgcttcgatcttgagcaggtcgggcgagaccgagttatcgtcgaaggcgaccactgcagccactacgaaaccgataacagccgattcgagtctgcgttgggcggcctcatggaggtaaggcagaagctcggctgccatcatcgaaaccgtgacgccgtgcagtaacgcaaagttgttcaggccggtgtttcgcacctgcgccgcacatgccgccagtgccagtcgatcgaaggcggcacgcagatcttcggccgggcgggctgatgcaacgaggtcgaacacaccgggctcgtccatcgccattcgtaagccataaacgagtagcccatctggcctctgggccgcatccagacggggaagtctggcgaacaggtcgctcagctcaagcgttcccccgagtgcctcgggagatttcagcgcagtacctcgtgaccagtaacccagggccgcagtcagttcccgtcggcgaatctcagattcgtggcgacctaacgctcgggtggcgtgggcaactcggaggagtccgtggcctgcttgagagccagctttgtaaactatctgaggaagctcttcttgtagttgcgactgccaattggcccgaccaatatagacgtcttcggtgagttcaagtttcttcgacacttcggtcacgtaaggaccaaacgcgtctggtaattcaagcgacgccaatgcctcaagtgccatcgggccatgattggaaaagccaccgccatactccgcgccaaagacaattagtgaaccgccccgggttttgaggaggctccaatatctgagaagatggagccatgaacaaatcaaataaatattcccccgaagtaagagcgcgcgcagtccgtctggtgcaggaacaccgcagtgagtatccctcgttgtggtcgacgattgaatccatcgcgccgaagatcggctgttcagcccacacattgcttgaatgggtgcgcaaacacgagaccgataccggcttgcgagacggtgtgaccagcgaagagcgcgaccgcatcaaagccctggaacgcgaagtaaaggaattgcgcaaggcgaatgagattctgaagctggccagtgcttttttcgctcaggcggagctcgaccgcaaactcaaatcctgagatcgttcatcgaccagcaccgcgacgcccatggggtcgagccgatctgcaaggttttgcaggtcgccccatcagggtatcggcgatatttcgcgcagcagcgtaatccggctttgcgcaatgcccgcgtcctgcgtgatgatgaactgctgccgcaaatacagtgggtctggcagaccaacatgcaggtctatggtgccgacaaggtctggcgtcagcttaagcgtgaagatgtccaggtggcacgctgtacggtcgaacggctcatgaaacggttagggctgaaaggcgccaggcgtggcaaggttgtgcgcaccacagttccggacaaggcgctgccgtgtccactggatcgggttaaccggcaattcaaggcagatcgtccgaaccagttgtgggtgtcagacttcacctatgtctcgacctggcaaggctggctgtatgtggctttcgtcatcgatgtatttgcccggcgcattgtgggctggcaggtgagcagctccatgcgcacggactttgtgctggatgccctggaacaagcgctgtatgcccggcaaccggggcggatggatgccttggtacaccatagcgacagaggctcgcaatatgtctccattcgctataccgagcgactcgccgaagccggaatagaaccctcggtcggcagcaagggcgacagctacgacaacgcgctggcagaaaccatcaatggactgtacaaaacagaattgattcacaagcgcgccccctggaaaaccagggaggccgtggagctggcaacgctggaatgggtagcctggttcaacaaccagcggctgctggaaccaatcggttacatccctcccgcagaagctgaggtaaactactataggcaattcgccaaggaagccattccggtggcttgactttaaccaaacagcctccacgaaacccgggacgattcattagccgttccagttctgcgtcgtagagttcgttaatagtgttcctcatacggtaatttataagatctcaagtaatgtcaaggtataggaaaaataaacgccctttttcataagaaccacatgtaccggaaaacggtttggtcgtcaacctgaccgggaagttgcccgaaatccttaaatttgtttttgaccgcagcaaaaagtattggtttgaggctttttttcgctattttcgtgaaagttactcgagggtaaaggtcggtccagtgatgaagagaactgataggaacgagcacaggatcgggttggctcggacggatcagagatttgcgcaggtgctccaggcggcgctcgggaggacaagccaggatggtcatgaattttagtgattgcgccagattccaggatggcggcgataatttccagggttcccctgcaatgcggacaatacttaatgtcaatatcgaacacccgcttgagcaaacgcacccaactgatacacacagaaaccgaggaaggtggcacagcattattcctgcaggaggattacttttgtttttcctgctgccgagaataatctcagaacgaagcttcgcgttgggcgcgagcacgccatggaaacgaatgaggttgagccttggcctgggaactaacgcggccagtcgttgcatgaattccagtggcgacatcacgatcccaataaggcgtttttagtgctgcccagcattatttagcgccagacgctcattggcaattgccggtcacgtgatgtaatgacacaagtgtaccagtttcttgcgctgactcatggtgcaccggcacccggaaaatgatgtgagcagccgtttgcgccatgcgccacccgtcgcacaaggggcgaaatccacgccgtttgcagaaaaaggccaccagtttctcatgggcgcaggttcttttggtggaattgggcggagggggtggccgtcgacatgatcgttaagaacgaaaacattcgttcttaacgtatcgatttctcttgccaggccttgagctgctacaataaatcaagactgggaatctggaattcaacgcggaacatgttgatgaggcgtggattcaaatcgccgagcgccggttcgcgcaatttgaatccggtgcggtgaaaccggttagctggaaagaaataaagctgaagctgatattggcatatctgtcaacgtgtcatcacggcggttccggtaccccgggtttatcaacgccgcgatgcgcgctgattgtgtgcagtaaagggtatcctctatagccgacttagagtgcttattttcataatcagcagcctcaatttcactcggcgtctcccattggcgcaagtgaccacaggaaattgttatgagccagtttgaataccttagaaggcagatgatcgatacccagttatctgcgcgcggcctgcacgatgaaacggttttgaacgcagtggctgcggtaccgcgcgaagcttttgttccggcagaactggtggagtttgcctataacgactctcccctgcccatcggcgccagccagaccatctcgcaaccgtatatcgtggcccttatgactgctgcgctcaacctgcaggcgggggaccgtgtgttggaaataggcaccggttcagggtatgcggctgccgttctggcagaaatagctgccgaggtttacacggtggaacggcacaaaattctggccgattcagctcgtaacaagcttgccgatctcggctataagaatattcaggttttgtatggcgacggcacgctgggttggcccgatcacgccccttttgacgccatcatcgtcgctgcgggcggtcccgaagtgcccgagacactcaaacagcaattggctattggcggacgacttgtgatcccggttggcaccagcttgcaaatgcagaaactactgcgcgtgcggcgtatcacagagcaagagtacatcgaagaggatatgggaagcgtccgttttgtaccgctgatcggtgccgcgggctgggaggatgagaccgctaccgcagttgcggcgggaaatagtgaagcatccctacctgagctgatttttaaatccagtgagcactttgcttcaattgatcatgtcaatctggacaagctactggcgcgcatcggtgacagccgcctcgtactactgggtgaggcttcacacggcacggccgaattttatgaaatgcggtcgcggatcacccgggagttaatcgaaaagaaaggctttactgtcgttgctgtggaagccgactggcccgatgcggcgcacctcgatcattatattcacggcaccgccccggacccaatgctagagagcacaccgttttcccgatttccgacctggatttgggcgaatacgtcggtgcttgcattcattgactggctcagagcccacaacgaaaaagtccgctcaactgaaaacaaggtaggattctacggtttggatctgtacagcctgagcacttctatagaagcggttttatcctacctggatacagtggatcccgaaacagcggaagtggcgagagtgcgctatggctgcctcacaccatgggccaatgaccctgctttatacggccggatggccaggaccaaagagtaccagacatgtgaagccggagtgttagcgaccctgcaggacttgatgaagaaacacctggattattcaatagcgaactgcaaacaattcttcgacgccaaacagaatgctcgcctgatagccaatgccgagcgctattaccgcaccctgtactacgccgaaaacaactcgtggaatcagcgcgaccagcatatgttcgagacgctgcaatctgtgatgaagttccgaggcccgcagtcaaaagcggtaatctgggcacacaactcgcatattggtgatgcacgggcaacggaaatgagtgcgcgcggtgagttcaacgttggtgaattagtgcggaagaagtatggcgatgctgcgtatattataggttttggtaccgatcacggcacagtggcggccgcctccgaatggggtggccctatggaaatcaaacaggtgcaaccagcgcacatcgacagctatgaacgtatcttccacggcgtcaacaccgacaactttctgttgccattacgttacccgctacaggaaattacacgtcaaaaactgcttcaggagcgattgcagcgtgctatcggtgttatctaccggcctgaagcggagttgcaaagccactatttctacgcttcactaccacatcagtttgacgaatatatctggtttgacgaaacccgagcggttgaacccgtaaccaggaaaaccacagaagggacactggatacattccctttcggtgtttagaatctgccagcgataccggaggcaacccgtttggaagcctgcggagtgggggagtattcctggtactcgaccacaataattcgcattgagacgttgctaatgtaattaggtgttcagccccagatgaatattgagattagcagccgaaccgaaacgttgaataacgtgtaattgctctgctatccttggagttcttccgcagtttagctgctttatgttcgaaccggtgaattcgaaggtaaaattattaaacttcaccaataggttgcgtaaacaaaatgattaaaggtacggttaagtggttcaatgcggataagggtgtagtggagcttccggatgagaactcatggggcgacagtggacaacaatgccagatgtttttacggcgcccccatctttccataaatgagctgtgctcaaacgaacgcgtaactatcgaaaccctacgaaaacacgtgcagagcaggctgcgccgaaataaaactgctgcacaatttccgcttttatccccgccccgagtaaacgaggatttatacggattttgctaaagtggaattatcgtaaaggcctgcggcggaagctcacgattagcattttttttgccttgggggtgtttattatgctcaccgttctgcaacgccaattgatctatttccccagcaaggcgcaagcggatgtgctgtcagaacttgcctcgcgcatgggcctgcaggtctggcgcgacaacgcaggagaggctataggctggaaatcccctggtgaccccaatgcctgctatcgaatgctggtgttccatggcaacgccggctatgcgctgaaccggagttattttgtgacgggcctgcgggcgctgggaaaccagtgggatgttttcctgttcgaataccccggatacggggctcgcgggggcacgccatctgaggtcaacttcaagaccactgcaacgcaggctctggaggcattactggcgattgattcacgaccggttttcattattggtgaatctctgggcagtggcgtcgccagttttctggcgtccaccttcccgaataaagtagcgggtctgctgctcatcactccttttcccagcctgactgatatcgcggcataccactaccccttccttcctgttcgcgccttgttaagcgagcgctatgattctcgagaagcgctgtcccattaccaggggccggtggcctttttgctggctggacgtgatgaagtggttaccagcgaattgggccagcagctctacgacagctatagtggccccaaatggctgcatatagaggcgcatgccgggcacaacactctgccctacgatcccgccactccctggtggggtgaagttacgacgtttctcacttccacagaaaagggctcgttgaagtaactgcgtattccggcggtccgcctcggtgcacttgtgcgcaatgacccgggaatcaacgcggccagacgctcattgacaattgccggtcgcgtgatgtaacaacacaggtgttccagttccttgcgctgactcatggcgcaacgcaccccggcatacaggctaaagccgtgggtgttggcacagtactcctggtctgactgttgttccagattttgtgtgggtgcggttttcaacaccagtaccttttgacctgtacggtgaccaagcgcaatccggtaggtgcaagccgccgattgcaagggtgccaaccaaggctgcatccgtttccatttcgacaccatcatcccctcctcctctataaacgcgccgaatcggccgtgtgcgtcttcaacgaccacggctaccgcgtcgtgatctccggatcttttttggtagctttgcaggtcgggcaaatgcaggtcgatttcctgagggcgaggctgcgggcagattgatgcggattctacggtaatcccccggctccagcccttccagcgaccagttgccaatacgatagcggatcagtcgcaacgttggaaagccgacggcggccgtcattcgtcgcacctgcctgttacggccttccgttatgatcagttccagccagctggtagggattgaatcgcgccagcgcaccggcggaactctgggccacagagccggctcttccattgcgcgcgctttagctggccgggtgcgcccatctttaagcattacaccggctgaaagcgctgctatagcgcttgcagaaatattaccctctacctgcacccagtaagttttcggcattttctggactggcgacgcaatgcaatgctgcaagaaaccatcatcggtcaatagaaggaggccctcggaatcgtaatccagtcgcccggccgggtagacgccagaaattttgatccagtctgcgagggtagatcggcgttctggcccggccgccgtgcgtttgtctgtaaactgactgagtacatgaaacggcttattgaaaaggataagctcagctatgaggtagctcccgggcaggtaatgaagaaattaagaaggatggtacgaagaaaagacacccaagggtaaaggtcagcccagtgatgaagagaactgaggagtgagcacggaatcaagttgattcgaacgggtatacccaaaccgatcctgcgctgaatgctgcagcagtccataaaacataccctcaccgatcatcaggcgctggaactggaaattgagaaggtaacgcagcaaggctacgcctttggtaacgaggagttattgcccgggcttttatgccttgcggtgctgtcctctcgtcccagcagcgtttccaacattggtgtggccacgcccatagctccaatcggttttcgaaaagtcacgatgaacagcttaaatgcgacgacccaccgacgccaaacaattccagtggcttcagcctatagtatttctcatccacgtccttcgattgctcggcgtatggttgtgtcatgacctcctgcagctcttgaattaaagagtagtctcctgtagccgcttgctgatacgcaggcaccacgaaccattcccgcaaactgtattttgggttgatgagtttcatctggcgagaaagctcctcacgagagcaagattgagtgagcgacttccattttgtgagccacgctgaccatcgtttgtccatcccttccgcgtctgcatgatacgtcgagttcttgtagaagctttttttgagtaagccaatatcgtcgggcaccatcgagagctcgcggaagaacatggtgtaatcaaccgatgtttgcagcatcagcgttaccagctcgctgaacaacgtcgcatgaaaagtgccaagcccaagcttggcagcccacatcttctccatttgcgcttgcatcacctttggaaaatcactttggatctcgtcgagctgcgccagacagtcctgatgcgccatcagcaacggccgcaatgccgaacaaaacatgtggaagttgcgttctgctgccacgggttggttcaggaacgagtaatgacgcccaccacccgtccaaggctggtaatgtggattgaacacatcacagaatccgaatgggccgtagtcgagtgtgaagccgccagccgcacagttgtcactgttgaagttaccctgacagtagccgacgcggatccagttcgccaccagcgacgtgagtcggttgagaaattcacgggcaagcaacaccactttttcggtggtcgccagcttctggtcgatgacgttatcgtactcacgatcgatcaaatgcaacacaatcttttcgagctcttccatcgctcgtgggtgttccatcttgcgggcacggcgaccgaagagctcgagttggccaacccgaatgaacgaagatgccacgcgtgtcgagatggcaaccgcttccgatacaagcatgtccggatcctgcgagtgtgaaccctccgagtaccatggccggcggaccttctccgtttttgaaacgtacaaactcaaagatcgagacgttggcaccccaagcgcatgcatgtgctcctgtgccagaaactcccggacactcgaccgcagaacggcccgtccgtcggcgccccggcaatagggtgtccggccaccaccttttagctgcatttcccaacgctgaccgttgatgacggcctcaagcactgaaattgcgcgcccgtcgccatatccattgccggtttggaacgggcattgctggtagtattcggtgccgaagatggaaagtgcatagccacacgcccaaccgaccttgcgcatcggctccggaacatgggcaaggtcgccggagaacacgcggacgaagtcggccgacgtcgccatgctgtcggcaaagcccagttcacgaaaaaaaattttactgtgcgccacgtactcggggtcttcaattggcgtggggttgacgggaacatagtgacccgtaaagacttgccgcggcgtgtggttgcgtccgtttacttccgcgtcagggtcgcagttgagagaatccatgaacgaataatttgccaattttgcgagatcgtcaagagtcgcaatgatagggggtgtttcttgggtcagtcgctttatcataagggctcctcatgcgtggaccaggggatgtaccggggaactccaggaagtgatggcatcgcgcaagtgggtattttctcagaggcggaaacgccggcaaccgctttcccggttactttgccgtaaaaataaattgatagggatactgctaactttatggaggaaaacaaatgctctgaagtatataaaattgagactaagcctaaagcagctaaagtgatcattccagcaaaggcgagcaaacggccagcccctgcatagcaagccgtacacacgtcataatatttgccattggccaagccatcaagttatttggggcggacgacaaatttaacgcaaaacaagttagggtaaataacaaaatctgtaaaaaagtcacaaacacaacaccttaaaaacaagctcaacgctcaataaaaaagcatggagctcaccaagtaaactctatgtaaaccctatgcctttaaaattaatatgccgcaaggcaaccagcctctttgcatttgactaatgttacagcgctactaaagggaatgcgaaaccttgcttagcagtcatacaacctattaactaacacgagcaaatattgggcttattgggctggcccttgacgtgaaaaccttgcagcttatggggaacccctaccatgcacaaacacaactgtaacattctgccactgggcgtaaatgacatgacaacagcagctgccatctgtgcagcagcgatgaatgaaaaccctttgcacatcaaggtgttcggtgccaacccagacttacgtcaacgtcgactcaagcgtatgtttcccgccctgctagcctatgtaaagcgtaaaggtgagctgtacggcgcttttattgacggcaacctcattggtgtattaggcatgctgccacccaatacttgccaaccaacacttagggacttgatacagttactgccaagaatgatcagtgccaacagccccctcggcagcttacgcttagccatttggttaggcacttgggctcgtattgatccaaaacaaccccattggcacttaggtcctttagcgatcgcacctcaatggcaatataaaggtgttggcacacaaatgattgagttcaccatcaaccaatgtgcggcagaggagcatctatatttagaaaccgacaaacaaagcaatgtggacctctatcagcgctttggctttaagaccctagccacacccactatcttaggcattcccagctgggtgatgattcgctcaacctaaacacgcagcggaactgccgcttaggtcaagctattgaaagtgatcttgctatcgaagtgcttgctgagctatcgcatcggtgaaaaactcatacgcacctgccaggatgaactgtacaccgatggccaccaggatcaaaccaaaaaagcgcagcaatatcttctgaccaagagggctaagcagtccttggacgccttgcgacaacaagagcacgacccagagcaccatcgtcaagaccacgatcgccgtcaaagcgacagacatattcttccaatagggctcggcaagcgcaatggtgattacggtggtgatcgctccgggcccggcaatgagcggcatggcgatgggcacaaaaatcttgcttcgacgttcgttgtgagtgagtgactcctgctggacactcgaagtacggccttgcagcatcgtcagccccatcagcaggatcaccaatccgccaccacaacgaaacgcggagatggaaataccgaaaatgtctagcatccagttccccgcgacggcggcggcgaacaggattgtgaaaacagaaatcgccgctagcaaagcggatttccgtcgctgcgtcctgtcgagaccgtcgaccgcttgcaggaacacaggaactgcagaaagtgggttggcaatcgcaagcaatgcgacaatcgcctgtatgtactggtccattgggttgatcattctaatagaatcgttgcagcagttttcggggactacgtgtcagcgaaggggagcgcaagcgttcggttgttgccatctctgctttccagcttcacaaagccatggtgccggtagaacgcatcgaactcgtcatcctttgcaactacagccaatgcaaacacaccgatatcgagttgccgaaccttgtaaactgcgtcggccaaaagagatcgcgcaagcccgatgccttgatagaattggtcaaccgctaatcggcccatcatcatgatgggaaccacagggtatcgcggcagccgcctcaaaaggacattcgatagtcggtaagactaaccgaaccggatgacagcgttaaaggtataggaaaaacaaacgccctttttcataaaaaccgaatgtactgggaaacggtttggtcgtcaacctgaccgggaagccacccgaaattcttaaatttattgttgatcagcagcaaaaagtgttggtttgaggctctttttcgctatctgcgtgaaagacacccaaaggtcaaggtcagcccagtgatgaagagaactgataggaacgagcacaggatcaggttggctcgaacggattaaagatctgcgcaggtactctaggcggcgctcgggaggacaagccaggatagtcaagaattttagtgattgcgccagattccaggatggcggcgatgattttcagggtccccccgcaatgcgggcaatcctcaatcaatattgaacacccgcttgagcaaacgcgcagcgcggccccctcggtgcgccggccaaatccgagtgccagcacgaagtgctcagcgcaaccgccaacaacatccttttatatcagcgatacgaatatgctacttactggcttattacccactaaaatggatagtacaggtattttttattgctacggcactggacaagtgacaacctcttacgaacattactggcctgtgaagccaacacaactctgattatcggagataatttactgctgcagtatttttctgatcgtaagttgacccagcctgccaattacctgcttcagcacgaaaaactctaatctcagggaaaaaccatgaaccctcccagcattgtctccacattccccgctacagaagaacttattgtattgtccaggaagcgcacagccaaatccctggatttcagcaaactggtggatgccattgccaccgccgcccttgagtacgatgccggccagattcagagcccggaacgcatggttgtaccctttgggattggtggcgtaatgctgagcatgccggccaccgcgcatgatatcgggattcacaaactcgtgactgtacaacccgcaaacaaggagcggcaactgcccaccatccacggcacggtaactgtgtgcgacacggaaaccggcaaacccatctgcctgcttgacggcccggaggtgactggacggagaacggccgctgtcacgatgcttgcaatccgtaccttcctgaagcaagcgcctcatgaaatcctgctgattggaacaggtgtacaagcgcgccaccacgttcaggcgctctacgcattgtatccacaatcaaaaatatgggtacgtggacgcagtgaaactgcttcggcagctttctgtgaccagtatcagtccctccatggcaagcttgttcccgcagagcagttgatttccgataatgtaaatgtcgtcattactgtcacgacaagcacacaagctgtctataacgaaactgccttacgcgatcgcctggtggtcggcgtaggtgctttcacgccggagatggccgaacttggcaaggtcacacttaatagtagcgctatcttcgttgatgatctggtcagtgcgcgtcatgaggctggcgatctcattcaggctgatatcgactggtcttgcgtgcgctcgctggctcacgcccttcaaaaccagctcgacgaatcccgccccagggttttcaaaagcgttggcactggcgcctgggatctcgcggccgcgcgtgtggcactgcaagccatttagaccaaaaacctgttcaagatctcgatcaaggggtgcactaggcaaaattgaacgataaaacggagcatacttggagtatgtaagcattttgagttcaatttcaataccgtaatgcactcttcaagtgagatattgaacaggttttaagcccaagtcaggtatcaagaccagacgtatcagacacatatcccgatcctgttttcatcccaaactttgtatgcgtacgctcctttagatgcccattaaatgcaagctgcgatctcgatccacagggcaaagcgaaccaggcattactcgcgatgccaccgcacaagattcgcttcatccagaaattttcacagtgtctgatcaacctgtaagctcacatgcatccttgctttatgaggtaatgggacgattgatgcttgggtttggattgatactgattgctttcaatttacgccccctgtttgccagtctttctgtcctgctacccgatatgttgcagcagcaagtactcacctctgcacaggctggctacctgacaaccttaccagtgttgtgtctcggtatttttgcaccactggcaccctggctgtcgcaacgaataggaaacaaacgaacccttttggtcgtcatggtactgttgactgcaggtacagccatgcgtggatggggaaatatcttgcccctgtttctcgggtcagccatggcaggcatggctattgcaatcggcaatgtactattgcctgccatggtcaaaaaggagtttccgcaatcccctgcattaatgaccggatcgtataccatggcactatgcgcgggtgctgccgttgcagcagccggcactttaccactcacccaatcgctggaaacaacctgggcaaccggactggcactctgggcgctacccgcaggaatagtgatgctgctatggttgccgtatgctgttgtgccagattcggctccacaaaacagacaacttcagacagtcagtttatggcgagactcactcgcctggcaggtaacgtttttcatgggattacagtctgcactgggttacagtatattcggctggattgtccctattttgcatgatcggggtttagatggcgtacaagccggatggatactgtccatttctatcgtagtgcaactgatcgcctgttttgtcctgccctctctggcagtacgctgcaagaaccagagcctaatcaatgcagcaatggcgctcactgctgcaatcggctttctgggaatgttgttcggcccaattgaattagtctgggaattcagcattttgcaaggaatcgggcagggtggcttgtttgcactcgcactgaccataatcgtcctgcgttctcccgacgctcacatcgcaacacacttatccagtatggcgcagagtgttggttatacgctggcggcactgggccccttgctgattggcatgctgcacagtctcactggcgggtatgccgccagcggctggttatttaccgctctgtgtctgggagcagccatcagtggctggggtgccggacgcaccaggctggtgcaggcatgctatacaagcaaggtgcgccattaaggagccgctgcttgtgagctgactttgccgtctttgcgaacaaccaaaggggtgaagcaaagaaggcaagggcagtgaactgggttgctacgtcagcctggccactacctgctttccgctgcattatgcttgtgggcgcagtcgcagttaaaggctggtttgctcacaatggcacgtcagctcaccaagacaagacgctgtatgcttggcttcgcacggttcattccccataacccccctgcacaactgtaaaattacagaattacgcagaagtctttttgcagaaaagactgttatcttggacaaggagttttcgtaatggataaagcaatatataaagaaaggtttccggatttctttgctgatgcgccggctgtaaccctacgcgatccgctggcacagtttctcggcacagcacgtgacgggatcatggaataccggtatgccgatgcggtacggttggcagggcattcctgcccgacagtagctggcacctggttgatgacgctacatggtctgcgtgcgctgtacgggaatgaattgccggtacgcggtgaaattgaagtctacatggctgatgcacgcgatgctggcactaccggcgtcgtggctactgtggtgcaacttgttaccggtgcagcaccagaaaccggctttcatggtattggtgggcgtttcgggcgtaataatctactgcatttcgatcagcccttacagggtgaaatcggcctgcgccgcaaggatacgggcgcagcagtacaggtggtgctcgatgcttccgtcgtaccctggccgaacgagatgcgccagttgcttccgaaggcggtcagtggacaggccagctctgccgaattgcagtactttggcgagttatggcaggaacgggtgcgccaaatgctgattgagcacgccggcgatgccaacctggtacaagtgaatacctgggttgtaaattaattgatcctgcgagttatcaaatctttatcatgtcagcgttcgctcaaaaaacactcaggcgcttctcaaggaaattgaaatgctgtcgcagtagctcgactgcgaacatcacccgtctgaatttttgcgttacttgttatactgcttgataaaaattagcgatcaaactatatcaatggagggataaatggacgttttaagtctggtggcaggatttttgctgggtgttgtcgcaacttatctgataagcgcctttctgttaaaacctggcctgcaaaagtcatccgatgcagcgacaggggtgattatcacaagcgatacccagaatctgtttgatcaattatggcaagcacatgagcacttgttgaacgagatgaaacaggatttggacaatccggatttcaagtttcatcgggaattttatgtgttaaagaaaaactggtgggactggaaccgctggggattccatcgtaaaggaccctgccttgcctactttattgatgatcacaacgatttactgccactgcttgatgcgctgacctcgcacggattgattagccagataggggaagctgacaaaaagtcggccaaatttcagttaagcgagaaactgattgagctgctacacgggaaaaagccaaccaagcatgcagcctgattgatcccacatagttatattgtgttttacagacggtactcaaaagcaatgaatgagcgattccttcacaaggaacgcgatactgtcatccgtctgtaaagccaatactcgaaaggagtaacaaacaggctgccttttttaccagtactgctactggattgctccgtacctgttggtgttcgcaaaaacagccacaatagacaataggatcgtagcaataccgtcaatcctgcagtaacaatttctccaacgtcaaccggtatatacgagatagtcgctcgatatccgcaacttccacggattcattaatcttatgaatagttgcattgcgtggtccgaattcgaccacctgcgaacagatatcagcgataaaacgaccatcggaagtaccgcccgaggtggaaagttccggctcaacgcctgttacttcgcgaatggcagcgctgagtgcatcggccagtattcccttgggcgtcaggtaaggcttgccggcaagctcccagaccagttcatactccagtccatgccgatccagaatctcatgcacgcgcgtcttgagtgattcaaccgtactggcggtagaaaaacggaaattgaacagcagattgacttctcccggaataacgttggttgcgccggtgccgccacggatattggaaatatgccaggtggtggcagggaaatattcattgccatcatcccatacggtttgggcaagctccgcaatggcaggtgcagcagtgtgaatcggatttctggccagatgaggataggcaatgtgtccctggatacctttaaccgtcaaattgcctgacagactgccgcgccgcccatttttaatagtgtcccctagccggtctgtacaggtgggttcgcccacgatgcaataatcaatcacctctccgcgtgcctgaagggtttccacgactttaaccgtaccctccaccgccggcccttcttcatccgaggtaatcagcaacgcaatcgaacccttgtgatcagggtgcaactcaacaaattcctcaatcgcagtaacaaaagcagcgatagaggacttcatatctgctgcaccacggccatagagaaagtcatcgcggactgttggtgtaaaaggatcgctatcccactgcgcaaccggcccagtcggcacaacatccgtatgcccgacaaaacataccagcggcccgtcaacaccttttctcgtccagagattctccacctcaccaaagttcatggcttcactgttgaatcccagtccggccagccggtgaacaagaattttctggcaaccgtcatcatctggcgtcagggaacgacgtgcaatcagcatctgggcaagtgtcagggtactattgggcatgggagtttccttggtttgagatttaagtgaaataatctggcagcaaaatcagagttgctgaaaaatgcgtaatgcattacgcccgcgtgcccctccaaaaaaatctttaataaacggatgtcgcccgttggcaataatatccggtatcggtcccagcgcgacaatgctccggttagccagcacagccactcgatcggaaattgcaaccagtgtatccagatcatgtgtgaccatgacaatcgtcagcgccagctcttcacgcaaagagcgtatcagctcaacaaaactttcactcaatgcgggatcaaggccggcagttggttcatccagaaataacagctccggatccagcgccaatgcacgcgccagagcaacccgcttgatcattccgcctgataattctgacggcatcttgtgaacgtgctgtgcctcaaccccgaccataccgagcttcagcatgaccagatcgcgaaccatggtttcgctcaatatacgcaactcccgcatgggcaaagcaatattgtcaaagaccgtcaaagcgctaaacagcgctccctgctgaaacaagacacccgagcgagtgcgcagctccctttctttttcatggccgcaatcatagcgcgtcgcacctaatactttgacgctgccttgtgcgggggtgatcaatccaagcatctggcgcagtagagtggttttgccgctaccagagccacctaccagtgccagcacctctcccttgagcacagtcagattgatattttcatgaatgacattctggccgaagcgagtagtcaatccggcaatttcgataactggttcagcagttgtcatcagcctgcaaccctgatgccgatactggaaaaagccactgcaaaaatggcatcaatgatgatcacggcagtaatcgaagtcaccactgaattggtagtaccttctcccaggctttcggtattcggtttgatgcgcagcccgaaatgacaggcaatcagggcaattgccatgccgcagaccactcccttgcccagtcccaaccataaattagcgattggtaccgcatcgggcaaggtagtcaccgcgtaacgaatacttaatcccacttgcagatccgccgctaaaagcccgcccagcagcgcaactgagctagtccagagcacgatcagcggtaaagcaagactcagaccgataattttggacaatactagtcgcaggctatgaggaatacccattaccgtcagtgcatccagttcttcggtcacacgcatgacccccaactgtgcagtcatggcggaaccggagcgcccggcaaccaatatggcagccagcattggacccagctcccggatgatactcatcccgagaatattgacaatgtagatatccgctccaagcatatgtagctgttcagaggaaagatagctcagcacaataccgatcaaaaatccgacgatggcagtaatgccaagtgcctgtgcgccagtacgatacaaattcgcagaaatttcccgcacaggaatcctgcttggatgagtcatcaggtaaacaatatccagcacaatctggccggaaaggctaatcatgccagcgaggtgatcaaaaaaacggaggagctgttgcccgagcagggagacaggcaaaaaccatttgcgctgtgtcggttcaggcagtgataccattttatccaatcgctgaaacatttgttcttgctcggggcgcagcagcaaatgatcaggacgctgctcgccccaaatctgccacaacatcacggcgcccgcgtaatcaagctggtggatattcgtcagatcccagtacaggccaggttgactggccagctgcgccagctcccttgcaactgcgggtaatgatgggttaagtgaaacgagggtatagctaccggtaagctgcagacaggaattacctgcttctgtggtaataagttgatgccggggattgtggtcaaccggcaaatcaaagggcatgactatcccaatccattttgactgttagctccggtttttgcgtttgttctgcgaatcctgggcaatcttttccggcttttggtcatgccggtatgcccagaacaccagtgcgacaccggctgcaatcatcggcagtgataaccactgacccatactaatccccagggtcatgacgccgagaaaaccgtcatccggttcgcgaaagaattcgcagaatgagcgaaaaacgccataaccaatcataaacattccggagatagcacccagtggtcttggtttggctgaatatagccacatcagaatgaaaaatgccaacccctccaatgcaaattcatatagttgggacggatgacgtggcagattgtctacatacgggaaaatcatcccccagggcacatccgttggtcgtccccataattccccgttgatgaaattaccaatacgtccggcacccaagccaagcggaaccagtggtgcgataaaatcagtgactgacaaccatgacagcctgtatttgcgtgccagccatatcatagccacaataacgccgagaaatccgccgtggaaagacattccgccatgccagattgccagaatctccagtggatgctgcaaaaaataacctggctcataaaataaaacctgccccagcctaccacctagcacgacacccagcacgccgaaaaacagtgcatcatccagcatttcccgggtaaagatacaaccgggctgatgccggatacgatagcgcccgagcacaatgaacaagaaaaacccgagcaggtacatcaacccgtaccagcgaacagcaagcggacctatggaaatcgcaatcggatcaaattgtggatgaacgaacatggcagcagcctgacttacggtaaaatacgcattatacggcaacatctgctgaccacagcaatcacccccagcaatcgttaccttgcctaactatattcatcacatctatctatctatctatctatgagggaataatatgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcatcactgatctgcacagagcaggcggcattccacaagtgatgaaaatactgctcgtgcacggtctgctgcatggtgactgtccgaccatcagcgggcaaactatcgctgaagtgctgaaagatattcctgaacaaccgcgcgcggatcaaaacgtcatccgcacctgggataacccggtgtatgaacaaggtcatctggcgattctgaagggtaatctttcaccggaaggttcagtggccaagatttctggtgtaaaaaaccccagcattaccgggcctgccagagtatttgaatccgaagaaacctgcatggctgccattcttgagcgcaagatcaagccgggtgatgtcgtcgttattcgctacgagggaccacgcggcggccccggcatgcgtgaaatgctctcccccacttcggcgctgattggcgaagggctgggtgattcggttggattgattaccgatggccgtttttccggcggtacctatggcatggtcgtaggtcacgttgcaccggaagcatacgccgggggggtgatcgctctggtggaagaaggagattcaatcacaatcgatgcgcatcgccgcctgttacaactgaatgtttcagaaacagaattggaacgccgccgggctgcctggcaaccccctgcaccgcgctacacacgcggtgtactggcgaagtacgccaaactggtatcaaccgccagtcgtggcgcggtaactgattaatcaccctataaaaacaatgtctaaccaccttgccggagaaaccagcccttacttgctgcagcacgcagacaacgctgtggactggtatccatggggaaaaaaggcattggaaatcgcacaaacacagaataagccgatattgctctccatcggctattccgcctgccactggtgtcatgtgatggcgcatgaatcatttgaagatgctgaagtggctgcaaccatgaacacgcatttcatcaatatcaaggttgatcgtgaagaacgccctgatattgaccaaatttaccagagtgcacactatgcgctaaatcatcgttccggcggctggccactgaccatgttcctgacacccgaacaaaaaccttttttcggcggcacttattttccaaaggaagcacgtcacggtatgccgggattcctgcaactactgccaaaagtggcagagacttatcacactcgtacagcggatatcgaacagcagaatgcagtattactgaaattgcttgctcaatcactgcccacacccaaaaccgatgcttccgtactttcccgacaaccaattgaccaggcatggcaacagttgaatcgccagtttgatgaaatgtatggcggatttggcgatgcgcccaagttccttcatccggctgaattgcagttctgcctgcgacgttatatcgctgataacaatactcaggcactgcatgttgtgatccacactctggaaaagatggcgcagggtggtttatatgaccaactgggcggaggattctgccgctatagcactgatcgttactggcggattccacattttgaaaaaatgctgtatgacaatgcgctgttgctgcccctctatgcagaaacctggttgataaccggcaacccgcttttcaaacaggttgttgaagaaacagcagcctgggtcatgcgggaaatgcaagccagtacagcagcaggtgggggctatttttcctcactggatgctgattctgaacatgaagaaggcaaattctacgtctgggatcggcaggcgattgccgcgattctcaccagggaagaatatgcggcgacagccccttactttggccttgatcgccctcccaacttcgaagatcagcattggcatcttgaagtggtgcaatcaatcgaggcagttgcagcaaataatcaaacccattcggaagctgcgcaacagctcattgacagcgcacgcaagaagttactgaacgaacgcgagcagcgtatccggccgggacgtgatgaaaaaatactgaccagctggaatgcgctgatgatcaagggcatggcgcgcgccggacagatttttgaacgtgggaaatggattgattcagccgtgcaggcaatggatttcatccacgacaggctatggcaggatagctgcctgctggcaacgttcaaggatggcaaagcgcatctgaatgcctatctggatgatcacgccttcctgctggatagtctgctgacgctgctgcaagcccgctttcgacaggcagatcttgattttgccatcaccttggcagatacactgctcacccggtttgaagatgaaacatccggtggattctttttcaccagtcatgaccatgagatgcttattcaccggcctaaaaccggtcacgatggcgccattccggccggaaacggtattgctagcatagccttgcagcacctgggctatctagtgggcgagccacgctacctcgaatctgccaaacgtacactggatattttctctgatgtgttgtcacaccaggccagttcgcattgcggcatgctggtcgcgctggaggaatttctggaaccaacccggacagtgctcctgtctggagatgaagcagaattgcaggtatggcttaaggcactggttccctgttcattgaatatgatatcaatcgcattacctcatgaactttccgggttacccgatggtcttaaaaaacgctctgccccagatgaaaaagtcagtgctcaagtatgtgagggcaggcgttgtcttccggagattcattcactgaatgaactgctgcaagtctgcagggttcacggtagaatggcactcccttaatcattcataaaaggaaaaaactgatgaaaacagcttggttaggtgtatttgctgcttcagcattgttagtggccggttctgttcaggccagccccgaattggcagcaaaaaataattgtgtcgcttgtcatcaggtagatgcaaaacttgttggcccttcatttaaagaaattgcagcaaaatatgctggtcaggctgatgaagccgggtatctggcaggaaaaatcaaagggggcagcactggtgtatggggtcagattccaatgccaccaaacgtcaatgtcagtgatgaggatgccaaagcattggcagaatggatctcgacacttaaatgatctgatcatcagctataaatttaagccgataccgggaaccgtatcggcttttttgtttccgggccgccaatccaagctatcaagaaagaccgctttatttgacaacgtacctggctttcaatacatttctttgaaacattctttttaaatatccagccatataacaattatgcttacggttttccttgatttcggctccgtcacgcgcggtgatattgatcgggcagcgctggagcaggccgtatctccctggatttatcatgacaacacctcccgtgaacaggttacagagcggatcaagggagctgaaatcatcatcagcaataaagtgcagctggatcggacagccatatttgcagcagatcagctaaaactgatttgtgtcgcagccaccggttataacaacgtcgatcttgctgcagccgctgagcgcaatattccggtatgtaatgtacgcaactatgccactagttccgttgcgcaacacacgcttatgttcatgctgaactttgcctgccgtttcgtggaatatcggcagctgataaaaaaagggggatggcagaccagcacctacttctgcccgcttgatttcggcgttatggaattggcaggaaagacgcttggtatcatcgggcatggcgagctcggtagtgctgtggcaaatatagccaaagcatttggtatgaaactgttgatcgccgaacataaatccgcctcatccatccggcctgggcgcatggcattcaatgatgttatccaacaagcggatttcattacgctgcactgcccgttgtcggcagatacccggcatttgattggcaagtgggaatttgatctgatgaaaccctcggtataccttattaatacagccagaagcggcctgatcaatgaagacgacctgctgcaagccctttattctggccgtattgccggcgcagctatcgacgtcctgcaagcagagccgccggttaatggcaatcccttgctggattaccctcatcccaacctgcttattacaccccattccgcctgggccagtgtggaatctagacaacgcatgatcaacctgctggcagataacatatgtaatttcctgcaaaacaagccttttaaccagattaatacagcgttgcagtaattctggatacgcatatagaccaggtaatgtccaccgctgcactctactgcttagaacctgttcaaggaaaaatctgaatgaaagccacacctcttgcgattcctgatatctatctaatcgaacccaaagtatacggcgatgaacgcggcttcttttttgaaagcttcaatcaagccagttttgaagaaatcatcggcaggccggttcagttcgtgcaggataatcacagccgcagtatgaagaatgtcctgcgcggcctgcattatcagattcagcaaccgcagggcaagctggtgcgtgtggtgcaaggtgaagtgttcgacgtagcgattgatctgcgcaaaagctcagaaacctttggccaatggacgggggaaatcctttctgcagaaaacaaataccaactctggatacctgaaggatttgcccatggttttgtcgtactgagcaataccgccgaatttctctacaaaaccacggattactatgcacctgcccatgagcgctgcattctctggaatgaccaaacactcgacattgcctggccagcaggtattcagcctgctctatccaccaaggatgccctgggaaccccatttgatcaggccgaggtctttgactaacgcaagagcttctgcaacaccaatggaaatgtgcgccaactcctggcgcaatacggcttgaagtatcctgacagcccggaaatctcgaagaaactgatttgactatgtcccaccctttttatcagcatcgccgcatactgattgcaagcctagtcggcacaaccatcgaattttatgatttttatatttatgccacggcagcggcactggtattcggacctttattctttcctgcagaatctccgtctgcacaattaatgttgtcattcctgagctttggactcgccttcctcgcgcggccagttggcgcaatattatttggccattttggtgatcgtattggaagaaaatcaacactggtcgcctcattgttgctgatgggcatatcaaccctgctgattgcattcttgcccacctacgcgacagcaggctggatagctccgttactattgtgcaccctgcgttttggtcagggactgggacttggcggcgaatggggcggcgcggctttattagctgttgaatacgctccccggggatggggtgcgcggtttggtatgattcctcagttaggtgctccaattggattcattgccgcaaacggattgtttttgcttctcggcacggtgttgagtgaaacagactttgcagcatggggatggcgaatcccattccttaccagtgcaattctggttggacttggtttatgggtgcggctgaaaattaatgaaacacccgaatttacccgggcactggcaaaagatcctcccattccggttcccatcggcgagctgatacgcaagcatgccgctatcacctttgccggaacgtttacagtagttgcctgttttgccatcttttatctttcaaccgcttttgcactggctcatggcactacgacacttggatacgatcgtgagctgtttctgctcactcagcttgcagcaatattatttctggctattggtatcgttctctcgggaatacgtgccgatcagcatcacgcaaaccaggtactggtatggggatgtgcagcgacaattatcctgggcttaatatttggaccagccttgggggcgggatcgctatggctggtctggatggtgctttcgcttgccctgtttataatggggtttgtgtacggcccgcttggcgtatggctaccatcgcttttccctccgcgaatacgctatacaggcatatctgttgccttcaacttaggaggtattctaggcggcgcactcgccccccttgccgcacaggcacttaatgatgcgggaggcacatcctttgttggcctttatctgacaatggcaggcatattcagcctggcgggattaaaaatgactcaacaattgataccaaaccaggtacacaaattgaattaagggtagatatctgttaatcaactgccgccttaccacctttaaccagatatggattactcaatgatgatgtctcaagaaaaaattcaggaaaggaatcagacttcaaagaaaaatggatataaggcttgattgaggccagcgtcacctgccaatcaaccaattcaatgaaaacaacctgtccgaatattaccgcacccaagctggcgtgtgattttgatgatttgagattgaatgatgatattctgctgcaggaccatgtaaacccatttttactcaatagccggttagcttcatcccacaaacgaagaaaggtaaacccgagtctgtagtgagggtttacataaacatcaaaatcccatgctgcttgcctggttggtagcggaatataacgcgctcgcacttcatcttcctgataaggaccaagcatcagccagataaaccctaaaaactcctcatccttagaagcaaccaggcagattgctccatttttgaaacgctctcgaatgacggatattggccgcggaaaatgatgaataaccgaatcctgttcatctatttgtctgattactattttcttacctcttgccagaggtaagaaagaattgttgttaacaggctgtgcaactaattgatacttaaaaattcttatattcccataagatatcttgaaaagcagcctatgcaaaactaaaaatccggtattcatccaaccaatcgcagatattgactgactaatatatctgtatattttcactacattattgataatgatcattatctaattacctcgagtaaccaaatatttttattgccttttacgacataataaatatgtcgtaaccaatttaatctttcgagaaaatactattctagatctctcttttacttcactcggatatagaaactactttcatgagtaaaacttttcccactgtcacttacttcatcaatacgctcctgtagaagaaacattgccaatctccaatgagacaacttctccttgatattactgaaatcggcccgccgtcactggacaactttattcctgaagggaacgaagagttgctgtacacactgaagaatctggttgccgacaatcgtcaagatcgtttttattatctgtggggaaatacaggaagcggtaaaagccatctgctgcaggcggtaaccaatatttttctggaacagcagcgcaatacacactacattgattgcaatcaggctgatgaaattgacttcaatctaaccgcagattgcatagcagttgataacattgaacaactggatgatgctgaacaaattagactgtttaatctttataaccagatccgagaaagcaagtatgggatatttttggctggtggcacccggccgcctgcacaattgggcttgcgtccggatctggctactcgcctgggctggggattggtatatcaggtacacgaattaacggatgaaaaaaaaatagaagttatgcaagactatgcaatccgttgcggatttgagttgcctctggatgtttgcaactacttactgaagcatgaacaacgggacttatcctccctgatcaggcaggtcagcgcgttggatcagctttcgctgactaggcagcgccccgtcacccttcccttgctgcgtgaactgttataatcagcaccggtttcggacgatcgtcaatctcggaatatcagatgattgcagtcgctccgttcaactttgaaacgaatctgctgtttttccttacacagttttattacatctattttttcttataccgatcagcatcatgaaactggcattatttgacctggataacacactcctggctggtgacagcgattttcaatgggcacagttcctgattgaacaaaatgttctggatcgggaggtctacgaagctcgtaacattgaattttacgagcaatacaaagcgggcacactggatattcatgaatttctgaattttcagttaaagcctctttcccgccacccgcgcgaacaattaaatgaatggcgcagtcgttttgtcaaacaaaaaattgcgccattgattgcccccggcgcttgtgaattaattgctggacatcaagctgaaaaggatttgtgcattatcattactgccaccaatagcttcgtaaccgcccccattgcccgcatgctgggtgttgatcatctaattgccaccgaaccggaactggaaaatggtgaatttaccggccgcgtaaccggcactccctctttccgggaaggcaaaataacccggctggagcaatggctggatatgcataacctcacctggctttctttcctgcaaagctggttttatagtgactcactcaacgatctgccactcctcaaaaaggtgacacatcctgttgcggtggacccggatgccacactccatgaacatgcgaaaaaatgcgggtggcgtattattagtctgcgccaatagcacctcaatcagataatttacattttttaacaaggagaaaacaaaatgaaacatacttccatagcattcctactaccagcaattttgagccttttactttcatttagcgcacaggctgctgacagctatcctgaaaaagcaggagaaaagctggctacaggcgttgccaatatcgttactggcattggtgaaattcctaaaaacatgatgatttccagccagaaaaaaggaactatctacggtgtaacagcgggatttttcgtgggcatcgttcaaacagtggggcggacattaagtggtgcgcttgatatcgtcaccttcgtaatacccactacttccctcgttcaaccggcttatatctggaatgatttcaatcgggaaacaacctattcagcctggcgtatgcgttgataatattgagtttgatatcaattacccttgccaggattcgctccggctggaagaaacacatgaagtcaagacagacaatacaactggttccgatataatatcggttttgtgaaggatcggcagcatgcgactcatacaaaaagcactcaccttcgacgatatattactgcttcccgctcattccgaagtcttgcccagggacgttgacctcaccacacagctaacccgttctctccagatcaggattccgattgtttcagccgcgatggatacagttaccgaagcacgacttgctattgctatcgcccaagagggcgggatcggcattatccacaaaaatatgccgatcagcgcccaagcagcgcaggttgcacaagtaaaacgcttcgaaagcggcattgtcactgatccgattgtcgtctctccagacatgaccgtcagaagcgttctggaactgattcggcaacacaacatatccggcttgcccgtagtaaagggcaaaaaggttgtaggcattgttaccaaccgcgatctgcggtttgaaaccaaccttgatcagccggtcaaaaatatcatgaccccgaagaagcgtctggttactgtccgagaaggcatctcacaggaagaagcactggccttactgcataaacacaggcttgagaaagcactgattgtcgatgaaaacttcgaattgcgcgggatgattaccgtcaaggacatcaccagaacaaccgaacatccctatgccagcaaggatgaacgggaacgtttatacgtgggtgctgcaatcggggtgggggaaggcagtgacgaacgtgccgccgctttggtggaagctggtgcagatgtaattgtcgtggacacagcacatgggcattcgcagggcgtattggaacgcgtgtactgggtcaggagaaattttcctgaaattcaggtaatcgccggtaatgttgccacggctgcaggagccaaagcattggtagatcatggtgttgatgccgtaaaggttggaatcggtccaggttcaatctgtaccacccgggtcatcgctggtgttggtgtcccgcaaatttcagcaattgataatgttgctactgcactgcagggtacaggtgtaccagttatcgcagatggaggtattcgttattccggtgatattgccaaggccattgctgcaggggcaagcgcagtcatgctgggaggtctactggctggaacagaggaatccccaggtgaagtcgagctactcaagggtagagcctataaaagttatcgcggcatgggctcattatctgccatgcaacaaggatcaagcgatcgctattttcaggaaaccgagcgccatgaagcagaaaaactggtacccgagggcgtggaaggtcgcgttccttacaaaggctctctcgccaatgtcatccatcaactgacaggaggtgtccgttccagcatgggttatctgggatgccataccatcagtgaaatgcatgaaaaagctgagtttatcgaaatcacgtctgccggaatccgggaatctcatgtgcatgacgttcagatcaccaaagaagcccccaattatcacgttgaataaccctttactgatatgcattcagcaattcttatcctggattttggctcgcagtacgctcgtttaatcgcacggcgcatccgggaaaccagtgtttactgtgaactccacccctttgatgtcagcccgcaatttattcgggaattttctcctgttggcatcattctctccggcgggccggcatccatctttaccaatgacgcgccgcgtgtgcctcaaattgtgtttgaactgggtgtccctgttctcggcatatgttatggaatgcaggccatggcagctcagctcggaggagaggtggaaaatgcgcaaacgcgcgaatttggctatgcagaattgttaacagaaccatgcaggctgttccaggacatcaaggatcgcatcagctctgatggcaaacccgctcttgatgtatggatgagccacggtgaccgggttaataaattaccgcctgggttcacagccattgccttcaatgcagccactccctttgcagccatggctgacgaaacacgcaggttctacggtgtccagttccatcctgaagtcactcacacccttcagggaaaagctatcctcgatcgtttcgttcatgatatctgtgatgcgggctatgactggaacatgccggattacgtagaagaggccattggccggatacgcgcgcgcgtcggcggcgataaagtcatcctgggattgtctgggggggtagattcttcagtagccgccgcactaatccaccgcgccatcggtgatcagctggtatgcgtattcgtagacaacggcctgctccgcctgaatgaagccaagcaaaccatggaaacctttagccggaatcttgcggtcaacgtcatctacgttgatgctagcagacaattcctggagcaattgaaaggaatcactgatccggaacagaaacgccgcaccatcggccgcgaatttgtggaaatctttcagcaggaagccgcaaaaattgaaaacgtcaaatggctggcgcaaggcaccatttatccggatgtcattgaatctgccggcagccacacaaagaaatcaggattaatcaaatcccaccataacgttggtggtctaccagaaacacttcgcctcaaattgctggaaccactgcgtgaactgttcaaggatgaagtacgagaacttggcctggcactggggcttccgcgtgacctggtattccgtcatcccttccctggaccgggactaggtgtccgtattctgggagaagttaaatacgaatatacagaattattgcgtcaggctgacgccatctttattgaagagctgagaaacgctggatggtatgaaaaaacctcccaggcatttgctgttttcctgccaataaaatcagttggcgttatgggagataagcgcagttatgagtacgtcatcgcactgcgcgccgttcagactgaagatttcatgactgcacaatgggctgagctgccttacaccttgcttgccagaatctccaaccgcatcatcaacgaaattcgtggcatcaaccgcgtagtttacgatatctcaggcaaacccccagcaacaattgagtgggaatgagggcattttataagtttttgatctaattacaaaaacaaagactcaataacgatatatttcgcatcatcaatggtatttttcatggcatgatgaggacgtgccattgaaaaaaacgccgataccgcggctagctaaataaagctggcatggtatcgggaaagcggatcggccattcttgacgaggcatgggggttcttgagttttcatgacatcgtcgtacctcgctccgcgccgtacgggtgatgacattcacttccccctcgacgacaacgcctttcaacaacggtaaagatacaaagaacggacaggtaatgtggttggcggaccacatgggcatgccgtgtatcaccttgcgtcccatcgtcgcttcagagaaatcagtctatcgtcgttatttagtgagctgcttgcttctccaatttgtttcaatatcccctccattccatagggccatgccaatacgttgtctggcagaacggcatgaagtagagccaacgcctgttccgggtaccggtctactatgttgtctccggatcgacgaagctctggcagtatcaaatggtcacgctcgattctgcccaagagaggtaaaaccaatgcagctatggtaggaaattcatcgccgctggagaaagccagttcgcaaaggcgagctgacgtgttggacgatctggctgatagttggcgcggccaaatctgaagcagttcggaaagctgtccttcccatcgctcgtgtgagttttcgttcttttcgtcagaccatcgttgagcctgccacagaacccgtgatcgaaattcatcatcgaccgttaagagcaaactgcgcatctcgtcattggaaatgcaacgctcacctgtggcatcgtcgacagttccccacccggcaaggatcatacctgcgatgatttcaccatatgagcggcgcgatgggagaggattagcggcgaactccagcatatcgtttttcaaccgcatatagagctctcgatttggagttctcgccccccacaagaagcccaaccatgctgcgtcgcggtcgtccgtgtcgttaccttgaagcgcaggcaacaaatattgttccgtccatttcggatcgacagcgaaaaaccagttgaggttgtgaaacaagatcacaatcgcatgtctgcgcaagtcgttgggaagcgccaacagggcctcagcgtgaacgagccattcggaaggaaagccttgattccgattcagattattcttgcggggatcgttaaaaagcgcctgcgcgatcttacccgtaggagaattaatcgcttccatcgtccagtctggttccttggaaccacgcacaatacccgaatgtccttcgttcggcgattcacggaggacgccagccagcttcttcaaaatgcggtcaaaaacagggaggcagtctttgctcagtttcgcactggcatcttgtagccaatcggtcgcagggcggaggatcgttgcaagctgcgcatttggataacgagctagtcgttcggcaatcagccaggttaatctggcctcgtcattcttccgtgcctctgaattaaggaagcgttgccatgcccaatctgggaaatttcctcgtttagctgcataggtcagcgcggcaaaagcgcgcgcagggcgttgagcggcgagaccagcaaaaggatcgttttcgacgagaaaatcgtctgatcgaccgctacgttccttggctcgcaacagtactgaatcgtcccgggtttcgtggaggctgtttggttaaagtcaagccaccggaatggcttccttggcgaattgcctatagtagtttacctcagcttctgcgggagggatgtaaccgattggttccagcagccgctggttgttgaaccaggctacccattccagcgttgccagctccacggcctccctggttttccaggggcgcgcttgtgaatcaattctgttttgtacagtccattgatggtttctgccagcgcgttgtcgtagctgtcgcccttgctgccgaccgagggttctattccggcttcggcgagtcgctcggtatagcgaatggagacatattgcgagcctctgtcgctatggtgtaccaaggcatccatccgccccggttgccgggcatacagcgcttgttccagggcatccagcacaaagtccgtgcgcatggagctgctcacctgccagcccacaatgcgccgggcaaatacatcgatgacgaaagccacatacagccagccttgccaggtcgagacataggtgaagtctgacacccacaactggttcggacgatctgccttgaattgccggttaacccgatccagtggacacggcagcgccttgtccggaactgtggtgcgcacaaccttgccacgcctggcgcctttcagccctaaccgtttcatgagccgttcgaccgtacagcgtgccacctggacatcttcacgcttaagctgacgccagaccttgtcggcaccatagacctgcatgttggtctgccagacccgctgtatctgcggcagcagttcatcatcacgcaggacgcgggcactgcgcaaagccggattacgctgctgcgcggaatatcgccgataccctgatggggcgacctgcaaaaccttgcagatcggctcgaccccatgggcgtcgcggtgctggtcgatgaacgatctcaggatttgagtttgcggtcgagctccgcctgagcgaaaaaagcgctggccagcttcagaatctcattcgccttgcgcaattcctttacttcgcgttccagggctttgatgcggtcgcgctcttcgctggtcacaccgtctcgcaagccggtatcggtctcgtgtttgcgcacccattcaagcaatgtgtgggctgaacagccgatcttcggcgcgatggattcaatcgtcgaccacaacgagggatactcactgcggtgttcctgcaccagacggactgcgcgcgctcttacttcgggggaatatttatttgatttgttcatggctccatcttctcagatattggagcctcctcaaaacccggggcggttcaaaacgacatgtgccacttgaccacgctcatacggctgaactgctgctggtcccttcttggatgcatcaataatctttgcataccagacatcaggatcacgcgcacgctctgcccaagtatcaagggattgccataaagcaacgtgttcgtttgcagggctataggggatagcttcaacacctttgtgctgccatcgtgcagcagcaccatcgtagtcgccggactgaaaagcataagcgttctcaagccttcctgaagtcttacgcaatgcttcaaggagatattgaacgggtgggtcgtcagccgtatatccaacgaatacaacggcatacttgtcaagtattttacgaatgaatgttgttgcccatccgtctgatagataagcacgaccaaattcggagcttgagagaacaaacccgtcaccctcagcgccggtataagtcggcgtggatcggccatgcagatacactactccattgatctcattttggcgcaaaggatctggtaacctcggcggttgccatatttgaagttttgttccgcagtcctcaaacaatctgtcgaagttcgtcgtgaccaattgaacagcgccctctggcgtggtcgctaagtcgagcaagatcctatgtgcagtgagatcacatcccgttgacggctccaacgcagatgctaccgcctcctcaatgtcacgcgaggcaaagtctctctccagaagtccgaaaacacggtcggccgatataacgcccggaacgccaacgcgccggtcaatttcctgagcttcttgaataagtttataggctggactgttttgatcaacgccaagcttggaaactaccttacgagctaagccaaagaaatcagggagtttcgcgcgtgctcttgatactcctgcaccacagaagaaaattacgcggccctgatctctggccaggaggaggtcatcggggattgatggcccgtcagctaagaatcgcaaatgctagtctccactttttttatcttagactactaaagtctgacatttctctgatgacaactaagctcagcatcgtttggattaaattcagttgaatcagaccagtagttggggtggcaaaaccagttgaatctttgcattcgctgcacagcatcaaagcctcccgttgccttggtttcggtcatcaaagatctggatgtgttgcgtttcgaagcgcgttgaccttgcacggctgcctgaacttcccgctcggtgggcagcgtcatcctggtttgcgcgatgctggtcatgactagttcctaggctgtgaagcaattacaggaaccatattattcgaaataaacgaaaacacaataaacaaaaagtggttgggaacgatcgttgttgttctgcgcggggcaaaattttccgactcaatggatgttattgctcttgtggatcactgatgagcaggtcgatgacctgcatggtatttctcgtggtatcggagtagaaggctgttttagtgctttgattcaaaaattatttttctttttgttgataactgagttggagtaaaccgccgcgtatcaatggtatcctgtatttatttatgtcgtcatccaactaaacacaatggaacatgaattctggctacaaagctggcgcgaagggcgtaccggttttcatcaactacgcgtacagccgttactgcagaaatactggccaacacttgatctaccaactggcagcaagatatttgttccactggctggcaaatcattggatatggcttggctggctgcgcaaggctaccgtgtattgggtgtagagctttcactactggcagtacagcagttttttgccgagcatggtctgaaacctgcggtgagagaatctcgctatggcacacattacacagccgggaacattgaggtgatctgtggcgatgcttttgcgctggatgcagcgctgctttccgattgcagcggtatctacgatcgtgctgcgctgatcgctctgccacccgagctgcgcgtaccctatataaacgaactcatgacatgtctgccggctggttgtagcggtttgctgatcacacttgaatatcagcagcaggaaatggttgggccaccgttttcagttgaagaagccgaggtactgaagtgctattcaccccgctggtgtgtcaagctgctggaacgaaacgatatccttccccaagaacctggttttgctgcacgtggcctgacaaaacttgccacagcagtgtaccaactccaacgactggctgtataaatcaacaaacggcgtggggtactgttgataaaacaatactgcacggataacctccctcaagaaatacaatctctcaccataactgatcgcataacctaaagtcggttgcggagcggggacaagctggaagtcaaattttttgatatgtttcttaaggtggagcacagcacattcgcaataacattcctcgcaataaccctgccctgcatttgtaatgatcaatcaaaattgaacttttcccctacactgtcgttgcaagtaactccagagttgatgtaactcttatatacggtgagcctatgcaaatagagccacccaaggatgcactacctggatgtaattccgttaaatccaattaacatgaaatttaatcccaattaccccaacgacaacaacaagggacaacgtcaactgtggaatgcgctcaagaacgcttttgagcaggatgaaggtgttgcgtactaccgataccctatcttcgcaacgagtaaacgagggcgaagtgagcctgatttcctcatgattcatcgccgcttcggcatatggatctttgaaagcaagggctgcacgattggaaatatcgcagcaattgagggccacgactggcaaatgcgcgactggtacgctgacagcatgtctcctataagccagatcgaagcgcaactatttgaagtcagggcgttatttaaaccaagcccaatgttagaaaaacttaaaataccattcgagtaccgggttgtactgccgttcatttcagcctctgaatgggctatgcaaggtttttcgaaacatccaagtacaaatggtgttgtctggcttgaagaagatattttacagacatctttcaggcaacaggttaaagctgtttcatctgcctatatgcccacgcttgacgatgctcaatgggagcaaattctcggagtattccgaggtatcgctacgaccgagccacctagacaacccaatccaggcgcccctgtttcttgtcatagcagggtgattcatgccgttgaaagccgtttgcgtattttggatgagaagcaagatcgaatttctcaggaagtccctgaaggtccccagcgcatgcgtggaatcgccggaagtggcaaaacagtcttgtttacaagacgagttgcacagatgcatgcatctaatccggattgggaaattgcatttgttttctggagtcgttcactttaccaacaaattcgaaatcttattgataagcactaccgacgattaaccggcgaaacccctgactggaataagttgcatatctggcatgcatggggaagcaaggaactcaccggcttctatcgtgaattggcattcaggtggaaatgtcgcttcttgagttttggggatgcagagaaaatgacaatccgtggagaatcagcatatgaagctgcctgccgcaacctcgaagaagaatgcaagagttgtccatcattgctcgacgccatcgttattgacgaaggacaagatctgccggcatctttctatcgaatagctcatcatgcgctacgtgcaccaaaacgcctctattgggcctatgacgaagcacaaggagtagattctctgatcgtcccgaatgcctcagagatatttggcagggatgagcaagatcgtccttatattgatctatctggcagctatgcgagcggcatgcggaaggcgcataatatgaattgttgctatcggattcctcgtcagattcttttagcagcgcatgccatcaacatggggttacttcgagaaggggggccacttcaaggaatcacacgtaaagaagactggatcgctttgggttaccaagtggtagaaggtgatttcagtgcagcaagcgtaaaggcatgtgccaccgttgtactccagcgtccgaataagacaagtggccaccccattgacaatcccgagttcggagcaccgttggacaaatcaacaatcttggtgattcatgagagcttaagccaggcagaagatgttgatttcgttgcaaccagtattcaccgtgatcttgaatcaggtcttcgtccagaagatattgcaatcgttggccttgagcccacacgctatctgttcccgcaaattgaggatcgcctccgtacacttggcatcagggttctctccctgaacaaccaaaacaaggatcaattccatcaagcaggatatgtaacgatttcaagtattcggcgagccaaaggtaatgaagcatacaaagtctatgccctcaatcttcacatggcgggagctttacaagccaaaagcccggaaaaagagatgattgctcgaaaccaggtatttgttgcgctgactcgtacgaaattatggtgtgttgctgtcgggagacctggatctatcatgaaagaattactggatacctcaaagaacaatggctttcttcgcttccctgccttcaatcaggccagcctgaaaagatcaatgagtgatacggatgctttgcaagaaaacttatgtagccaaacaactgtaagcgcctaacgacactatctgttattttttctatactaaataatttaatgaactctggcattaacggcaatagttcatcggtacgatctgggccagacaaagaatttaatgagccaaaccgccatggagccaatactgcagcggatacactgtgcttatctacttttttacaaaactacagcatcacccaggatgatgcgagcgcctctaccaaatcaactcaaatcccatggctccccaatctgaactgacattgcgcggtattgttattggcatttttattacactgatatttactgctgccaatatttattttgggctaaaggcgggactcacgtttgccacgtcgattccggcggcagtaatttcgatggcggtgctgcgcaagttccagcatgtaaccatccaggaaaacaacattgtacagacggtagcatcagcggcgggcacgctgtcggcgattgtttttgtattaccaggcctgatcatgatcggctggtggcaggattttccgttttggatgacattcggcatttgcctgaccggcggcgtgctgggcgtgatgtacaccattccgctgcggcgggcactggtgactaattcagacttaccgtaccctgaaggtatggcttgtgccgaggtgttgaaggtcggtaccgagaccggacgttccggcaatgatgaagggaatcactcaatcggccgtatcgggttgcgagtagtgattgttggaagcatcagctcagcagtttttgctgtgattgtagcaaccaggttatttgctgcttccgtttcgtactacttcaacgtgagtacgcgcagtgtgacgggatttgacttcagcttgtcgctggcactatttgccgtgggacatctggtaggcttgtgggtcgggctggccatgctggtaggtgcgttggtgggatggggatgggcagttccacattacagcaccttgcttgatgtagcaaatggttcggctgcacagttggcgcaagccgtgtggtcagaaaaagtacgctttctgggcgcaggcaccatcggcgtagctgcggtatgggcactggtcaaactggtgcggccagtcatcagcggtttacagaatgcctggcgttcaacccgtatgcgcaaggccaggcatggcgatgcgttgccacgtactgaattcgatattccaatctccatcgtggctctagtcattgccatcaccatagtacccatcatctggctgctcatggatttcgtccgcaccagcggactgcatgcgcatgtgatgccgctggtggcaggcactacactttttattttactgatcacgattttggtcgcagccgtatgcggttacatggctggcttgattggctccagcaacagcccgctatcggggatagggattttggtcatcatcgtggtttcactgctgctgatgctcggcttcggacacttgtaccccggtgacgaggcacaggcgctagtagcgtatgcactatttgccacctccattattttcgccggagccactattgccaatgacaacctgcaagatctcaagactggacaactggtggatgccacaccgtggaagcaacaggtagcgctggtgattggcgttgtcgcaggcgcaattatcatccctccggtattggatttactacgcgaggcctacagttttgtcggtgcaccaggtgctgagccgacacgtgcgctacctgcaccacaagcgggtttgatttcgacattggcacaaggcgtgatcgagaacagcgtcgcctggaatctgcttggcataggtgcgctgattggagttacagctgtagtcattgatgaactgctggcacgcactcaaacagctaccaggctgccgccgctgggagtgggactgggaatgtatctgccaacatcgactacgctgatagtggtgtcaggcgctttggccggcgctgtattcaatcattgcgctgaatgtaaatctgggccgcgcgctgataccatcaaacaactaggcgtgctgctggcatcggggatgatcgtaggtgaaagcctgataggcgtggtactggcagctgttattacattttccggtagggatgcaccattaacattggtagatgacgaatttgccaagacttcgctgtggctaggcgggatcgcgtttatgctgctgttagccgcgctgtactactggattatgcgaatggaatcacaagcgacaaatcaaaacgaacacagcattacatcgtcagttaatgtgcaggagtagagcctgggtatctcatggagccattaaatcgagtcggccacctggctggatttttgaagatgaatgcctttcaaacggataattcctgtgacacatatttattttgagatcgtaatgggaattcccaatgatttggtgtcggtaatcgtcagccggaacaacacataaagtaattggaaggcatttcgattccagtgagtctcttcgccggtcgtatccaccgtgtaatactttccgtgtgaataagcaaacatatcaatattgccaggctgtttatcagcaacaatcatgcccatggtttgtgcgggattctcattaccggcaagggggtgtgcgtgagtctttttctacataatattccgcttcttctcccagtgcatggctcaggaagttaagtatgctatgaaaactcctgagcctgaacgcgccctggattggccattctccccccggataacccgggcgaatatcaaaagcgatatcattctcaacccatggattgatcagatcatccagctccgcacgctcttcacaacagagaatattaggatcgtagttagtgatgagaatcggacctggcagttgtttgctcagtgtgtaaatatttttttccgagtcataatccacggcaaaatctttttcaatagcctgaaataatccttctgctgaaatgccactatcagcaactttccagctacgctcaaatatcaaaggctcggcgtagagctgattttgatcctgaattgcggagagatggagaacgatacggcaaacatttcgtagccggtacgatccgatggattattacgatagacggcttggtgctgatatatatgctgccggaaacgctgcggtcattctttcatggtttccatataatgtgcatgcaggcgcctcagcagaaccagcaaaaccgcgctgaccggcagcgccagcagaattccgataaaaccaaataactggccaaacgccattaatgaaaagattactgctaccgggtgtaaaccaatccgctctcccaccagccggggagtaatcagcataccttccagcagttgccctgatccaatcacagcccagattattattacactgctccattcctgaaattgtgtcagagcagcgagagtcgccaatgtcaggccagttattgttcccagatagggcacaaataccagcacaccggatagcaacccgatcggcaaggcgaattccagcccaaccagccatagccctgtcacgtaatagatactcatgatggtgattaccgctatttctccacgcataaattcagccagcacatcgtctgtttctctggacagagcaaagatttgtttttgccaagccggcggaattaactcccccacttgtttaatcagaatattccagtctcgcagcatgtagaacagcaccactggcactaataccagatttattaaaaatcccagtatcgccagcccaccacttttcaaggttggcagtgccctggcagccactccacctgcactttgccagtgttctgtcagcagctgcttgagcatctcaacatcgatctgcaattcaatatcaaaatttccttccacccagggaatgagacgattactaagcagatcaagaaaagaagggatgcgctcaatcaggcgcgagatctctttttcaaacaatggcaacataatcaaaatcatggtgataaaaataccgattgccatcagcatgacaaaaacggtactcagcgtcctgggaactcttctgacttcaagccaggtaaccagtggattacaaatataggcaatgactgctgccaataagaaaggtgtgagaatggggctaagtagataaatcagggcgctgacaatgccaatgagcgccagataccagaggaaacgggaatccggggaatatttgttgtccatttacggtaaattatgcctcaatacggtaaaatcatgccttaaaaactccactctagccttaacactgcgagaactcaacttgactgtatccaattccacagatcctgataaaaaccagatttcctaccgcgcatccggtgttgatatcgatgcgggaaaccgcctggtggagataatcaaaccttttgcacagcgcaccctgcgcccggaagcgctgggagggatcggtggatttggcgcattgttcgaagtccctggaaaatatcgacaaccggtactggtatccggaacggatggagtcggcaccaaactcaagctggcattccagtatgcacgacatgcaactattggcattgatctggttgccatgagtgtgaacgatattctggtacaaggtgctgaaccactattctttctggattattttgcctgtggcaaactggatgtagaaactgctgcacaggtgattcaaggcattgcgcacggctgtgagcaagccggctgtgcgctgattggaggggaaacagcagagatgcctggcatgtacccggaaggcgaatatgatttggctggttttgctgtaggtgtagtggaaaaagatcagatcatcgatggttccagcatccgagaaaatgatcttgtgctggggatcgcctcaagcggcccgcattccaatggattttcactgatccgcaaaatacttgatcgtcatgcggggcaacctgatactgggcttgatgaaacctggctcgtagatgcgctcctggcaccgactcgaatttatgtgaaatcaatactggcattgctggcagaattgcccgtcaaaggattagcgcatattaccggcggtgggctgcttgaaaatattccacgtatcttaccagatagcgtcatggcccatatcgaccagagtgcctgggtgcgccctcccctgtttgactggctgcaacaacatggcaatgtcacggacgaggaaatgctgcatgtttttaattgtggaattggcatgattgtaatcgtagcaccggagcatgctttgactgccactaatatcctgcgcagcggtggtgaaaccgtgtggcaaatcggtgatatcaaatcgcgtaaacctggaacgccatctatcgtcattacctgaaggaaaggatcatgaaatcaatggtgatccttatttccggtcgcggtagcaatatgcaagcgttactgaaggccgggctaccagttgcagcagtaatcagcaataatccgacagcagaaggattggcgtttgcccgcgaacacggtattccagcccatgcgattgatcatcacgctttccctgatcggaaaacttttgacaatgccctggcggaaatcattgattcataccagcctcacctggttgcgctcgccggcttcatgcgtatcctgtcagaaacatttgttgaccattaccagggccggctgattaatattcacccctctctgttgccagcattccccggactggatacccatacacgagctctgcaggaaggagtcaaaattcatgggtgcacagttcatttcgtcacctcgcaactggatcatggccctatcattatccaagccgccataccggtactagctgatgatacgccggtaacactggcggcgagagtgctgacgcaggaacaccgcatttatccgcaagcagcaaactggtttctgcagggacaattgaccttgatagaaaatcatgttgaaactggaatagcctgtgatagtcagaaagttctatattctcccgggatcacgtcatgaaatttttatttcccataatcctgttctggataagcagtatcacttgcgctgctgatttgcctgaacgtattgatatcgactatgtactcaacggtcttattggtcagggcaaagcacatgaaactctgcttatacaaaaccagaacggagctcagcattacacccttggcagcgaaatttcagccagcgggtttcttaaactgatcaaacgtggcagcattcttcgccacagtgagggcatgattattccgggcgaaggaatgaagcctctacacttttcagaccaacgtggcggaaaacctgcacgcacggttgaatttgactggggcaaggagcgcatcatttatcgccgtaaaggccgtgagatgatagagaatctgccaaaaggaacactggatgaattaagtcttgcttatcacttcattttcaccgcccatcccaaacagacgctgaccatatacgaaaccgattaccgcgttctgcgcccggttcactatgctgttacccatgaaacactggatacaccaatgggaaaactggccacgatcgtacttacgaaacaacaagagccaggtgatgcgttccgcaagaaaatctggctggcaacggatcatcatatgctgccagtacgtattatttcgacagaaaaaagcgggatggaagtagaccagctagttactaaaatagactacaagtcttcagcaagttccacacaatgacccatttaaactgcttatgcgcctgacccccgaacgactgaatctgctgattatcgccgtacgaaaggtgttacctctacaagctccggcagatgtgctactgcgacagtttttccgggattatccacagctgggacaaaatggccggagcatgattgcagaaaccgtctttggaatcctgagacatcgatttttcctggaagtactgaccggaaaagcaactgctcgtgaactggtattagcctatctggccagattccaaggtatgaatctacgggaattaaccccactcatccgggaggtggaatccaaatggatccaacaaatcaaagcggtaaaactggaggaacaaccactgttcatacgggcagagttcccggaatggctggtgggaaaattgcagcaatcctggtcggatgaagatattttgcgtcttggccaagttttgcaacaacccgctccattggatatacgtgtcaacagcctacttgcaaaacgtgaagaagtaattgctgtactaaaacaggaaggaattgaagctcagcccacgcccttttctcccgttggtatccgcctcactggcaatccagcaatcaaccggaacgcattgttcctttccggaaaaattgaagtgcaggatgaaggcagccagattctcagttttctgctggcacccaagcgaggcgagatggtagtagacttttgtgctggcgcgggaggtaaaacattgctgctcggcgcattgatgcattctcgcgggcgcctgtatgcttttgatatttctgaaaagcggctcaacaacctcaaaccccggctcaaacgctctggattatcgaacgttcacccgcaacacattgatagcgaaaaagatatcaagctgaaacgattagcgggaaaaattgaccgggtattagtcgatgccccctgcagcggactgggcactttacgccgtaatcctgacttaaagtggcgacaaagtccggaaagtatcaatgagctgcagaaaaaacaaatggccattcttacggccgccgcaaaattgctaaaatcgggagggcgtctagtttatgcaacctgcagtctgttgccagaagagaatcagcaggtaattgaacgctttttagcagatcatccacaattttccatacttaattgtggagagctgcttacacaacaaaaaatcaacttgcctgatacaggtgaatttttacagctctcaccgctataccacaatactgacggcttctttgctgctgttctggaacactccagaatggagtccgaaaattaaaaaggggccttagagacaaggccccttcagaatgcaagcagctaacttgagttactgcttgcagaaattaattattattgttatttcagatcgtcaataccggcaccaaaattgatatggaatgccgctccgtcgattacaagcgctggaactgattttactccagctgcttcagcttcaccgatacgtgatttatccgtacccaagtgtacattttcaactgtatattttgaaggatcaatagcattggcgacagcctgttcagcagacacacagacaggacaaccggcatgatagaaaatagcttttgatgccatgtgtttctccttaactaagattcattaaaacgacattctcaaaacggaatatcctggtccctgttcgaaaccatacggcatttagaactgcttacaggcattccaattttttattttaacacataaaatcaatgaaatgtattcgcatggcttactgatgcaaatgtatcaatatggtggcggtgatggcggataacccgacggcggtggaggaatatatctgcccggagcagcaggtggataggaataagttccctggtttacattcccgcccgatccttcaatcagcccggcagaaaccggaacacgatgaccattggcatacatgcactggatataggcaatatcataacgctcctgactaatagaaccagacgactgcgcagtaccactgcctaccagtccgcctcccagcagacctgctcccgcaccaacagcagcaccacgcccaccaccaaacgccgctcccgcagcagctcctagcgccgcaccaacagcagcgctttccatgccgctggatgccgctgaactcctgggtgtctggaaatcggtttgctggctggcaaactgtcgacacaaataatcatcactgcgaaactgatcaaaacttttaccattacccggtaatatcatgacacttggtccggttggtacattcacacaggccacaagaaggatcgcaactggaaaaacaattaatctggagaagtaacgcattgtatgctcctgtattattgggcaggtctgggaggaacttttatccatccacccgggcagcgttccacttccggataatagccggcggggttctcgcaataataccagtaattcgtcacggctgattcagggggtggcggggggggtggcggggggggtgccggctggacaggctgttgctgctggatataaataggtggatcaggcggcacaatcacaaccggaggatatacgacgggaggataagcgggccagtaaaagcggttgtccaggtaaccgtagggacggtagtaaggttgccggtaatagggataataatgccgcccgtagacaaagtccccataaatcccgatattccggccaggatagctaaaatggccataagacccgaatgaaccagccaagccgacacccagagaaaaattaggccgactcgaataatgacgatgtccatgagaatatctactatggttatgaccatggctataactccatgaaacgtcactcattgttattccggttaaaatcagagacagataaagccaatcgacctttttcactcattgctcctcatatatccgtgatacagttattttgaggtgtacagctcttatattgcccattaggctgcatcctttaataaaggtttcaagtatacgccgctctggaaaagcacatgataggcaggcatttttacgaaaacagaaaaggcccgcactattttaattggaaactgcggtgtacgttttttgaatcaagagtttaatgtctgaccggggagatttttgatgtctggattattcagcgcgctttcaagagcctcaattaacctttttaatccacgcatgttatggctgtggagttggcccatattggtatcggctattttctggtggctgatcgggatgtttttctggacgccactatcaggctggctgctgactgtcatcccggtagatacgctccagaactggctggaaacttcacatctgcaggtgatcgctgacggggtggagactgtgatcaacctgatcattttcatgatattaacgatcacaaccagcctggtgattaccgcattgtttaccatgccagctctggtcagttttgtagcaaaacgctactaccctgatctggctccgatgcggggtggaacaatcaccggcagcctgcgcaatgtcctattggccatcgcgatttttatcgtaatctggatagcaaccatccctttatggtttaccggaattggcctgctggggcctctgctggcggcagcttatttgaatcagcggctgtttttctatgatgcgctgtgtgaccatgcagacaactccgagctaaacaagctatcaaccatgaatcgaccggcacgctggagtctgggttttctgacagggttgctacaattcataccatttttaaatttttttgcacccactctgaccgcactggctttcatacacttcgagctagcacgcctggcacaattgcgtcgcacaacgaattgattaccacataaaccaggtttttcaccctttccacagaatcaagtttttcctgtccgggtcgataccggaagatatcacaccaggaagaatctgaaatgtcatatggaaaattaaaacttttaatcatcggccattccaaagctgatgtaaatcagctaagtaccgattttagtcgtaacggaaaacagctgatttaccaacatgcaaacagtttacccgacgtccgggcggcattggatacatcaagctgggatgcagtcattgcagaatattcaatggctggatttgatgccttgcaagtgctggatctgcttaaaacccgccaccaaacgacaccctttattctgtacacctcgataacagatgagcaagtaatactctcggcattacgcaacggggcaagtgactgtgtaccaaaaggacattcgacgcggctgatactggctatcaatcgaggttttgagctcatggatctgaaacgcaggaaacgtcaggccgatagccatatttaccgtatgacctattatgatgaactgaccggcctgcccaaacacaatctgttttgtgaaaaagcagctgcactgctgtcaaacaacgctgtgattgatggcatgatcgctgctatttatttcatcgatatcaaccgtttgtcacgcatcaacagtaaatatggctacagcatcaatgatcagctaatacaacaattcgccagccgtttatccatctactccgacaacagctgtattctggcacgcaccgaaggaggtaattttgtttttctcaaaaccagcctggccaacaccagccaagcacagatattcgcaaaccagttgctaaagctcgccaccacaccttttatcattaatgatcttgaattttatatcaccctgacgataggaatctgcctctatcctcgcgatggcagggaaattgaggtgctgctggccaatgccgaaaatgcatcatcttttacccgaaaaatctggcctaatacctatagattctatgcccgggaaattggtgaagcttcgttacaaaaggtcaagattgagcaatcattgcagaaaatcattaatgacaaagaactcgttctacattatcaaccggtgattgatctcatgaccggaaaaattatcggagtcgaagcactggtccgctggcgtcatccggaactcggactcattcctccagataaatttgttcctctggctattgaatccggctccattgtcaaaataggcaaatgggtattacatgaagcttgcagacaagccaaatcttggcaagatgccggccttgaacccgctttcattgcagtcaacctttctgccatagaactggatcagctccagttaattaatcacgttgctgaagcattacatgcgacggggcttgacccttcaaaactggagctagaaattaatgaatctgtattaatgcaggatatagatggaagcaccagaatcttgaacgaactaaagaaaatgggtgtaaaaatcgtgatggataattttggcaccggctactcatctctcaaccatctgcggcgcctgcccatcgataccatcaagatcggtcaaccactcgttcaggatatcgccagcaaatctgacagctccgtaatcattacagccattattgcgcttgcccggaatctcggcatgcaaatacgagcagaaggtgttcaatcacaaacacaactcgattttctgaaacaagccaactgccatcacgttcagggattcttattcactcccccactttcagcagagcattttttaccacttatcgagcaacgcaaaactggtactttttcataactttgcacagtatggcggtcaccgccacatgcatgaagatgatacgaaccacctctgctttacctgtcccgttttcagaataaacctgacaagtggaaattgctttattatttctgctgttcggaatggtgctgtgaaacgggtaaattccaccagcaaatctcgaattatccaatctaccaagctgtaaatactactttttagaggtaataatgaatgtaaaaaaactattgggcatcgttctttcaggatgtctatttttatcgataaatgcccaggctgccggggaacacatgacaccacactacgtaaatgttgcagatgtaacaacactggaaaaaatagataccaaggttggtactggagaagaagccgatattggcaaaaccgccaatgtgcactatacaggctggttgtatgatcccactgcggaagaccataaaggcataaaatttgacagttctcacgatcgtggcactcccttttcattcctgcttggtgctggacgggttatcaaaggatgggatcagggagtactgggtatgaaagttggtggaaaacgtaccttgattatcccctccgccatggcatacggtacccatggcgccggaggtgttatccctcccgattcagcactgatatttgatgtggaattgatcggcctggagtaaccaggggctgggcccggcgggaaaacagacaaataccacctgtcgggttatttatcgccagcttcctttgtttacctccctccagggagggattcctttatgcacttcatcaacttatggtaacaagctaaccggcgtgaattaagaataccttcctgcgccgcttgcaataatctgcaacccggctctgaaacatgccggcaattccggaatttgcactgtttcagaaaaggacgaaattcgacaaacccccatgccagtgattcttcatccagttgttgcagaccgaattcctgaaaaccaggggaatcaatgatgctactgttcgtatcaagatgaaaaagacgaacatgggtagtcgtgtgtcgtccgctatccagtgcatcggaaatttctgcggttgcctgctgcgccactggaataagtgcgttaagcagcgtggatttgcccacaccagattgccccgccaatagactgatctgtccgcccaggaacggaacaagtagctgagcgttggcttccgcactgatctccagtacgggataccccagctcccggtaaaacaccaagctttgtgcaacaacctgcctttgcacatccttgccaattaggtcgatcttgttcaatataatgagcgacttgattccctggttttcggcaacaatcagacaacgatcaagcaattcaaaattacaagttggaacaaccgccagcacaaaaatcaactgcgtgacattggccgcgatcagtttttcacgaaagagctcgctacgataaaagaggcttgaacgagacaggatagtttcgataataccctggccgtccgttgtcggaagcatttcaacccaatcaccacataccactccttttttcttaccacgtacaacacaggaataaatagtatgtgcagtttcgacttcaaaatgacggccataggccgctactaccctgccgagcaatggcgatccggctttatttacgccaatatctctggctctcaagatatgagcaacatatcgactttcgccgcacagataaagtcattttccgataatccgccaatggcgtgcgtcgtatactctacacggcactggttataaccaaccatcatatccggatgatgatcttcctgatgtgatacccaggcaaccgcattgacaaaagccatcgtctggtaataattcttgaaagaaaaagtcctgctgattctgttatctgccagttgccagccctgctccaactgcttcaacaaattttcagcttcttctttcctcaatggaggaactcctccctcgcacggcttacatttccggtcagccaagtcacagatattagtcatgctgcagctcctgttgtgattattttcttgagatgcgcaacccgaattgctgctggcgggtgcgaatcataaaaagcagaatgtagcggatcaggtgtcagcgtcgcagcgttatcctgatacatcttgaccagcgcctggatcatatctgccgccgatgattgctgagctgcatattcatctgcctcaaattcatgtttgcgtgaatagatactggataatggttgcagcaaaaaggtaaataccggcatcaccagaaagaacagcaatagtgccatggcggttgatggcacatcagccacctgaacacccagtccattatagaaccacggttgctgcattagataacccaacacccatagaaacaacagactgactacaaacgacagcgcaatccgcttgatgacatgatgccgtttgaaatggcccagctcatgtgccagcaccgcttcgatttccgcagcttccaaacggttcagcaacgtatcaaagaacacaatccgcttcgttttaccaaacccggtaaaataggcattgccatgactgctgcgacgagagccatccataacgaacaacccactggattcaaaaccacacttccgcaacagattttcaatacgagccttgagtaaatcattttccaacggtgaaaacttgttgaacagcggggcaatccagttaggataaaccgccagtagaaacaggttaaaacctatccaggtcaaccaagtatataaccaccagttatctcctgttttttccatcaaccacaggacactcaacaacaatggcgcacccaacaatgccaccactacggtctgcttgacgagatcagtaaaaaacatggctcgcgtcatcttgttgaatccgtattgctgttcaatgacgaatgtacggtaataattaaaagggattgcaactatactcagcagagctaatacactaaaaatgagtaccatcccatgccatagcggatcactgaaccaggaataccagaagtccgacagcaattccaatccaccacccagtgtcaacactagcaacaaacctgtgttgagcagtatgcctggataactcaggcgtacttttgcacaggtataatcagctgctttctggtgagcagataattcaatttgtgaagcgaaagcagctggaacctggtcgcggtttgctgttatatggcgtatgtgccgggtagccagccacaactgcaccagcgtagtcaatgtcagcgcaagaataaaaacaatggtgaaaatatgcataaaaccacctggaaattaagtatctgaacaggacatgctaggattttactctttatgcaccccaaaacagggaagcagaccgatcacgacgagtatacttggatgtgacacaatcctatcttgaaaattcacgtaacaaacattcagaattatggcacaagacagtaacaaccttatctggatagacatggaaatgaccggtctgaatccgaatactgactacattatcgaaatcgccctggtcgtcacagatgcgcaactcaacacagtagctgaagcaccggtactggtcgtttcacaaccagacagtgtccttaacgggatggataaatggaaccagtccacacacggcaaatctggcttgatcgataaggtcaaggcttcaacattgagtgaagccgaagcagaagctcgcatgctggcattcttggcgccatacgtcccggccgatatctcgcctatgtgcggaaattcaatctgccaggatcgacgtttcctagccagatgcatgccgcaactggaagcttattttcattaccgcaatctggatgtcagtacacttaaggaattggccaaacgctggaaacctgaagttgcccagggattcaacaagcaaggtaaacatgaagcactggctgatatttacgactcaatagaagaactcaaacactatcgtcagcacctgtttaatatctgaatgtccgtgattcatctctactacaggagctcaatgaatgactcaacgcactgcatttacacttaccatcagccccaaaataccggcacgcttggatcggatggaggaactagcaaataatctctggtacagctgggatcgagccacacgcgctctgttttcgaggcttgatccacagctatggggaattgtagggcacagccccaaagcgtttctcagacgggtgaatgaatccgcactactccaggcggcagaagatctgacattcctcggccattacaatagtgttctgtctgcttacgattcctatcattcggagccttctcgccaccagaccattaaggggctgaatgtgcgtgatcaggttgcgtatttctgttttgagtttggttttcatgaaagcctgccggtttattctggtggtcttggcattcttgctggcgatcactgcaaagctgccagcgatctgtgtctcccttttgttgcagttggactgctttatcggcagggctacttcttccagactattgatggccacggtaatcagcagcctgtttactgcgactcggatttcgaggatctgccggtaaaacccgtactacatgatgatggctcggaagttagaatatctgtgcaattccccggacgaatcgttaccgtcaaagtatggcgagcacaaatcggacatgtcagtttgtatctgctcgataccgatctttcggataattccgaacatgatcgtctgatcacacaccagctttacggtggaaacaacaccatgcgcatcgagcaggaaatcattctcggcgtgggcggagtagccgcactcagggaaatggatatcaaacccacaatctggcacagtaatgaaggccatgccgccttcatgatgttggcacgcgctcttgagctggtacgacaagggctggattttgccagcgcaacagaggcggtagcagtcaatacgatctttaccacccatacggccgttccggcgggtcacgatcatttcccggaagacatgatgcaccattattttcaggatatttatcacgaactgaaaatttcccgggaagaattcatggcgcttggtcacacttcaaataatcatgacttcaacatgaccgcgctggccattcgcatgtcgcgcatgcataacggcgtcagcagaatccaccgagatgtctccgccaatatttgtcgggatttgtggccacagatcgagccagaagaaaatccaattgactatgttaccaatggcgtccatgtaccgacatttctggcacaggaatgggtggatctatttgaccgccgcctgggtccgcaatggcgcaacaaacaacaggaccccgaattctggtcaggcattcataacattccggaccatatattctggagtgtacggcagagtctgaaatcacaaatgttttacggtatccgcgcgcgcctgaccgagcagaatttacgtaatcatggctctgaagcccatcttgatcgcctgctcagatttgctgatccgatcaacccgaatatattgacactgggctttgcgcgccgtttcgctacctacaagcgcgccaaactactgtttcgagatcttgactggctgcgtaaactactgcttgaccccgaacgcccggtattactgatttttgccggtaaggcccatccagccgatctgcctggccaggaattgattcgacacatctatcatatcgcagatatgccagaattcagagggcatatcctgctggtggaagggtatgatttgcgcctcgcccggcgactggtatcaggcgttgatgtctggctcaacaaccctatctatccactggaagccagtggtacatcaggcatgaaagcaggaatcaatggcacactcaatctgagtatactggatggctggtggggagaaggctatgacggcaaaaacgggtggggaatcaaacctgtttcggagaatctggaagcttcattacgcgatgccgaagaaggtcgggctttctacgaaatcctgcaagatcaggtcattccactctattacgatcacggcaagtttggttactcggtcgaatgggtaaacatggccaaacattcaatgacctctctgttaccacaatacggaaccaggcgaatggttggagaatatatccagaagttttacacactcgccagtcggcaaggggcgggctacagtcaggataattttgcaatcgccaaagatattgccgcctggaaagcgcgaataaatgcagcatggaacggcgtaagtgtgcgacgactcgacatacccagcaagcagctcgaatttggtaacgccttgcattttaaactcgctgtgaagttaaacggcctgcaaccagaagatgtcgtcgtggagttgctgctctcgcggcaatacaacaaagtcaagctcaatcagttccagaattttcggctggaatgcaccggcatcatcgagccgaacgagcatcagttcgaactgaaccatataccggaattgtgcggcagacagcaatattatctacgtgtctacccctatcacccgctgctgactcacccactggaaatgggcaagatggtatggctgtgatagccagtccattattattcttgttatgacaataccaacggaaaattgtcaatcagccgaatttgatccagccacgccgcgcccaatatgaccaaaccagaatcgcacgctgttgccggtaacagcgtgcgattctgtcgtaccgaaatatagtcaactttccagccgtgcatattcagcctttcgatggcagaccattctaactgtgggaaatttcgttcacccgaagcaatactttctccaattttcttcagattacaagccagctcgctcgctttctgccgctggatgttatcaaggtaattattacgtgaactgagcgccagaccgtcttctgcccgtatcgtctggccagcaataatttctacgggcagattcagttgagcaaccatcctgcagataatctgcagttgctggtagtctttttcaccgaatatcgcaacctgtggctgcacgatattgaacagcttcaatacaaccgttgtcaccccacggaaaaatccagggcgacaagcaccttccagcgtatctgccacaggtggaagcagtaactgaaattcctgtgggataggaaaaagtgttttttcacctggaataaatacgatatccacaccatattcttccagcaagcgacaatcgttctcctgggtacgtggatagcggtcataatcttcatgcggagcaaattgcaaacgattgacgaagatactgacgacggtacaagcagcatgctgctgagcgatccgcaccagagataaatggcccgcatgcagattacccatagttggcaccagggctattgaagcttcatcttgaagccgcacacgcaacgatgcgatatcagtgattatttccacgtgaataattcgtatcgtacctgtcagaacatatgttcatgcgcaggaaattctccggttttgactgctttcacataattcctgactgccacctgaatactatctgcgcctgccatgaaatttttgacaaaacgcggcaaagtaccactgctgatgcctaacatatcgtgcaacaccaagacctgtcccgaacatactgcaccagcaccaatgccgatagtcgggatggatagtgaccgggtaatttcctctcccagtgcagccgggatcaactccatcacgagcatggccgcccctgccttttgcaatagcagtgcatcctccagcaattgtctggcaccatcaggtgttttcccttgaattttgtagccgcctaactggtggacagactgaggtattaacccgatatgggcacataccggaatgccacgacaggtcaaaaattctatggtttctgccatatgccttcccccttcaaccttaaccatctgcgcaccggcagccattaaccgaactgcattcctgaatgcttcctgtggagacacctggaacgtgccaaacggcatgtcagccaggataaatacgctgtgagtaccgcgctctacacagcaaacgtggtagatcatttcatccagtgtaaccggcaaagtactggcctgaccttgtatcacgtttccaagcgaatcccccaccagcagaatatcaactcctgcgttttccagtaccgcagcaaacgttgcgtcataacaggtcagggccgctattttccccttctcccggtaaatattctgcagtgtcaaaaccgttatacgttttgtaaccggccgatccatctgttaactggctccaacattaaagtattcacgcgcactgcgcatctggtcaatgcgcgtcagtaacagatcaaaatcggcaatactgttcgccagatcaatatgttcgctattcacgatcatgaccggcgcccgatcgtactcatgaaaaaattgcatatagcgctctgccaggcgtcgcagataatcctccgatatgttctgttccagcgtattgccacgttgccggatgcgtttaatgaggacttcgggtgaaacctgcagataaatcaccagatcaggcgccggtgcatcgaggggcatctgttcgcagatctgccggtataacccgtgctcgggttcactcaacgcaacggctgcaaacaactgacctttttcaaataaaaaatcactcacgacagattgtgagaaaccattttcctgcctcatcaattgcagttgatgcctgcgctggagcaaaaaaaacaactgggttgacaaggcatatctgggcgtatcttcatagaatttctctagaaacggattagcctccggctgctccaacataagtgaacagttcaaacgggttgccatattacgggcaaggctggtcttacccgcaccgacaggtccttcaacaacaatatagcggcagcgctcaagattcatgatgatgcaatatactccaatggttgtttcatacacgcagccagacaagcggcagctgggcctcttcccggaatcacgcaatctgctgcgatttccagcaagggttgcagtacaaaagcgcgctcatgcatacgtggatgtggcaacaccagttttgtatcactgtgttgcaggtttccaaataacagaatatccagatcaaggatgcgtggggcgttgggaaaagtacgcacacgaccgcaagcacgctcgatttccagtagagtatcgagcaggtgatgcggtgtcagatttgtttccatctgtactaccgcattgatgaaatcgggctgatcggtattgccaatcggagcagtgcggtaaaacgaagaacgttttaccaaacgtgaatgttccagctcggctaacagcagtattccacgcctgacctgagacaaaggattttccaggttgctgcctaatgcaataaaaatacggctgatagattcaggatgaaaatcagatgtcatgaaatatcctgattaacgggagagtctacttttacactttccgattgactgctacggcgacgttttctgcgacgttttgtcggggcttcctgcagcaacattgcttcccgggcagcattatcggtatttttgaatgtttgccaccattgccccagctcttcgtcgatttctccgcttttacaccgcaacagcataaaatcataggcggcagggaaatgtggatgctccagcaggcgaaatggcttacgacctgcgcgcgccagaaaccttggctgcaaggaccagatatcataaataacgccatcatgcctgcgcggaatggccaatcggcggcgctgagccgccagaacatcgcccatcgctctatgtaataatgcgggaatatttttttcacccgccttcagatgaatattccataccgccaacacttcatgccacaacaatgctgcaaataagaatccgggagaaaccggtttaccctgccgcacccgctcatccgtattttttagtgccagagaaataaatcgttcacccagaggctgctccagaattacatccagcatcggcagtaacccatgatgcaaccctcgcgttcgcagatcaatcacagctgtcagtgcatgaccggaaaacaatagcttcaacatctcgtcaaacaggcgtgccgctggaacattcagtaacaatggcgcaagatcaccaataggtgcagctgtcctgtcatcgatctgaatgcccagcttggcagcaagacgcactgcccgcaacatccgtaccggatcttcccggtaacgctgctctgggtctccgatgatgctcaaccgctttgccatgacatcttcgaaaccgcttagatagtcaatgatctcttctgtagcaggattatagaacaaggcattgatagtgaaatcacgacgtcttacatcctcttcctggctgccaaaaaagttatcgtgcaacaaccgtccggtggcatcgatataggcacactctttatcagactgaatcagatcatcagccgccttaccgcgaaaagtggatacttccactgtttctcccttgctcatgacgtgcaccagccggaaacgccgaccaataatgcgtgaatgacggaagattgcgcgcacttcttcaggcgtggcatcagtgacaatatcataatccttgggcttcagccctaacagcagatcacggacggcaccgcccacaatataggcagaataacctgcctgctgtaaagtcagagcaactttcagcgaaccggcactaatgctgctgcgcgaaattccatgccgctcacatgcaatggcccggaatgccggggcagctgtaacagaaactgtagagccgaaggaaaaaatatgatgcagaaatttacggatcatgcctggatgcaatacctgtgaacgacaaattatacacctggtaacaaattagactttgatgaaacactggcccacaaaagaaaatggcaatcgggcattggttataccgtacccgagtaatgcgacaagatcaccttaaggcagccaagagatcttagatgtttagtcccgacggtatcccagcaatccccacacaatccggatgaagtaatagcatatccagttcagcgaacgtttaattcgtgaccggtctctccaggaacgctgtaacaccggacaagagacttccaatgtccgttgcagactgccctgtaatcccgctgcaaatatccgatccaagacaatgacattggcctcacgtgccagcaataaactgaacggatcaatattggaagaaccaacagtagaccaggaaccgtcaataactgccactttggcgtgcagatacccttgtcggtactcgtagatacggataccggcatccagcaggtggcgatacagggaatgcatggcgtaatattgcaagcgatattccgatttcccctgtagcagaaggataaccgagacgccacgctgtgcggccttgatcagcgcctgccgaaaattcttcccgggaagaaaataggcattggcaataataatttccttgcgagcaaccgctattgccctgagatagcaatgctcaatactatgccggttacgcagattatcccggataaccaacgatgcacgctgatgacctgccggcagattattgctgacaacagacaaataatttgtccagcgttttttgaaataaacccatgcaaccaacatccacagatgccttgctgtagcatgaattttttccagtaacggaccgataatttgaacagcataatcgaatcgtggaaataacgcatcagattcgtagcaatcatcgacaatattaattcctcccacaaatgccacactggcatccataaccgccagtttgcgatgcatacgacgcaagcgggagcgtttgagccggaatgaaaaaaactccggccgatatatcagtactcgcacacctgctgcaagcatctcctgaattactttcccgggcaggccgagcgagccaaacccatcaatcagtagatggacagctaccccgcgttgtgctgcccgtttaagcgcttcagcaatccggataccggttgcatcgtactgaaaaatataagtttcgagataaatttcctgcctggtcgaatcaatggccgattccagcaccgggaaatattccgtgccagaatgcagtagtgttatacggtttccttcgacaaaatcaggcaaactcatttacgcataatctgagccgataacgcagcatggtctgaaattctggaccaggggcgattatgaaaaatccgggcattttttacctgaaaaccacggatataaattctatccagacgcagcaacggcaaaacagatggaaagctgcgcgccgccttaccctgcgtatgctgaaaaacctcaaccagattcaagcgactggccaaagcctgatttgccacaccacgccagtcattaaaatctcccgcgagtacgagcggtgcatcaggcggtaccagttgccggatgcggcgctctatggcctccagctgccggtaccttccacgcttaaacagccccagatgcacacagatgcagtgcaacgcgtctttccatccgggaatggccagctcgcaatgtaacaatccgcgactttcaaatcgatgtgccgaaatatcttcattctcccagcttgatatgggaaagcggctaagaatggcattgccgtgatggccatggttataaaccgcattctttccataggcaaaatccgaccacactgcatccgccaaaaattcatactgagcatctttcggccaatcctgaaagcggccggcgtgcagcgtatgctccccgatcacctcttgcaaaaaaatgatatcgacattcaggctacgcaaatagtcacgcaattcatgcaataccacacgctgattaaaaaacgacagccctttgtggatgttataagttgcgatatgtaatgtccgattagattcacgcattgcttcgtttcctggcaaagaagcaatcctgtcagtatccgcagacaaaaccggcagtttcaccatcgatactatttcgagacctcaagcatcttttcaagcgtcagcctggccagactggcctgtggttccggcacgctaatctgattaaccacacgaccctcagccagattttcaagtgaccaggccaagtgctgtggatcgatccgcgccatagtcgaacacatacataccatcggcgacatgaactgaataattttgccttcggacttgaactcctcggcaatgcgaccaaccagattcaattccgtcccgaccagccagcgagtaccagctttcgctgcccggatggtattgatgatgtactcggtcgatccaacaaaatcagatgccttacacacctcaaagctgcattccggatgtgaaataaccaacccatccggatattggttgcgaaagcgaaggatatgctgcggctgaaacatttggtgaacggaacaatgccctttccataaaaggattttggctttttcaacctgttctggtgtcaatccgcccatgggttcatcaaaatcccatactggcatttcatccgacgatagccccatcttgtatccgctccaacgacctaggtgctgatcagggaaaaacagtactttttcacgtcggtcaaatgcccattgcagaatctttacagcgttactggaagtacaaacgataccaccatgttgtccacaaaaggcctttagatcagcactggaattgatataagttactggtgtcaccccctcatccgggtcgagcacttctgtcagttcacgccaagcacgttctaccttggtgagattagccatatctgccatagagcaacctgcggaaagatcaggcaggatgacggtttgttcagggctggaaagaatatccgctacctctgccatgaagtgcaccccgcaaaacaccagaaaatcagcatctgtctgcgcggcgagataagaaagcttaagtgagtctccggtcagatcggcatgccggtaaacatctgcacgctgatagtgatgtgccaatataatggcgcgctttcccagcttctgtttagctgcaacgatccgttgcgtacatacttcatcttgcagtaattcgtaattctcaaaatcgattgcgtttgcttgcataatcaatccagctttatttatcgtgaaatatgaccataatcacattaagatacttattcaagcaaaaagtgcaaattaaaaagctgttctgcagattctgcaatacccgccgaaaacaaagatacttggctctgaatgcgacaactattgtgaaaaagggactctgctataattcctaaaaacagcgcattaacagtgtgttgtctgtttttaactatactgtttgatcgggaatgaccggagaaacaatccatattcatcataaagtctatgcgtaatatgtcttaacatgacacgttcattattttcaagaccgtccatatggttggttattttgcttctgcttactctctggctggacagcgtcctgcagcgcccgcgcctgcagcagggcaacgatttgcagcaagagatagactacatcattgaaaatcttaacgggatacaggtcaaccatgaatttgaacgaaatcgttttttctcggctgacaaactgatccactactcaacagaagacataacgcagctggagcacgtacgctttaccagcatagaaccggataaaccactgctcagagtgacttctgattgggctgagctgactaaagatggagatgatattttcctaaccgaaaatgtttctattatcaggggagaagatctggacaaagacaaggtaaccatgctgactgattttttacaccttattccggatactgatatcgccaaaaccgatcgaccagttaccgtgatcagaatgaacagtgttctcaacgccgtagggttgttcatgaacaatcggaccggtgagattttgatgcagtcccgggtcaaagcacatgacgaacgtacaccacgctcatcccgctagaggatgccgcaccaacacggattctgattcttctggttttcttattttactttttgtatctatcggtttatgcaatctcaatgtttgttcctaagcttgtctctcatgtttttctcagccactgccctggctgaacgcgcagatcgcgataagccaattcatctggaagccgatcgcgcaactgtcgaagattacaagcaaaaaggggagtttcgtaccagcatatttaccgggaatgtcatattgacccagggaacgcttattcttcgtgcagataaagtcgtgatgaaggaggacagcacgggttaccggcacgctacagcttatggcaatctggtcagctatcgtcaaaagcgtgatggcgttgatgagtacgttgaagcatggagccgacgcgcagaatatgacaacaaaaccgacaaaatagaattgtttggaagcgcgcgactgaaacgcggcaccgatgaagtagaaggggattatatctcctacgatatagcaagcgacttttttcaggtatttggccagcctcaagcggaaaatgataaaaattctgatcacagggtacgtgccgtgattcagccaaaagcgaaacaacctgacgcagaaacagaaaaataaaactaacaaaaaatatatttaccactgtatatcgccactccgggtcatcttatgagtgaattaagagctgaaaatctgaaaaaaaaatatcagtcacgcaccgtcgtgatggatgtatctttctctgttcgcagcggcgaagttgttggtctgcttggccctaatggtgcaggcaaaaccacctgtttctacatggtggttggactggttccattgaacggaggggaaatatttctggatgaacacaatctgagccagctgccgattcatcagcgcgcccggttggggttaagctatcttccccaggaggcatcagttttccgtcggctttcggtcgaagaaaacattcttgcagtactagaattacaacactttcagaaagatgaaatgcagcggcatctggacggattgctacatgacctgcatatcggtcatctgcgtgagagcctaggcatgagtctatcgggtggtgaacgcaggcgtgtagaaattgcacgggcactggcatcccagccgcgcttcatcctgctggacgaacccttcgctggagtagatccaattgccgttatggatatccagagagtcatcggttttctcaaatcacgcggaatcggtgtacttatcacggatcataatgtgcgagaaacactggggatttgtgaccgtgcctatatcatcagcgaaggaaccgtgcttgccagtggagtccctgctgaaatcatcaatgacggacgtgtccgggaagtttatctgggggagcatttcaggctctgaaaaatatgaagccgactctgcaactcaagctttctaccggccttacactgacaccgcaactgaaacaatcaattcagctgcttcaactatctgcacttgaactcaaccaggaaatctcacgtattgtccaagaaaaccctttgcttgagctggatgaagatatcgatcaagaaaaacttgaaactgaaggacaagattcttcgttagtatcatcagatttatctactacagcagaagctaatgaatcccatgatattagagaaaacactgaaatatcgaacgactggctagatgactcattgtattcagatcagggggcttttttagacacacgtagacaagatgatgaggagtatgatcaggactattctcgcctggttagcaaacccgccagcttgcgtgaacacctgctcatgcaaatcagcttgaggcaacgttgcgaacgaaaaaagaaaattaccgcgctgctggtggatagtctggacgataatggttattttactcaggatctggaagagcttgccaagttacttccggttgagctggaaatcgacatcacggacctgaagtcagcccttgcttatattcagcaactggatccgcccggcgtaggagcacgcaatctgcgggagtgtctgtctatacagctttcagcattgccggatgcaacgccactacgaacggaagcactcaaactggtcaatgagcacctggaaagtgtcgctgccaaaaatttcccattgctcaggaaagttcttggctgtgatgaaacctgtttacagtcagtttaccagttgatcactcaactcaatcccaagcctggcgatgatttcaacgcaacaacagcacgttatgtcattcctgatgtgattgtgaccaaatcggctaaaggctgggtggcacagctcaattccgattcagttccgcgtgtgcgcgttaaccatttatatgccgacattctgaagcagaatcgtaatgaagcaatccgaccactgatggagcaactgaaagaggcccgctggctgatcagaaatatcgaccagcgcatggttaccatactccgggccagtcaggcgattattgattgccagcaagcattcctggagcatggcgaaacagctgtgcgcccccttgttatgcgtgaaattgccgaagttcttggattacatgagtcaaccatttctcgtatcacaacccagaaatatatgcggacaccgcacggtatctttgagctcaaatatttctttggaagccatattcccgctgaaacgggtgaagcacattcagccatagctattcgtggacttattaagcaattgatccagaatgaggatcgaaaaaagccacttaatgatagtcaagtttcacaaatactcgcgcagcagggtattgttgttgctcgccgtactgttgcaaaatatcgggagttcatgcatattcccccgactaatttacgtaaaataccctaggaaaattctgaaaaaatcagctgattaccatgaagcaaatcaaggtgaaaaagtacagttcacaaatagcatatgtgtactcgaaacctgatttcaggtcggtatagccagacagatactttcagagttttccatgatacccttgaacacgactctctcacataaggagaaataatgaatttgaatctcaccggtaatcacgtggcaatcacacctgccatgcgtgactacgttacgtccaaaatcgagaggagcacacgccactttgacaatatcatggctatcaatgtgaccctttccgtggataaactcaaacaaaaggctgaagccacggttcacttacccggtagagagatttttgtcgaggccgatagcaccgatatgtatgcttcaattgatagtctggcagataagctggctcgccagatccttaagcataaggaaaaaaatattagacagcgcaacgatcagggtgggctgaaagatcaggaatttgaacagcccgaataaacccgtccacttctcctcatatatttgtaaagaactgcagcagcaatgccagaaaaatctcgaaaaatgggaccgtacctaatcaacagccaactatagccatgttgcccgcgcagcggaaaagatgacctacggaacatcagcaagttgggcacatatatagtgagtgatataaaaaaacagtcccgttttcaataagaagaaaacaccgcctaatttcctaaagtggtttgaatctccatgaatctcattactcaattattgccggaatccaacattattattgatctggatgtgaccagcaagaaacgtgtatttgagcaagttggtctgttatttgaaaataccctgcatattgcgcgcagccaggtttttgacagcttgttcgcacgtgagaaactcggatcaaccgggcttggtcagggagtcgccatcccgcatggccggatcaagggactgcgcgaagcagctgcagcgctggtcagaatgaaggaagctatacctttcgacgctccagacggccaacctgtcagtattatctgcatcttgctggtgccggaaaaagcaacagatcagcacttgatgatactgagcgaactagcacaaatgtttagtaataaaagcttccgcgaaaaactgcgccatggccggagtgctaaagaaattcatcaactcatctccgagtggacgcctgaacatgtctcaggttagcgtcaaacaactatttgaagaaaacaaggaaaaattatgtctgcaatggggtgaaccgccgcctgccatagacaggcggcttgagaatcacctgatcgccagctcaacacaggaactgatcggtcatctcaactttgttcatcccaactggatacaggttctgaaccagatatccgtcaaatatcttgaacagcttgatgatttttctcttcaaaaaaggctaaatcaactagctagaagtcaactttcctgtctgatcgtagcagacggtgcgccaatcccgtattccatcagacagttcgtgaatgaacactctatcccgctgattcgttcagaaattgccagccttgagattatctggggattgcaaacctatcttgtgagagtactggcgcccgttatcagtcggcatggtgtattactggatgtacttggaatgggtgtcatgatcaccggagagagtggcgttggtaaaagtgaactcgctctggagcttatcagccgcggacacggcctggttgcagatgatgtcgtcgaattacgccgtattggccctgaaacgctggaaggcaggtgtccgccgctgttgcgagattttcttgaagtacgcggactgggattgctgaatattcgtaccatattcggagaaactgcaattcggcgacacaaaaatatgaagctgatcgtgcagcttgaaaaaactgctggcagtagtattaatgcttatgaacgactgccactgagtaacctcaacgaaattattctgaatgtcagtatccgcaaggtgactattccagttgccgccggccgtaatctggcagtattggtagaagcagcagtccggaattatattttgcaactccggggaattgacagtacccaggaatttgtccgccgacatgaatcagaaatgaatgggaataccgcagagcacttcgacgatcctcatactgaatgaagtgtaaagtaaaaatctgccatataactaccttgcttctatatgaaaactctggaaaaagaacaggctatgacaaagcaaatccagataaaatatacgattcacaagcagtaattgtgtacttcaagcctgattccggcacaacataaccgagcagccgttcttcaaaatcttcccggaaaaatatgagcgaaaagaaaacaattacgattgccttgactggcgcatccggtatgccatacggtattcgcctgctggaaatacttctgcagcaaggtcatcgagtttatttgctttactctcaagctgctcaaattgtggcgcaacaagaaatggccctgacactatctcctcgtcccaaagaaacagaagctttcctgaatagctatttcaatattgagccaggcctgctcagaatttttggtcgggaagaatggtttgcaccagttgcttccggctccaacccggctgatgccatggtaatctgcccctgtactatgggtactctatccgctgtggcagccggtttaggacaaaaactaatagaacgtgcggcagatgtcatgctgaaggaacagcgcaaacttattctggttgccagggaaacacccttctctgttatccatctagaaaacatgctgaaactcgctcgcagcggcgcagtgatacttcccgccaatcccggcttttaccatttacccgagaacattcaggatatcgttgattttatcgttgcacgtatactcgaccagcttggtgtaacacataccctgatgccccgctgggggagtggtaactaagtaagctgaaagatcttctccgaattcactaccagaaacaaaaaaccagctaatcccggacaaagctgtttcgggctgcacaatcggaaaccgtcagcggcataaggccagcatctgttctgcacaaaatagattgttcagtcacaatataatccatcggaatatcgtgttgctgcggatgaatcgttggcaggcgcagcatctcaaataccacaccaatagcgagcggacgcggattcatcgttgcgagtgtgcgatcaaaataaccgctgccataaccaagacgataaccttgttcatcaaaaccaagcagtggaatgataatactgtcaacagtgatttcccgggtattgtcggggaacgatattccgtaaatatcctttttcattggcgctcccggccaccattcgatgaacctgagtggctctcctttaccgattacctctggcaaggcaagagtggcgccacgcgctctcaaatctgtcatggctggcactgggtcatattcaccctgatgcggccaataaaaaccaatccgctgattctcaaggataggaaagccttgtgtcagtgcggcggtaattgcatcactccagagaacgcgctgtgctgctgggatctgctggcgtaattcgcgcagatgagtacgctgctgctgtttccaaggctgggaagttacgttactcatgacaagattggagtaagggttgggtcattaacaacaattttctgacaggaacggggatcgcccgttgcaaagcttcctcaattgtcatccaaagaaagtcattttcctcgctattttcttcatactctggcagatacattattgattgcaggagttgcggctgaataatcaatttaaaatgcgtaaacgtatgttgcaaatgaggaagctcagcaaattttaacacctgtagatgtaaattctttttacagtaatcaacactgtcctcattaatggaagtttccgggaaacaccacaatccaccccaaataccggaagccggccgcttctttagcaaaatacggccttgattcaggaggattaaatgtacaatttctttgataggaggcgttttcctgggcttgggaacaggcaaaacagccgtcagatcattctgatatgcatagcaatcagcctgcaacggacaatgttcgcaacgtggttgggtacgcacacagaccagcgctccaagatccattagtgcctgggtataggatgctatagttttatgatcttcttcaacaggcaacagatcttccgccaattgccacagttgttcttcaatcattctttcacctgggtgcccgttaacaccaaagtaacggatcaaaatacgcttgacgtttccgtcaagaatcgtgcaacgcttaccaaatgcaaaagcagcaatggccgctgcggtagaacggcctatccctggtaatcgttgaagtgtagcgatatcctgcggaaacgcgccaccatactgctccattatcatacgtgctgtccggtgcaaattgcgtccgcgtgagtaataacccaaaccgctccatagcgtgagcacttcttcaaccggcgcgctggcaagtggtgcaatatttggaaaaacagtcataaaacgctcgtaatatggaataaccgtactgacctgtgtttgttgcagcattatctcggatatccatatagcataaggatcactgattccctgccatggcagggaatgtcgcccgtatacaagctgccagcggatcaacctaccagcgaaaaaatctgattcaacagctgaagtccgaggccgtctggttgcctgttgaatcataaatttaacggtacatcataattatattttctggttatcatttttctccatgtattttcccaacagaagagcctgcaggataatgaagacaaacataagccccatgaagccaaacaatttgaaatttacccaggtatcagtcgaatagttgtaggcaacataaagattaagagcccccatcgcaccaaaaaaaactgaccagctgatattgagcctcacccataccggttcgggcaacttgatctgatccttcatcatagctcggatcagattttttccaaaaaaactgtgtgccaaaaagagaatgacagcaaataaccaataaagcacggtaggtttccatttaataaaagtctcatcctgcaggatgagcgttgcaccaccaaaaacgataatgattgcaagactcacccataacatattgtcaaccttacgatggcgcaaccacacccagccaatttgagcaaaagtagcgacgatggcaaccgctgtcgcgctgtagataccgtaaattttgtaggtggcgaaaaacaggattatcggaaaaagatcaaaaagaaatttcattcaaaatacccctaacgttgccaatataatcataattatgctgttcgttatatcagtgacatgtttaccttaatgcaacatcatcaaaaatagatgttatctaactgaagtctggctgatcatagataatgcatccaggttcccaagatctaacagctgatcagcaagatcaagtattgcagggcgcgccgaaagaatcagaactgtgcgattactaagtaatacgcacagcgcgcgcatcaagaaaggattatcagtatcgaaacaggcaatactttcatccagaataataataccgggatcctttaatagcgctcgggcaataagaatgcgctggcgctggtcatcggaaagcacatcgttacatttcttgagcttcgtttgcagaccatgtggcagcttacagataaattccattgcctgactagcatgtgctgctgtagtaatcgctatctccttactgcaacgtaaactgccgtaggcaatatttgctgcaattgtgtcaattaaaagatcttcatctggagtaatccaggcgatattgccacataattcagcatggcttatccgactaatatctttatcatccagcaaaattctgccggttgatggttgctcgaaaccacaaacaagatcggcaaatagtttgttaatacgagcatcatgatttattaatgcaattttctttccaggagcgatttcaaggttaaagtagggtaaccaagatttttcctgataatccttataactaacactctcaagccgcagcttacccttggcacgttcaacccggacagcaagagtattttcaacaaccatttcagaattctgatccaacaatgaaaaaataacgtgcaatgcttcattacattgctgcagtaacaaattgatatgagacaatcgcttcaacggaaaaacaagcatcagccctgccgtaaaaaatgcaacagcgtcctctacagtcaattggctcagaacaagttgttgcaaaaaataataaagaatccctgtaagtatccctatcaggaaaatggaggccaataattccagtagtcctgtctgatagatctgcctcagtaaagtaagttgtaattgcctgaacatatttcggatacgctcaacctcttgtttataacctttatccaagaagataactctgctatgtcgcagtgttttggatatcactctggaaacttcatgttgttcttgatccagcatacttcgctgataagtattcgcataaaatatttgcctgattaaaagcgctgcagccagcactgttagtatcaaaaaggatatatccggattcagccagatcattattgaaaataatccgactacaatcagggaatctctgtataaacagattccaagtgagatagcattgcgatatagcttttctatagatttgaagaagtataaggaaattgtgttagcaggaagatcggaacaagctggcggcaatatcagtaatttcttgaatatttccacacgtatatccagtatgagcccgtcaagcaagcgatgaatcacataatatcctgaccaactggcgataacgattactaacaagagtaccaccaatatcaaaggaagtgattgcagtaactgccggttacctccgggtaatatttgagtaaataattgccctgctattaatgggattaatgaagctgagatagcagccaatccaccaacaacaataatgattataaaggatgtccagtgggatccattccaggttaaaaagcgcttcaacagttcaatctgaatcactagccgcttatctggcattgcaagggggtaagatgagggaatcagtgtaacaagtaaaactacatcaaatcacgaggatactgatagtaacctaacgatacaaaacatcagaagatatttagaaaacaccaattatttaatacagtttattactataaataaaaattcgctcaactaataattgaatcaagtaagacactacagatggaaatcaggcgatgctcacagaaaaactttggctttctgattaaccttaaagactaactgcccgaaatatcaaccaagctgtcattttatgatacaggttgcttcaaattgtcgaataattcaataagatctactagaaaacatgcgtgtgttatcgcaggtttgcagagatgagattcaataaaaactgaataaagctcatgtgagtaacgattatcaaagataattcgagctgaaaatacagaaaaagcaggataatttaaattatcctgctttttcttacttttttaattctaagttagaactcagcagtacgaatgataatattcttaatcttcttcggtattgctttcactttcttcggaagaagattcgtgttcatgctcatgctcatgctcagtggcattttcatcctcagcatctccatgatggtgttcatgtgcctcttcttctttagtgtcggcagacgctccttgaactaacgatgtaaatcgagcagtatatgttttattatcctctggtactgcgaaaacagatattactgtttcgggagtaattttaaaatcgcctgttcctttcatgaaatttgcaaatataggcgtcaattttattgaaactttgtttccatctttatcaaaaatatttgcttttgctgatccgcccttagaaagtatttgatcacgattgttttgatcagtaatatacaaacgtaattcaccatccttagccagcaactcaaagtgatacggacctgttgcaagcaattgcccgccatgcgctccttttactacttttgaatcctcacctggatgtgaatgtgcccacgctgaaccagtcaacaaaacaatcaaaccagaaaaaacaacaccgactagaaaatttttcataccaccccctctcacagttaaaaattgctctacaagctctacaattttattattaaacctacttaaataggccaactaaaactcttctttctgaagtctctcttgatagaattaatgtgcatgattatgcagctgtggcaatatctccttttcctgattaagttgctgaagttgatcagtaagtaacaccaggttatcccagccagattgatccatcgaaggtatccatcgtgcacgcaaaaagccaaaccgatcaacaaggaattccatgtgatcaggtatattaccttttcctagaatatcaggatatttaagggttcgcctatataaaatgtaactatcttttatttcaagccatccatcccttaccacttcaatagagttattggcagcaaagtcagctattgctgtttcactgtattcatctaaaggaatagcgagtataacagtatttaagtttctaaatttttcgtaattttcgctcaactctttcaatctttctaaagaactgggccagctaaaaaatgctagcaaaacatttttattttgtcgatattctttaagagtaccagtagtgtcagtataggttgtaaactggaaatcaggtggtgtcgttgagagtttatacgaagcagcaatgggacccagccaccttagctgatagccactcgacattgctcgaatataattaacaatatcccatcgatcctcttcctctagcttttcagaaaaaccaggcatgcctgcttctttaataccatgacttatccaatgaaaaaaatcgccagcaagatgtctcgatgtatataaatcagtgagtaaatctgtaggcatcttcggtaaggttttagcaagaatgccattacctatcccttgcggcccatgacaagtggagcaaaattcagaaaaatgagctgttccattcgaaattgaaattgcatcaaatggaattggtgtatttcgatatgtttcaggaaacgcatcaacagcaaattggggtaacgtaacagctgcgcaacctaacattagcgccattgtcaccatattatgttttctgggactcctgtttttttttatccccagcaagaatgaaccaatcgctgtaacaaataaaatgactcccaataccagaaaaaactgaacacttggatctttccatgtccccgctcccaaagttccctctattgtgaagcggaatgaataaggccaattttcaactattgcatgtttagcgggcacagagttggagaggattgttgcaaacaatacaagcaacaatgcgaataaaaattcaatccgaacccatttccttaatttttccaccccgatattggcagcatccccatcataatcatagttttctgcctgaacagctttatgcattacttttgaaaataggaaattcttccgttcactttcctttttaagctcggagaaattaatcgaatcacaaactcgttcgaatgaaggaagccactttgatcgtgcctggtaagctatcaataaaataaccaccaataaagaaattttgatgatcaatgcccaaccataagtgctcgcaaccagtgcatgataataattctcaaccatccgatctgtcagaaccaggcctgttaatataattacagtcataacgggcagagcaatgaaagaaaacttcttaaggctttctacattcaaaaccagttgagtacccttttcctcacaattacgtcgatcaaaaataataaacaaaaatgccggcagcgcaccaaaccacactccagccatcaaaatatgcatgacataaacaggagcataaaacaagaaattctcgtctgaaccagcatgacttaccatagcagaagctatcaaaggcagagatgccaagcctgcaaccatgacgtaatgccatctagcccgctcacgttttagcgagacaaatgtagcagcacccagcaaaagcaaagctgataccgcacgtactgcccacatgtgccccatattggtatgttggacaatttttatccatgcatcaggcttccatacgtttgattcaatccctgttgcttttcccgtagtagttgccaaaatccctacgagaccaattaaaattatacaagccaacaatggaaataatttttctaaacgtaggatccagttattactaaataactccttccttgcgcccgctaccgcgagataagtacaactaccaagcaataccagattagcaacaagctgtgaccaacgagcgagtatcgcaacaacttccattacttttacttaattttatttttcttaaccgtaaatttatattctgaatccagtacgtgcccatctaccgacaacacccgaaacttaactgtataccgaccttctgctaattccggcagctccaggtagatagattttgaatcgtctggatgtgcaataggttttttttccgttaaaactttattatctgcatcaagcaaggaaagcgaagcataatctgcctcaatttcctcattgaaccataacctaatttgttgcggagaatcggcaagaacagctctgcgcgcaggctcagctttaactagttcagcatgtgcaaacacagcagtaggatgcgccaccagaattaccaatccaaatcctagaattgcaatattcatctttaccgtagtagctagctttatcataataaatttaaaataattattcttgatcatatcaccatcctattgataattaagacaaataaaagaatcaggattactattcgccaaataaaaatttattttagtattcctgtacgaatgatccgactatgtatttttttctttttgactttttgaagcgaagaagaagtatccaccgcctatgacaatgatcaacaagggccagaaatacatattcatcttaaatttgcctcctgtgcccacagcgaaagggaagcgtgatacatgctctattccattgtctctaactgttaccagtcctacaaaatctccttctgtgggaaatgtatgttcaaacgtgactgatccattcgagtacacttttggagggatatgcatgacggtaatctcgtcaagatttccttcttcccccggctctgcacctgtatcacgaataatgcgtacttctgttgttaacggtctcagcgcttcatcaatataatccagtgctaccactgtacgaccagtattgggtatatcctcacagaattcctgctcttgcgagctttcaggttggtagcccgtaaagtgcatggtataaggcccaaccgtgagtttacacatatcctccgccatagacagtccgccatgagcataagcttgcatccagcaggtcatgcccagtaacattccaaccagccatttaatgccggttattgtccatccttttgtcatctatctatcctccctgtcttttatatttttgttgcaaatcatgtcagcactctctatgagactgcctgaatttaatcgtcttcagatttaaaccagcttcttaagcggccggattgtatcagcttatacagcagccaactcaggaacaggagcgcaattgctgggcctgcccaagtgcgtacaagcttgccataatcaaccatttcaactcgcagctggtaataataatttagcggagggaccccttctgccgttactattactgaatataaccctttatccagtctgcctattccattaatgactccatccgggtgatgagctgcattgacctggatgatcatatctccttctttttcttcacctctgaatactttcatacccactggcatatcgcgcaaacccaggtctatcagatccacaaccaaataggtatctccagccattggaatctccgtgcaataatgcccgccccgatcaaattgaggttgataggtgttcaggtgcaccatattttcacctatctggcgcacgcaggtatcttcctccagtgatacacgaccatgccccaaggctgtattcgtgtaacacaagatggcaagaacacaagtcataaaagccagttgtaccgattgcttcaacataatgactccttgctcctgtcttgataaaaaaccacttttctgcttttccaacagatgctctcttcccatttttataattcctttcaattcagtactcaagataccgaatttgacaggctgtctgatgctttgtctcaaaatcagaatcacaataaaaaaccggtacacctctgccttgcgacaggcgatgtaccggttcttattaactaatacgcagtacctcagtactgtctattagagcttggtaaagactggaatcaccggaccagcaatactgttgatatggcgattaccttctgaatcccaagacattaacagtccaccaaaacggctttccgggtcacccagcaacgccatcagacgttggatttcccacagagcatctttggcttccatcctcaattgcttggtctcgcctggctgaattgcaccatcatcatcaaaattcaagcctactgcaaccagttcacgaggatactgtggatccaggtacttgcggccggtactgttaacgaaacgaatacctgctgtggtaaattcaccaaatgtgactggtgtatcaccgttgttggttacttccatcgatacacgcagtgcacgtcccggtacgtcatagttagcatctgtaattttgattgctaccggatttggtgctaccggtaatggtgcaactttggattgaccagcctggataggtactgtgtatggatgcttggtttctgtatagcggtatccaccccatactatagccaaggtcaggattgcaagtacccaggtgattttcttatccatcggatccagcaacagatcatcaccataagcgagcaatacccggctacgtggcaggaacatcggacgcgctacaaagataccaatccaaaatataccaattgacatccagagaatatgccagaaaataccgtttgacaggttgaatgtttctgagtcaattgtttcgcctgtcagcagcttgagtggattagtaaaatcatcccagcttccggtaatgttcatccatgcacccggtcctgcaattggacctgcatctttaacgtttaacatggcgtgcatgtgatggcgtcctggaatacgtgctctcagctgaacttcgaacgcatagtcacgaccaatttgcagcggacctgaaataaaccatgggtggccattaatcttcgtactcaaacgcacgtataccgagcttgggctacctacgttaaagaatgcgaaatccggtcttgctgccgcacgcggccagtcttcagccaagtgaaatttgccggtaatttgggcattctcattgactttggttacttccggaccccacttaacatcgtaccactgtactgtacgcatccgaagaaacggttcctgggatcgttctccatgggctgctactgttgagacatctagtgtcactgtcatggtcagtgccgccattgcataaacagcaacgccacaaagtcccatcattccacgtttataaaggttcttgatacccattatttgatcccctctggaaacccttcttcaccaaatgccgtaacatcattgcgctgcacgatacgtcctcttttacctttaacgtagaagaaggctgtgcagtaaacttttccaagataccaccagactgcaaacatcagcatggatacaaacgcagcgaagaatgctgcaataactgtggtgtgaccaccaaaggtacgtaatgaaccttgttcaatatgacgaacatactcaggtgtacccgtacgaacatacaggtgacccatatagtcagccatcgacaacagtgttccttctacaacgattggcagatgggtcggaccaaagattgcccagttacccgggtaaaacagcagaccaaagaatccacccccaaccaatgcagtcaccaaccagttacgtgtcagatacattgtgaaatccaacatcaatgcacccgggagcatgatacctggggttacaaaattgagtggatagtgtgaccaccagtagaaaccccagtaacgtgtcagccactcacctatcagcaaacacactacgcacagagtcgcaccaaatggttgacggtagttgacccacaggtaatacataattgccgagcaataggtaatgcctacaataggtgttactacaggccaccattgacgatctttccagtccatccagaaatcccagtcacctgccaacaacatgaagtgcatatggtaggtacctaccaacagaacaaccagaatcggaaaataaaccgcatcaatcaggcgtgacatatggaccgcttccggcggcatcttggccgctttcaggatctcttctgttctaaatatactcaccctatcctcccctcttataatttaaaattaacatcacgattcctctttttctttaaggtaccgcattccgattaccggccggctaaacgttaattgcttaacgtcagccagtcatttctttttccatataccccttgaaatgtagtttcctagatttcaaggggtattccggactaagctacaacccggttattcagaatttctttgctttgattattccagaccacgtcagtcaggttggaataacgggtaatgatttgggcagcaactccaccctggaataacccagcccaaccgagcactacaaaaccccaatgcagcggtgcgctgaacagctcttccatgaaccagaaagcatgaccccattcattcagaccaacgtttggcagaatcatcagaggacctgcaatcgccatcaccagtgggaaagaaattccacgatgaaacagcggcagacgggtcattgcatacagataggttgcaactccgcagacgatgtacatcggaaatgatccataaaacacgactacgtgacttggtgtaaagctggtgtcacgaataatcacctggtgccaggaggcatcttgctccgtaaagaagctaccaccccagtaaacaccaaaaatgtatacacccagccacatcatgtagtagaagtagcgtttgatttccagtttcggatccaggttattcaattgctcttctgtatcacgtgttttccagatccagccccaggttaccagtgcaaacagcggcataatggccatgtgcacacgccacaggcccatccatacacggtcaaactctggttccattgaatccattccgtgtgaataggcaaagtaacgttgataccatacccagaatatcgctaccaacaacatggttattaaaccaaatttataaaatttggagtcataccacagtgacatgtcatagcctcttgatgagactgatgaggcactgctcgttcctaacgtagttgccatctctttatcctcctttacaccacattttgttaaaaccagtaatgaaaattagaatttttcattactgtccatcgcaaataaccacatttaaatcacggtctttgcttgatttttgcctcagtatttctcattttgttccgggaaggcttctatacccacaccagatacatccgaaaggctagtcaccttggctcttttagtcaagcattttttattcacacaaccacaaggtttagttagttaacacaaaatcaattgattacaataatcttcacagcaccccctcacaaaaaccagatcatccctcaaaataaaataaaccatgaaaactttgtggatatgggtttttgcatctgtctgcgtggataatttaaacttacaaaatgtggaatatattccttctattgcggttattcttattacatgtattacatgtccaaaacccataatccagttcctgacttggtaaacgagcaaattactgccgccgttgcaagtttacgtaaaggtaatgttatcgctttcccaacagaaacggtttatgggctgggtgcggatatttctcacccccaagcaatccagaagatatttgatatcaaaggcaggcctcctgaccatccactcatagttcattttgctaagtcagccgagctcgaattttgggcggaaaatatacctacaacagcacttatgctggctaaacatttctggcctggcccattaaccttaatcctgcccaaaagcaggcatattccacttagcgttacaggagggcaagatactgtaggattacgtgttcccagtcacccagttgcactcaggcttttagaggagcttggcggttataaagcaattgccgcgccctcggccaatcgcttcggctttgttagccccacatctgctgaccatgtaaagaaagaatttggggatcgtattgatataattctcgacggcggatcctgcgaagtaggtcttgaaagtacaatcgtcagttgtattgataatgaagtcgcgatactgcgccctggtggaatttcggttttatctattgaaaatgtacttaagcagaagatttttgttcgatctcacggtaattcaattcgggctccaggatccttgacatcacattacgcaaccacaacaccacttgaaatctgccatggtgaatctctttttttacgctcttccatccttttgcagcaaggaatacgcacagcagttatagtacgaagcgtacgcgaagattttgttcaagatgcaaataacaaacttcactgtgtttttatgcctaatgatccggttaggtttggaagggatttatacgcgactctgcgtagacttgataatgaaaatttccaacaaattctagttgaagcaccgcctgataatttagaatggctagccgttgctgatcgattaaatcgagccagctactcattttataaataaatcttaaaaagacaatggctctttcagcagtcctctttgacgttgacggtactctcgcagatactgagcgggatggacaccggctcgcttttaatcaagcctttaatgaacttcaacttgattggcagtgggatatagatctatacggcgtcctgctccagatcactggtggcaaggaacgtatccgcttttatctagaaaattatgtgccttcattccttggcaggaacgatctcgatgaatggattacacaaattcataaagtcaaaaccagatatttccttaatttgctgaaagaaggaagaataccgctacgtcccggtattaagcgcctattagatgaattgcgaaaaaacaatataaaaattgcaatcgccacaactacaacgtacgagaatgtcagcaccttacttcagtgcacacttggagacgatgctctttcctggttcactgtaataggcgcgggagatattgttccaaaaaaaaagcctgcgccagatatttatcattgggtacttggccaacttggcctgccagccgaagattgtattgcaattgaagattcagaaaatggattaaaatccgctacggctgcaggaattaaaacaattatcacaaccagcgaatatactcggcagcaggattttaataatgcggctttagtcttagaagacttggaaaatgtgatgatagcctctcataacgagccattaagtgtccaaacgctcattaatctaaaccgaagaactccaatttgatttgatttgatttatatctactacatagacaatagctatcgaacaggcaaatagccaagaggatctacaggcttacccttttcacgaatttcgaaatgaagttttaccacgccaccatcagtattacccatttcagcaattttctgtcctttagaaacattctccccctcatgcacaaagattttactgttatgcccataagcactcaaataactatcattatgcttaataataattaagttgccatatccgcgcaaaccgttaccactataaactactgtcccagaagctgatgccagaactggttgcttaaaactgccacttattcccacaccttttgatttttcagaaaatctgcttattatttgtccatctgccggccacccccaattaatgccactcttatttgcactcacacttattgattgaccaggatcgctgttacctccccctccgacactgccaacttgataagaatctgaatttttttcagctaatttctgggccgatacagttttagattgattattcagctgatcacgagccgaatccgaataaggcagcaaaaccccttttggttctgtcttgaaagattcagatgccttctccccagtctcagaaaaaccaggttgatagccaccagttactacacccacatcctcgggttgagctattgagtaaagcgtaggttgagaggtaaggctttcctgttgagaaattaatccttctgcaggaagtgtctgcaaataaagctcttggccaacccgcaactccctgggatctgtaatattatttatcctagccaactgattaatatccaaaccatgtctgagagcaatactatacaaagtatcaccactttgcactatgtaggtttttctatccaaaagaccttttgtagcattatctccttcatcagaataacgaccaagctgtcgctcaacgactggcgcggggtcaggctttgaaacacaagcacccaaggacaagacaagaaataaaagaattatttgcatgaacatagatatttagctctacgctacatttagattaaattgctatagaaaataagaaattgaaagtttaagatatagccaacaacatggctgcctctattcgttggagataagtgctccctacctgttgattgtcccgggaagaatgggcacaaacatcacctcatccaagatcgtttcaacaaaaccctcggtagtatgatcaattacacaaagatactgctgcctgtttcctttcgggaataccatcctgccacccattgccaattgttccaagagcgtctctggtatctctggaataactgcagtcatcattattccatcgaatggacccgcctccaacaatccacgcattccatcagcatgtttcaggtaaatattacgaatacccaattcacgcaatcgaatgcgagtacgtgtcaacaagggacctatccgctcaattgaatagacttcattcgctatcttggccaaaacagcagtctgatagccgcaccctgttccgatttccagtacttttctcagcgaattgttcccaccattccgcagcaattcactcatacggcctacaatccaggggctggagattgtttgtccgtaattaattggcaatgccacatcttcatatgcccgggatgccaatgcttcttcaacgaaaagatggcgtggaatagaacccattgcagccaataccacctcatctctaacaccttgctcccttaaacgctcgaccatgcgaaccctcgttcgcggcgaagtcatgccaataccagaatggcgtacactcacgcaccaactctcctttattatttctttccagcaaataaccggatctgactattcctactatctttcataaaagaaccagcctgataatacatcaagggagaagaaaataacgagaagccaacccatttcaaacaaatcccaacttctttcattccgaaaacacacttattaattgaaatcacggcagctattaaaaaaccagccagtttttgacataaccaatctggtcgtaacgcgtcaaatctatttgcaaaggtgttatcgatacccggttattctgaagagcatggaaatctgttccctcactcgcgtcttgggccgcacctgcagcacccacccaatacactgtttctcctcgtggagtctggtatttaatcacaggctccgctttatgacggcgacctaagcgtgttacttctatcccctgcaattcttcatacggtaaatcaggaacatttacgttaagcagaatggggacatgaaacttattatctataaatcgtttcacgagatctaaaacaatctttgctgcagttggaaagttaccacgtgacatacttactaaagataccgcaattgaaggtaatcccaataaaaaaccttcggtggcggcagccacagtacccgaataaaccgtatcatcccccatgttggcaccatcattgattccagagatcaccatatcgggtagttcatccaacatgccagttacagcaagatggacacaatctgtcggggtaccgtttacataataaaaaccattgtgtgatttatgtaaactgagggggcgatccaatgtaagcgaattacttgctccgctacgatcacgctctggtgcgacaactgttacatctgcaatatcagaaagtatttttgcaagattagcaatacctggcgcaaaatacccatcatcattactgagcaaaatgcgcatttctacacccttaaaaaataagtaatgtgattaatcaccccgcattctcagaaatgactagctgcttatgccggatagcaaccatatgatagtcacagatatataaaacttgatttttaacggactaacctatagtcgaaatgaggaatatttttataaaactggtcggggcgagaggatttgaacctccgaccacttgcaccccatgcaagtacgctaccagactgcgctacgccccgtatcgattaattataacaaaacatacatcaatccaattgtttgcgatatagcaacactacctgtctaccgatcaatttaaaccgactctcccttgtcacatactagctacaatcaaagctatagcgcgaacaactctcgtaaacaggaaagagcactccctgatgctagcaattgtatcgatccccatagcttcaataaaatcttacagggaaaacacatactccggttatacagaatatgtatcctgatttgctatacacatttatcttatttaccactcaaaacaatatatatttatcaatataaaaaaacggaatgttaatttacgtttggttccccacgatagttagcttctaccatagatttaagcttctggcttgcatgaaaagtaaccactcttcgtgctgaaatgggaatttcttcaccagttttgggattccgccccggccgttgtggtttagtcctcaattgaaagttgccaaagcctgaaagttttacaccatcaccattttggagcgctgtgcgcatttcttcataaaaacactcgacaatttcttttgcttcacgtttattcagaccgatattttcaaataataaatcggttagctctgctttggttaaagccatatatccacccttaagttagaaaacagagtaaatgtcttgaactaacaccaggatttgccagatttgagcaatcataacgcaccaagtgaaagagtgaagacaatcgctcatgatttcgaaatacacgacaaatctataccgcgaagaactcaggaaaaaaaacgttcttcccaccaattcagccggccagtctcagcggacagaactcccaactagccgcgtagtgttgcaccaaactttcgaccgagaacattgatcagcccatttactgcttgatcgatttcctgatctgtaaggtttttttcagtaccttgcaacaaaatacggaaagcaaggctcttcttcccttgctctaaattttcaccactatataaatcaaataaagatatctcactgacgcttttatctttttctgagttcattgcttccagtaacttggccatacttacctcattctctaccaccaccgcaatatcacgccttactggtggaaattttgagagtacttgcatcatcggcagcaagtcactagcaagagcttctatttgcaattcaaataggatcgcagattgtgataaatgatattttctctgccaacgaggatgaagttctcctatccagccaatcggactcttgtcaatcagaattctggctgattttcctggatgtaatgccggatgaacagccgactcgaaatcaatatttcttggccagaataaggactcaacatccattttgacgtcataaaaatcaacatcccgatccgtaacaccccattgctccggatgcacattccctgaacaaagaacggccagattctctacctctttttcttcatcattatccttgctgaaacaggaacctatctcaaaaatcctaaccctactttgcttgcgattcagattaaattgtagattgttgatcaatccgccaaaaaggctgctacgcataacatccatatgacttgcaattggattcttcagttttaccggtaagttatttccgcaaagatctgcttcccactgagtgtctacaaatgtgtaattaataacctcctgataatcccttgccaccagaatttgacgcaatcgcttaacaggcgcaataccaatttctggttccgttagcatatgtgccgatgccttgggcaactgcgcgggaatcaggtcatatccatgcatacgcgcaagctcttcaataaaatcttcttcgatgactaaatcaaagcgcgatgcaggtggcactacataaaacgtatcgccgctaacagagtgaccaaattgtaatctccggaaatattctgatatcagttcaatcccaaaatccactcccaggatctttgctatgcgcttttgacgaacctcgaccgcatctcgtcgcggcaaatcgttactaacctctactactgggcctattttccccccacatatatccaaaaccagcgcagtggcacgctcaagtgcattacgcgtcatggagaaatccacccctcgttcgaatcgatgcgaggaatccgagctaaaacccaatttaaatgacttgccactaatcgcagccggcgaaaaaaaagcactctcgataaaaatatccgttgtgcctccctctaccccactttcactgccacccatgatgccagccaatgccaaaggtttgctactatcagctatgactaacagatcttcttgcaaatcaaggcattcaccgtttaacagtcgtaagcgttcatttgcaacggcatagcgcacacggatctcctgttctgcccctttttcaatcttagcaagatcaaaagcatgcatcggctgacctgtttccagcatgacatagttaataatatcaaccaccggattaatcagacgcaaaccagcccgcaccaaatactgattcatccacagaggagtttgtgtgctggtgatgatacctttgacgatacgaccacagtaaagcgggcaggattgaggctcttcaacccggattcgcagaacatctgcaatttcaggattaacaggtttaatttctggcaaattgagtttgccggcagtaatagcagcgacctcgcgagcaataccgaacatccccaagcaatcagctcgattaggcgtcaatttcagggtaaaaatactatcatccaacccgtcatattctctaaagctgatacctgcaggcgcatcatctggaagttcaataagtccgtcagcctcactttccaacccgagttctcttgcagaacacaacatgccaaaagattccacaccgcgtatcttaccttgccgtatattcaattctggcagccgtgcacctatcaaggcacatacggtcttcattccttctgtaacattctgtgccccacaaacgatttgtaaaggttcatcagaatagtttcccacatccaccttacatactcttagccgatcggcatttgcatgtttttgaacagacatcacctctgcgatgaccactttgtcaaaaaaaggagcaaccggcaccacactctcaacttctaatccagccatagtcaacttgtgtgccagctcttcatcagagcattggtagtcaaccaatttacgtagccagttcccgggaaatttcataactacaagtctagagcatcaattaaattgtttcagaaaacgtaagtcattttcaaagaatagacgcagatcattaactccataacgcaacatagttaaacgttcgacacccaacccgaaagcaaatccaatattttcttcactattcaagccaacatgattcatgacattaggatgtaccatgccgcatccaagcacctccaaccaaccagtttcaccgcaaactcgacaacctttaccattacacattacgcatgcaatgtccatttcagcagaaggttcggtaaaagggaaaaaagagggacggaatcttactgataaattatccttttcaaagaaatttctcataaattccaccagcacgccctttaatgcagagaaactgacattttcatctatccacagcccctcaacctgatggaacattggcgtatgagttacatcagaatcacagcgatacacccgtccaggagcaataatctttataggtggctggtgattttgcatatagtgaatctgcaccggcgatgtatgtgttcgcaacagcttcccgccttcaatatagaaagtatcgtgcatagcacgcgcaggatgattctcggcaatatttagtgccgtaaaattatagaaatctgtttcgatttcagggccagttgcaatatcaaatccaatcgaatgaaacagcgactcaatacgagttagtgttagcgtaaccgggtgctccccccctaacccgaatccacgcccaggcaaagacacatccaaactttcctcagccagacgagccgacatatttttctcatgaattacatttcggcgttcagtcaaagcatcttccaacaactttttcgcctgattaattcgctctcccattaccggtctttcttccggggtcagttccctgagttttttcagcaaaagtgtaacttcccctgctttacccagatatcgcgccttaatttgctctaggtcaacaacactttccgcctgatcaaataattttattgcggtactgaccaaatcttccagattattcatggcaatgaaatgatccactcataaaaaagggaggtcgagctaacatagtgcagacctcccctgataaatttgtatacaaactgttttttagtttgccaggctagtttttacttgattggttattttttcaaaggcagctttatcaaacacagccaaatcagccaacacttttctatcaagaccaattcctgatttcttgagcccattcataaaggtgctgtaagtcattcctaactctcgcactgccgcattgatgcgcgcaatccacaaagcccgaaactgtcgttttctttgacgtcgatcacgataagcatactgccctgccttcataacagcctgttttgcaatacggtatatatttttccgcctaccgcgatatccctttgccagcttaagtacttttttatgtcgtgcccttgccgttacgcttcgttttactcttggcattatctatctcctcaggcgtaaggcagcattgcgcgtacagatgccacatcgcttgcatgaacgacagtcatacctcttagttgccgcttatttttagttgtttttttagtgagaatatgtcgtttaaacgcttgcgaacgttttatacttcctcccgctcttattctaaagcgctttgcagcacttttcttagttttcattttaggcataaagcaacacttcctttttaatatgaaccaaggtgtctctaattagagaacttttaaaaccttgatatcacttattttaaataaaccagcaagaacatattttacggcagcaagataattcgctacttactaagttacagtttcgttttttgtatccgcttcccgctacttatcagatttggccaccttcacctctttttttctaggcgccagaaccatcaccatctgccgtccttccaatctaggaaactgctcaacaacggcatgctcctcaagttcttctcttaccctttcaagcagtctaataccaaattcctgatgcgccatctcccttccacgaaaccggagtgtaactttaaccttgtcgccttcatttaagaaattgattaaattccgcagcttaatactataatcaccctcatctgtattgggtctgagtttaatctcttttacctgtatctgtttttgcctcagcttggcatcgtgcttctttttgctttcctgataaagatattttccataatccatcaacctgcaaactggaggctccgcacttggtgcaatttctacaatatctacaccagactcttcagccaactcttttgcttcagctattggtactatccccacctgctcaccgttcacgccaatcaatctgacttgtagtgccgtgatttcatcattaacccttacagtcttttcttgagctatggtaccctccgtaaatccataaaaaccccttaactacactctttcggccatctctttccgaattaaggtaacaaaaccttcaagagacatcgccccatgatcatggtttgaccgtcctctcacagtaacagtctgattttcgacttccttatcgccaaccactattaaataaggcactttctgcaagctatgttctctgattttatagcttattttctcatttctcaagtccgagctgacgcgaataccattttgtttgagttcatttgtgattgactgaacataatcagcttgatttctagaaatattaagtacaaccacttgatcaggagaaagccataccggcaaagcgcccgcatgatgctcaataagaattccgataaaacgctccatagatcctaaaatagctctatgcagcattactgggatctttttcgtattatcttctgcgatataccctgcgcctaatctcgctggcatagagaaatcaagctgcaaagttccacattgccacttacgtccaaggctatctttcaatgtaaattctattttagggccatagaaagccccttcacccggttgcagctcccagtttagttccttttgatttagagctgcagccaaggcggcctcagctctgtcccattgttcttcggttccaactctctggactgggcgggttgaaagttttatcaagttttcatggaatccaaaatctatatacacctgatttaatagatcaatgaatttagttacttcttctagaacctggtcgtccgtgcaaaaaatatgagcgtcatcctgcgtaaatgaacgaacgcgcataagcccatgtaaagcaccagacgcctcatttcgatgacatgaaccaaactctgccagtcgaagcggcaaatcacgatagctccttaacccttgattaaatacctgaacatgccccggacaattcatgggtttaatagcgtaatgcctactctcagactccgtaataaacatattttctcggaaattttcccaatgtccggatttttcccataacgatatgtccagaacctgaggagtacgaatctcgacgtaaccattcttggccagcacctgccgcatatattgctctatttgctgccatatagcccatcctttgggatgccaatacaccattcccggagcttcttcctgcatgtggaacagatcaagctgtttaccaagtttacggtgatctcgtttttctgcttcttccaggcgccgaagataattattttgctcttcgctgcttacccacgctgttccatatattctttgcagcatttcattttttgagtctccacgccaataagcacctgctattttcatcaacttaaagactttgattcttgatgtatacggcacgtgcggcccgcgacataaatctgtgaaatcaccctgagaataaagtgaaacaggctcatcattcggaatagatgcaattatctgagccttatagtgctcgcctagatccttaaaaaagccaattgcttttgaacgatcccacaccttacgctctatcttcagatttctcctgctgatttcttgcattctcttctctatggcagccagatcttctggtgtaaaaggccgctcataagaaaaatcataataaaacccatcctctataaccggcccgatggtaacttgcgcacttgggaataattcctttactgcgtgtgctaataagtgagcacaagagtgacgaatgatttccagaccttcaggatccttgtttgttatcagcaccagatcactatcaacctctatcggctccgataaatctactagcctcccattcaacttacctgccaatgctacacgcgcaagtccggggccaattgactcagcaacatcaagcaccgtcacgggataatcgaacgctttgtctgtgccatccggcaaacgaacaactgtcacttatttacctcatcacttgaacaaatatatatattaagctagccattcgcgaattcaaggtaataaattcttgtggtttacccatttaatcagcaaataccgaccatcaggtcttaccatgaaaatcagctgagaatatcttgcatattcccgctaaaaaatattcttgtcatcattcctacagagatagtctattcgctcctattaaatctctgttccaatagcttaagttcatttatgtcaataaaaaacccgcgaagtttttaagcttaatctccgcgggtcctagtttacatcaataagatagcgtgttaattacattgcactttactcatcatcactatcgtcatcatggttgctggaggaagcggagtcgctgtcgtcagctgtttcagtttcttcaacttccacctcgacttcttcatcctcctcctcgtcatcaacgtcaacgtcatcgtcatcgtcatcgtcaccctcttctggctttaataccagcttgcctgcagcaagacttgcattcaaatctgtcatcggcgcttcttcatgcaccagattctgatgacagtctatgcaggttgctccttccgtttccattttcttatgttccgcctgggcgctttctcccggaggagctggttttacatgacaggtacggcaggtgatgctgtcccatttcttgaggttcatccgggcatcatgcgccatttccaatcttctttcgttgaacttctccagggtggagtagtcattgaccatctccaaccaaagttctctggcaccatcaaccacgtgagttgctactgccaggtggaaattttctatcccttgtggaatatgacagtctttacaagtcggattaacccccaatgcaccatagtgggtggattcttttaattcactctgtgggtatgacatggaatgacagctggtacaaaactcttcggtcgataacgcagcttccccaccaaaaaccacagccaccaatgctattcccagcagagctcctgtcagtaaagtgccaattgatcctttttgcagtctagtcatctctattttccttttttggcagttttagcgttggcctggaattcgtcatggaacttgaatttaggctctccgtcaaatacgccatccagtttgtaatgctcgtgcatggctttgacgtcttttaccatctcgtcaaacttgaaggtgtatttcggatccacttccggtgtatacggggtatagggaggttttgctcctttccagggtgacccttcatagttcagatggcaggcgctgcaacgttcttcaaaattaaagtcttgccccttgcttgccagggtcttgcgcggcgcttttttgcccgatttctcaaatgcttgcccggccttgcggtgatctccccggtatttacgtccaggcccgtggcaggattcacagcctacgccagtcagcatgggtttgggggagtctatcgtgtagccgcctttctggccaaatccatccacgtggcaacctacgcagtctttgtcctgggtgtagtccttggtaggatccagtttggctttttgtttggcttccactttgacattgggcttgagcgattccatcgccttggcgtgggcagtatgtttccacgactgggcttgtggtttgtgacaggaactgcactttttccgaccttcaaacggagcatccgctgccagactctgcccacttgtcagggtgaacagggctgcagcaaccagtccgcaggctattattattttcatgatctctcctcttttcttagatgtttgaacacagattatgattcttttgtcttgccgaccatcattgtatcttgccgaccatcattgtacctgatcagtcagatgggttgaatccgtcgttttatcatgatccggagtgggttgcagattgtgctgggtttgtgccgccggggccttttctgccagttgatagacccagtatcctccttgctggtagatcaatcgcggggaggcaagctccagcggagaaggttggctggtaaatggcagcagcctggccagcagggtgtggtaactggcttcatctgtcagaaagaaggcgcgaatcagttcgtccgataacgattgcacagtgtaggcgtagtagccgtgattgctcatctcggtcttgacatgactgatcatgccatgcaggttaccggtcaggcggtagggtttgtaggcaatgccaaatttgtcagggtatagcagacctagtttgtacaggtcgctgatatgcacgatcaggtaagcatcgcgtgtaccggccagttgtcgcaaatcagccaggccactggccagcggattgagcaggctttgcgtaaaacgcagaaacagctcgcgttcctgtggatcggccgcagcgccagtttgttcgttttcatacgcgcggatcgcttgcgcatgcgcttgccattccggcggaacaatcagaggttcgtgcagtgtgctgtgaaacagtacgtctcgtccggtcaacagggccagttggcgtgaggtatcccaccagctgagcagtagtgcatctcgcggggcgtatttgtctattgccgttgcaagcgcactgagttcagcagctttctgatccagcgccagcagaggttctctggtttcgttcttccagttgagtaatacctgcggttgatttgcacgctgaccaaaccaggcttgtgctatcggttgatccgttccttccagatgaatgtcgtactggttgatggtcagatccggccaggcttccagttccagatcaggatagtcgtccaccttgccggtggcagccagctggtaacgatagggagcctcatccggtgtcagcagcagccaagcatacccgcccagcaaaaccaaacctcccgtcaccagtaaaatccccagtggcgggaggagtcggtcaaaccagcgcgactgtgcgcgccggtttggtgtcaacgaagcagtcaagcttgcgtttgcttacgtttacgccagccaatcagagcaatcgctcccgccagcaacatgccacctcccagtcctcccagcgagatcttttctcccgctcccttgaggtcaagcaggctggtttttttaccttccagtttgttaacacgcgcttgcagagctgtcatttcctgcatcttggtgtattcatcctggatttcaacataggcacggttcatcgggccccaaccttcggtatatgtccagccacctggattaacgtgtgccagtcctacgtgcattttggccaggttgttttctgccatttccagcactttcagttcaagtgaggccgggttgttacccttggaccagaacagttgggtgaagataccaaaacccggtttctctggcgccggtggattcggacgattggttttttgaccagtcagggtgccgtcttcatacattttgtgaacaatggcattggcttcctggtatttagccaacccttccagggtacctttgtccatgagatccaggtaggagcgggcaaaccgttccgagtgacattgggtacaggtcacaacccaggaatccagacgagcttctgaccagtcgctggtgatgttttctgcaatccccggaacaaacgggtagtttgcccagcgggtcttacgggtgatgttatgggtatattccccttcgtattccatgtggcaggctgcacaggtcggtgcggtctgacctcctttggagaaggcgtctttcagacgaacattccagttccagttctcccggttcatttcagccagtttgccgtgcttggacataatgtaggcttcatagttattatgatccacgccgctgtgacaggtggcacaggcttccggtttgcgggattctgccgccgaaaattcatggcgggtatggcagttgtcgcatttgttctggttggtgtggcacatggtgcaaccttctgccacttcacgttgcggcatggctgcccaaacggtggtttcaatgttggctgtgtagtccagtgcgtgggatggacgtccgtcaggccactggccattcggccagatcatggtgtcacgctcggattcacgctcggcaaattctctcaggtgacaggttccgcaaacgtcagctgtaggcatgcgtacgtctttggtgtgatctgctttctttttggcgttgatgtcaacgtgacagtcaatacagcctacttccttgagcgcttccttctctccaagtttgcccatggagcgcaggttgttctcaacttcttccagcttgccttttttgtaaaaaagcggatcttccggcttgaggttgcgtattttgtccaggttggcgtgggtgctgcgtttccatgctcttacccaaaccggcgtttcatcagagtggcattcaacgcagtctttgcgctcagcaatttctttcggggaaaccggtggtttgtaaaaggtgctcgggtccatgtagatactaagcgctatcggttcccagtagtctcccatcgtgcccttgccagcaccatgtgcaggatccttgtaacgcttcaccagcgcatcataggtctctttcggcgtggctttgctgcgatccagcttcaatgcttcatacgtctcatccggtaccgtcgatatatccgcctgtaccggcccaatcaacaacaggcccgcacacagcagcatccccttcaaatactcccctaatctcatctctctcctccgtaatctacctgtcggtatttccaatgtacaaacaataaccagctaccccaatccctctcaggtaaccagccaaaatcacttctatacatcacagcgccccaagactactttctcatcagagacaagtcaagattttaagaagccagtaccggggcaaaaatctgaatacgaactactaagtattgttccgagtatccaggcacaagataaaggccgcataatttatcgctggcccggaagcaaggtagaattgctgtatctgtttcttcggttgatggaatgaataaatcacgtgtagttgtaggtatgtctggcggagtggactcatcagttgccgccttgttactcaagcagcaaggctatgatgtaataggccttttcatgaaaaattgggaagatgatgataccgatgaatattgctcttcccgcaaggattttctcgatgccgcttctgtagcagatatccttgatataccgctggaagcagtgaatttttcagctgagtatcgggagcgggtttttagcctgtttttagcagaatatcaggctggacgcacgcccaatccagatgtgctttgcaacagtgagatcaagtttaaagcctttctcgatcacgcgctggcgttgggcgctgactggattgcaaccggacactatgcgcaggtacatgaaatcaacggtcagtttcagttgctcaaaggggaagatggcaacaaggatcagagctattttctttaccggctgaatcagcaacaattgtcacgcacaatttttcctattggccacctctacaagcgagaggtacgcaaaattgcacacaagcacggactgcccaattcaaccaaaaaagatagcactggaatttgtttcattggcgaacgccctttccgtgagtttctcaaccgatatttaccagtcgacccaggcgaaattcatacgctggacggtcagatcgttggagagcaccagggattaatgtattacaccatcgggcaaaggcaggggctgggtattggcggtattcgcgaaggtagcgagcaaccttggtttgtgtcaggaaaagatatgcaaacaaacgtgttatatgtcgtgcaggggcacgatcatcctacactgttacgttcttcactgactgccgccgatctctcctggatcagcggtgcaccgccccatcaaagctgggtttatgcagccaaaatccgctatcggcagacggatgcaccttgcgcaatcatccgccttgagcatgattcctgtcagatcggctttgcagcgccgcaatggggagtcactcccgggcaatctgtagtaatttatgaaagcaaagtctgcctgggaggaggaatcattaccgacagtgtgtaatcaggtaatggttaaattttcgatgtttgtctctgtatgtatacgttttgcttctgctccgttcagtttgatttgcagtcgcagttcattcacggaatcagcattacgtaatgcatcttcgtaggaaatcacaccactctcgtaaagttcaaatagcgccatatcaaaggtctgcatccccaattcacttgattttttcatgatttccttgatttcatgcacatttcccttgaatatcagatcggaaatcaacggagaattgagcattatctcgattgccgcaacccgcccactgcctgattttttgggaattaacctttgtgcaaccaatgcccgcatattcagtgataaatccatcagcaactgcgcacgccgctcttccggaaagaagttgataatgcgatccaacgcctgattagcactgtttgcgtgcaaggtacccatgcataaatgcccggtctcggcaaaggcaatggcatgttccattgtttcccgatcccggatttcaccaatcaaaataacatcaggcgcctgccgtaacgtattcttcagcgcagcttcccaggattccgtatcaaccccgacttcccgctgagtaatgacgcagttgatatgctcatgcacaaattcaaccggatcttcaatggtaatgatgtgtccatagctgcttttgttgcgatggccgatcaacgccgccatcgaggtggattttcccgaaccggttccaccgacaaaaaccaccagaccgcgtttgctcatgacaacctctttcagaaccggtggcaacccgagatcatcgaaatccgggatctttgtggtaatcgtccgcaaaacgatgcccgtccgctgttgctggacaaaggtattaacacgaaaacgcccgatcccctcaggattaatcgcaaaattgcattccttactggtctcaaactctgccgcctgcttattattcatgatgacccgtgccagagcttcggtatgtataggagagagcgcctgttgcgtgaccggtgtcatttttccatctattttcatcgccggaggatagcctgctgtgatgaacaagtctgaagccttcttgcttagcatcagtcgcaataaatcatgcataaatttaagtgcctgttctttttccatcatgttctacccttaaccccggaaattatctttgttcatcgctttggtgcgcgcttccgctgtcgaaacaacaccgcgtttcaccagatctgtcagattctgatcaagtgtctgcatcccgactccctgcccggtctggatggctgaatacatctgtgccactttcccttcccggataaggttacggatcgccggtgtaccgatcatgatctcgtgtgcggccactcgccctttgccatcctttgtcttcagcagtgcctgggaaataactgcacgcaacgattcagacaacatcgcacgtaccatttccttttcttcagcaggaaacacgtcaataatccggtcaatcgtcttggcagccgaactggtatgtagcgtgccgaataccagatgaccggtttccgcagcagtcatcgccaagcggatagtctccaaatcccgcatttcccccaccagaataatatctggatcttcccgtaaggcagagcgcagtgcattgctgaaactgtgcgtatctcgcccgacttcacgctggttaatcagacattttttgctttcatgcacaaattcgatcggatcttccagagtcaggatatgatcatactgattttcgttaatatcattgatcatggctgcaagcgtagttgacttgccagatccggttggccccgtaaccaacaccacgccacgcggctgttgcgcgatctcggcaaatatcttaggtgctttcagctcttcaagcgttagtactttggatggaatggtacgcagcaccgaagctgctccccgttgggtgttgaaggcattgactcggaaacgagctagaccagaaatagcaaatgaaaaatcacattccagatgttcttcataagctttacgctggctatcgttcatgatgtcgtacaccatgtcatgcacatccttgtgctccagtgcgggaagattgatacgccgaatctctccatgcacccgaatcatgggtggcatgccagcagataaatgcagatcagaagcgctattcttgaccacaaatgagagtagttctactatgttcatccgatgtgttccttctacctcgtggaatattggttggtcaatgacaatcgttggatgtcatttccggccacaccgggccgatccaatctagaacggatcaaaccgcacggaattaaatatatttcgggaacatcagccaaactttccctgtaatatccatcgtatttgtcaactcatttagatcactattcgccatgactacaattgcctcacgcctgcagaatgttaagaaccgtattattgatgccgctaaaaatgtggggcgcgacccggcaactattcagttactggcagccagtaaaaccaatacaccggataagttgagagaagcctgggaagcgggacaaaccgtgtttggagaaaattatctgcaagaaggtctggttaaaattcgtgcattagccgatttaccaatcgaatggcactttatcggcccaattcaaagcaacaaaaccaaactgattgccgagaatttttcctgggtacatggcattgaccgggaaaaaatcgcaactcgtctttcagcagcaagaccggaatcattacctcccctgcaagtctgcgtgcaagtcaatgtaagtggagaaattactaaaagtggagtagatccggaaaaagtcgcagaactggcagcctttgtcagtgagcagccgcgacttcaactgcgcggaatcatggccgtgccggaactgactgctgtcactgcgctgcaacgcgaacaatttcagatgatgcgagaagtttacgagcaactcaaacagaaaggctttatcctggatacgctatcaatgggcatgtcagaagatctggagaacgccattgcggaaggggccacaatggtcagaataggcacagcaatttttggtcaacgacgttacgctatccctgaggagctcggttcgcgcccgtagtcagaaaacgatacttctctatcagctgctcatgatcctcaacccggttcggatcaacaataatgcagctgaccggacaaacttccacacactgcggcgtatcataatgtccgacacattccgtacacaaatccgggttaatctcgtaaatttcctccccctgtgaaattgcctggttaggacattcaggttcacacacatcgcaattgatgcattcatcagtaatgatcagtgccatttttattactctccattattcatttctatctttttctgacgtaaccgctcgatcacaagaggatgcacaaatttgcttacatctcctcccaaacgggcaatttcacgcacaatcgtggcggagataaacatatattgttcagatggcgtcagaaaaatggtttccacgtccggatacaagccgcgattcatgcccgccagttgaaattcatactcaaaatcagatacggcacgcagaccgcgaatgatgatatgagcatcctgttgccgcgcgaattccatcagcagaccagaaaatcccgttacttcaacattggaatatccggtcagcacgtctctggccattttcacccgttcttccagtgagaaaaaaggtgcttttccactactgacagcaaccgccacaatcaccttgccaaataatctcgacgcacgatataccagatcctcatgcccatgggtaatcggatcaaacgtacctgggtaaatgactttatccatcaagattcagagtcaagaggcaataataaacatggcttgctcgcccttgcttgcagatcaaccaggtattatcgggcaataacttgtcactactttcagcataaaccaccccgtttttcctcaacctcgcaggcagtaatggcaatacttcagtcagcaacccggattgatacggagggtctacaaaaataatatcgtagtactcagagttggatgcaagaaatgtccgggcatcggtatgctcaagtttcacttgtgaagcagccagtttctcaatagcgttgcgtagattgcgcgccgtctttacattttgctcaatcatggtgacctgttttgctccacgcgaagctgcttcaaaccccagtgcaccactaccggcaaacagatccaggcaagtttttccggtcagatcctgtcccagccagttgaataatgtttctcgtacacgatctggcgtcggtctcagcaacaacttatcattagaaaactggagcaatctgctgcgccattgcccgccaataatacgaattttacccattagcaacatgaaaaatcaggagtctactctgcacccacgactaccgtcaccatccctgctggatcaatccggcgctggaacgcctctttaatctgtgccacagtcactttttccactgccttgacataatcttccagataagtcagtggcaaatcataaaacccgatcacccccaggtaaccgagtattttccggttactgtcgatacgcaagggaaatccccccacaatattctgccgggcagcctgtaattctttcttagttggcccctgttcaacaaagtcactgagtgtctttcgcgttaattgcaaagcctgttctgcctgctctttctttgtctgcaaaccgatttcaaaaggccctttctcccgatacggtataaaagcactgtaaacactgtaggccaacccgcgtgtttcacgaattgtcttcatcaaacgagatacaaacccgcccccacccagaatgtaattgccaaccagcaaaggaaaataatcaggatccttgcggctcaacccagggtaagccaattggatatggctttgtgtcgccggatgcgcaatttttcgggttatcggttccggtttttcgactgctggcaagctattgttcgtttttccgctgggcaaattttcagtcagcatctctgcaatatgattcgcttcatcacgcttgatatcaccaatgattgcgacaactgcattaccagccgtgtagtgcgtacggtaaaaatcaactagatcctgacgtttcaacatggtaagcgtatccggctctccggattcacgcaaaccataaggatgcttgccatacaacagcttcattaacgtccggtctgcaataacttccggcttggtatccgcttccttgagcgcagaaatgatgcgcgtacgttcccgttccaaaatttgttcaggaaattccgggcgctggatgatttgtgccagcacattcagcgcacgaatgcgctcctgctgatgactcaacgttcgcaatgacaaacctgctcgatccagatcaaatgttccacccagctctgctccgacatccgccagcgtttcagcaatctgatcttctgataaaccacccgtgcccatacccatcaaccgttgcaccagcctggcgcgcccagatgtcgcagcggtatcagtactgctgcctgccagaaactcaatactgagatcaagaatcggcaaatcgtgattctcaacaaaataaacccgtaccccgtttgctgtctgccactgctgaattggcaaaaaagccagcgcccactgcgcatgaatacccagccagaatatgaccaaaaactgtaaaaatcgcatatatccctttcccggtaaatttagggaaacactgatttattccgtcatctggattgcttcctgccacggcctatggcctcgcagctaaaaaccacacactcgcaatgacgtttatcactttaaccagcctttccttagcgttaaatgtagaaacattgtacctgattagaaagattgttcagcttgccatagccaacgtgctgggcggggtccgatagtggctgcagcgacgaacagacgtagagggagcgtttcaagatggaagcgccggttgaaacggtaaacaaatgcaccgaggtaacgggttccatatttggcaaaattgaatgcatgataagtgccatccaggctggttttgaggctgcccaaaaccgtattgatccagctgaattctggtaaatccttagatttgcggctgtccgcaacgattgcccggtgctggcagccagcatcagcaaccccggtaaaacaactcaatcgtgactatacaacctggcgcgaggtcagcagtagcccagttaaaaaccgctttgcgcgtaaagccagagctttgatgggtgtgtttgggccactatgcgccttatcatagaaaaaatcgggcctggctgaacaatctttctaatcaggtattggtttgggcttttgtatcccaggtatgaatgtagtcgctggctgttataaaacatggaaatatatgcaatacatcttgctgagctgcatagcgggtcaggtaatattgccagtggatttgctcctgtttaaggctgccgataaagccatatatttttagaagttggcgatactgtttgcaggcatattacgatccgcgatccgaatgtaccgtcagcctacttgcggctaacgttgccagataaccatctgcaatacatcacacaccagtcttgctttcattcttgtactcatactccagccaaccactttcctggaaaacaaatcgatcaccacagccagatacaaccagccttcctgattccaaatgtcagtaatatcgctcacataggcctgatccagtttagcaacattaaactgtcgattcagtttgttctcgaacaccggttgtttgtgatgactgtcagtggttaccttgtacttttcccggtgcctcacttgcacgccagcttctcgcatcaatcttcgagctttccagcgatccaccggataaccccgtgcattgagcgcttttccgattctgtgacaaatagtcatggaaaattccttcacaaggtatgaaggctttggcacttacacaatagattttacagtctctattttaattgatctggctcaattattaatttgttcagaaccttctttacaccatctaccgaatgcgcaatgttatacacattttctttttctgctgctgatttaaccgtaccagttagcaccacaataccatcactatctgtatctactttaatgtgtaatgaatcaatattttctgtcgcaagcaacttggctttgatttgggtagtaatgactgaatcactaacaaattcacccacactaaactcttccgcagaagctacggaagcaatagacaacatgcttattaaaaacaaaccggcaattaattttaagaatctcatgtcctgtacctcattgaattagaaaatagtacatcactactatcagttatcctctctctaacgattccaaaggctatataacaattaactgttgagattagtcgtcaagagaacctgtcacattaagcatgcttcgtacaaattcttcattgattctatggaagaaaaatttccaaaaattgcttaatgcgacagaaccattaataatcgtctctgattttatctgcgttatcctccattttatcggccttatcttcagccgcacctctcacctgatccgcctgatcttccatcttatcggcttgattttcgcgcatctcttccttggcttcttttgcctcctcacccgcttctctaatctgatcggctttatcttccaatctatcagcttgtgtttctgcatcccccatgcttagaacaacattttttgcatagctattaggtgcggcaataacaaatagaaaaacacttaaagccaaaattgttttcattagattattcattttgatttcctcttcacagtgaaagaattgcttgaattagccttttttgcaaaaatcatccacctgcttttcagcagcctcttttgcaataccatatttttcctgaattttgccaattaactcttcacgctttccttcaacaatatccagatcatcgtcggtcaacttgccccattgttgctgtattttgcctttggcctgtgtccaattacctttaatttgatcccagttcataatgaataccccttttattaaaattgaaataaataatttaatttagtgtttcctatgacatgcagtcacaacaaaattacataggtggcgggcgtcgtcccaatacccagaatacaactgctaacacgacaccgataacaaataaaatccaggccatttccatcgcgatacctgcgacaccagttatgcctaatagggcagcaattattgctataactaaaaaagtaattgccaaatttatcatgagatttctccttatttttttggctccagagggtgtgttaattcagcacaccaatctagaaatatatttttagaagcgttaatcttctaactcattgtgctgcgctcttctttgagcattaaaggcatactacagcaggagttttttgtggtatgtgcgatgacgcacaaagcgttaaataatacaaacatctgggatgcgacagctacttgaggagcattttccaggtagagaaggggcatggggagggatagccacagataatcgtcggtttatcaatgctgttttctgggttatgcgaacagagctccatggcgggatttgccgccggactacgggggtggagcaatacccaccgccgttttattcgctggcgtgacaagggtatccgggaaaaattgctggaaatcctgatggataacccggattatgaatggctgatatacatctggccgaggatgcgcatggcatggtataccgatcaaaatccttgttacaccaggtaccactgctgattgcatgcaagttggccgcctgatcgaaggcgatgatgcagatcatctgctggcagataaggcgtttgatgcaaagcaattatcatttttcaacttgctcataactactaaccactcgcgtcatgaacaagggataacgagttttatctgtataatcatttgggatcagacgggcttttagtttcgctacacgacccagtaactcctgcaatatatgttataaagactactggtcacattcattgtggactagactaatttgatacagcgttctaaacttctgtcaaagcttattattctgagtcaactacataaaaggaagcggcaatgtcactgattaacaccactatcaaaccgttcaaggcaactgcataccacaatggcgattttgttgaggtatccgacaaaacattaaagggcaaatggtcggttatcgttttctatccagccgactttacttttgtatgcccaaccgagctggaggatctggcagataattatgctgagttccagaaagcaggcattgaagtctattcggtttctaccgacacacatttcacacacaaagcatggcacgacagctccagcgtggtgcgtaaggttcaatatcccatgataggcgatccaaccagacagctggcacgcgactttgacgtactcattgaagaagaaggattagccttacgtggaagttttattatcaatccagaaggccaaattaaagcactagaagttcaggatctcagtatcggtcgtaatgctgctgaattactgcgcaaggctaaggctgcacaatacgtctctactcactcgggcgaagtttgccctgccaaatggactgatggtgctgccacgctgaagccatctattgatctggttggcaagatttaaatattctgcacaattctgctttcaaccggctgcagcgatacttctcctctagagaggtatcccagccggtttcttcagaccagccaatcacacaatgatggtagctgctgatttttttctgattttccgcaaggctatgtaccgaaaactcaatcggtggataaaaactgtattgagcttgatgctgactcttggtatcaccgcctgcatcagccaaagtacattcttcgatacgcttgatcacaaaaaagactgggaagccattcaatccagtctacctgcctacccacaaccggaaaatctactggaatttgatgccggccctactgcaagattgcgttattttatcgatgccaaatcaatcagtgtcgatgagaaacgtgtgatccgctacagtatggtagcccgatccggacaaggtgcgagcaatgtttcatacgaagggatacgctgcaaaacacgcgaacggaaacgctatgcaacaggcaacaacgaaacacacagctgggtacgtgccaccatttctgaatggcaaccacttgaaatggttacccaattacaggcacagcgggagctggccaaattttatttctgtccccgtggtttagtggtgggttctcctgaagaagcaatccgtgcgctcaaagccggcgtacatccaatgatgaatcgctaatcatcatccatcgtttgattagttaatctaatcgtcactgacagatgttctctctgacattttttgcaaaacagacaacaactctatcggtagcggaaaaacaatcgtagaacttttctctcctgctatttctgtcagcgtttgcagatagcgcagttgcaaagcttgaggctgcttcgccagaatttgcgaggcctcaagcaaatggcgtgatgcctgcaattctccttctgcatgaatgattttggcacggcgctcccgttcggcctcggcctgtcttgcaattgcccgaaccattgtttcattgagatcaacgtgcttgagctcgacattcgataccttgataccccacgcttcagtctgcccatccagaatcaactggatatctgtattgagcttgtcgcgactggccagcatttcatccagctcatgttgtcccagcacggagcgtaatgttgtctgtgccagctgactggtcgccatattgtaatcctcaacctgaataatggctttttccggatcaaccacacgaaaatacagcacggcatttacttttaccgagacattgtcacgcgaaataacatcctgagcgggcacatccatcacaattgtgcgtagatcaacccgcaccatagtttgtataactggaatgacaacgatgagacccggccctttgactcgccaaaaacgccccagcatgaacacgaccccgcgctcgtattctttcaataccttaagcgcactggccagaaaaaagatggaaaaaatcagtattggcgtaatagctgatacgatatccgtgtgcatatcaatcctccgttgtgttgattgtaagatcaggttggtaaggctccacttcaagcatcagtccatgtatggctattacactgacctgctgtccaggttttaatggggcgttggatctggcacgccacaactcgccatgaatccggatccaaccttcctgatcaaagccttccactacttctcccatgctgcgaataagttgttcactacctgtgacaactggtttttccctggatttgagcgccatgccaagtaccatcataaaaaacccagccgatatcagtgcaaatgtaacgatcaatggaatcgaaataccgtaccctggtatttccgtatcaatcaacataatcgatcccatgatgaaagccgccacccctccaatgcctaacactcccacgcccggcacgagtgcctctgccagcataaaagtgatgccaagtagaatcagcgccagtccagcataattgattggcaacacctgaaaggcaaacaaagccagcagcaggctgattgccccgattacaccagccacgattgtcccgggatttgcaaattcaaggatcagaccataaaaaccaatcagcatcaggatataagcaacatcgggattagtgatcactgccagtagatgtgtacgccagtcctgttcaaagtgctccaacaccagcgatcgagtagataacgctactttttgtccggctaaatcgactacacgtccgtctatttgcgtcagcagatcacccagatcatctgctatcagatcaatcacgttgttatcaagtgcttctgcagatgtcagactgacaccctctcgtactgcctgctctgcccagtcagcattgcgatcgcgcatccgggcaagtccacggatataagcggccgcatcgttgataactttcattgtcatggcatcctgcgtaccagatgaactgattgggttggttctttcattttccggtttatgcccgggtgcctttatctcttgtgactgggctcctatctttaccggtgtggcagcgcccaaattggttgcaggtgccatggccgcgatatgactggcgtaaagaatataggtgccggcactggctgcacgcgcgccgctgggggctacaaaacttgctactggaatcggggaagcaataatttcctggatgatcttgcgcatggacacatccagcccgccgggtgtatccatttgaagaataacgatctgcgcctgctgttcggccgctctggagagtccacgatgaatgtaatcgtatatggctggactgatggcgccgttaacatccagccagacagcaatgccattagctgcgccagtggccgtattggagggttgtgcaaacagcatgccagcccatagaaaaatagccagcagtaaactatattgtgcctggtaaaatcctgtagatttactggcacacatgcgtgcactcctatctggacagccagtgctgctgaacagtgtcgcggttcaaagcaagccactgtaatgcaataatagcactggcagaattaatctgaccggtattcaatagttccaacgcatcatgaaaagacatgacatgcaccttgatatcctcatcttcttcgccattgccatgaatactgcccgcatcaatcgttttcatatcaacccgaccacagaacaatacaattcgctcagtcgtaccaccggggctgaccagataatcatacagcgggatcaggctactgatctgacaatccgcttcctcgatggattctcttgcaaccacctgttctggcgcttcatcagcttcaattatgcccgccacaatttctagcaaccaaggaccatctggtgcagacatggcgcctgcacgaaactgttcaatcagtaaaatttcatcagtgtgcggatcgtaaggcaatactgctgctgcatgtccccgctcaaataattcacgtgtgatcgggcgcccccaccctccgtcgaatttacggtgacgcaggcggtactgctctagacggaaaaaaccctgaaagcagatggttttttccagtatttcgaaatccattttatggatgtttgagtagtttattaccagcaatcagtgatttattcccaattgctggcagagatagcatcaagatttcattcaggcacttaacggacgtgttctggctatcaagtcctgcacggcagataattcagccataatagctgacaaaccgatctggccagagcacgtccgtatgatcaatgcttcagatcagatgcctgctgaatgccggacaacagccaggcagaatcagaggcaaccagatctttttcaacatgccagatctcgtcaaaaggctccaactgtgccccgggagcttcccgtagctcaccggtaaaccggacgctggcaactgcatgattatcctgagtggtgatgtctagtaaggctgcattaacatgggtcacatcagtctgctgggtaacattaccgcgctcagtaatctgtttactgatttctgcaaacaattcaggtgttgtaaatgcgcgaatctcttctagatcaccggaatcatgcgccaattgcaacgtaatgaatgaacctttggcatttttaagaaaggaatccacgtcgaaaccagcaggaatatcgagagcatccgtattggcggcagactgaccaccgaccccggaagctactcctcccgaaggagttgccgtatcctgacgaggaaatggcattcctcccatactatgcccagctcccgcaccagaatattgcataggtcgcgctgcttgtccgcctccggaagatctgcgcatcatgcgtattccgaagaatatggcagctgctatgcctgccagcactagaatatccatcatattgattccgtcaaaagctccgcccataagcagtgacgccagcaatccaccagcagccaatccggccagtggccccagccatttgctaccccctgctgctgcagcgggtgctgcggattgcccggggcgctgggcttgctggggagtagtctgttgctgctgtcggttaaggttaagcgattggcgctgtttcccaaggctgctgccaccgcccagacgccgggcttcggcatccagtgctgtcagactaaaagcaagcaatgccaaagccagaaatgttaatattctcattatgcttatctccatgaatcaaaaatataatttaagggctgagtatagcatcatccccaatcgctctggactacccgtcggatggaaaagttcatgattacaagcatgacaggttatgcggcagcttccgcagaaattccgcaaggatcgctggctttggaactacgttcagtcaacaatcgctatcttgacctgcaattcaagcttcctgacgagtttcgtgtactggaacctgagatgcgggattttctaggtacaggcataacgcggggaaaagtagattgtcgccttactttttcaatctactcaggcacctcccgtcaccaacgacttaatcatgatctattgaataatctgctggcaatgagtcgtgacgtcaaatcaatctttcctgcagcgaatgatctttctgttgctgaaattttgcgctggcccggggtacttgatagcgatcggatttcagtcgatgaattgcgtcccccctgcatgacactgctgcagactgctttacaagaactggttttggctcgcaggcgtgaaggagaaaaactgcaaaacctgctactggaacgcgtacaacaattacgtcaactggtgctagatctgttacccagcctaccagccattctggctggttttcaggaaagattgctaaactgcttaaagacagctggtcttgatgaaaacgatgaacgtatccgccaggaattcaccttgtttgccaataaaattgatgtggatgaagaattatcgcgtctgcagggacacctgaatgaatttgaacatatcgtgctggctggtggcgttgtcggcaaacggcttgattttctgacccaggaacttaaccgggaagccaatacattggcatccaagtcagttgccagagaaatcactcgcatatccatagaaatgaaagttatgattgaacaactgcgcgaacagattcaaaacatagagtgatccaaaaagcacacctgctacaactttttcaatacatatttttctattctggaaaattctgaaaagtaatgcagagcagccagaatagatagtttatctgtaatttatcagtgatctaaatgtgccgatcaaggtgagcaaccagatcaacagcgcaaaccaacaccaataaaaggaaatagattcaagaaagtaataaccacttactttcgccagagagaaggtgcatacggtatacattcctgccggaaatactctgctccatgcttcgatatcataagcacgacacttccctttgcatgccaatcttgcccagggaaatatttttatccaggctgcggctgaatccaattcaacggtaaattttcgtatatccatacctagcaaataaggtatccataaagtaccaaatgcccacgcgaggaggctcatctccaacgtcacctgccctagatcatcacagagagagcggggtaagcgagtaaaaaattccgaaccagcaagagtgataatggcaggcgctcccatacaaatccagtaagacggctgccagttttccgggacaaagcaactaaagaacagccggcggataatcaaataaattacaaataaatataaaacgcaacccaatatccatatcccccagagcaccaggaagttccacgtattttcatccgttgcatcgagcagataactccccagcagcacgatcgacacagtacttacagtcagaagaagtgttgctccacagatgaaattgacagcactttctcgcggcaaccttaagatattaaaaataataaaaccgatcaatacaagccaggcaaaaaacgcactacaccaaagtacgtttgccagactatttgcctgagcgaacgagatcagttgcactccgaccgtattggttcctgccacgaaagccagaaacagccagctccgtgacaaaatacaaagttccaatagcagttcacgcgggaaaaatacgatccgtgcgacaaaaaacaggcaaaaaacagaataaagcgataaggtcagagcaaacaaagactttgctataaccgtgaaatcaagcacatcaaaggcaacagatacaataccggtagccatcaccatcacaaaccaggacgggtggaaaaccctgatgctgttgaagaataaaacgggataaaacagcatgtgtattatgaattcagttcgtttgtactaatttgtcatgccatcagcaaattatgacaggcatcctgcacaggaaaatgtggttacgaaaatatcgaaaataccaaatatttgctatcagaacacatacacagaaggtcttatacccacctcaattcccatacccttgataacaaatactcacccagatacaactgcaactgctcaataccagccctgcaatttatccacctgacatattgcccagaagaccataaacaggttcacagcgcagattgcctgagtttggtatcgagcagttgcaggcgtttaggggtgccgatgtccatccatatacctaagtgtttagtcccacggtgtgctggaatgggtcaaagataaaacgatctggctcatttttccagattttgcagatgtattcatagggtgttaggcctttgagagcttttagtcttttggcgaagttataagccatcacaaagcgatggagatgggccttcagctgatcgtgtgagtcgtaataataccgttttacagtcgcatccttgatggttcgattcatgcgttcaacctgaccattggtccagggatggttgggtttggtgagacggtgctcgatgccgttgatctgacaacacctatcgaacatatgcgttacatactgagccgttggcccattccgataacgcgccgggaacgtaaactggataccgttatcagtcaggattgtatggatcttgtagggaacagtctcgatcacggccttcaagaaggcggttgccgtgttgcggttggctttgttctggagttgaacaaaaacgaactttgatgtccggtcaatggctacaaaaagatagagtttaccttccttcgtacgaacttcggcaatatcaatatggaagtagccaattggataggcattaaactttttctttggcttgtcaccatcaacctccggcaaccgactgatgccatgccgttgaaagcagcgatgcaggcttgagcgggttaaatgcggaatgcttggttgcaaggcatatagacaatcatccagcggtagaagcgtatgtttgcgaaacgccacaacagcggcttcttcttccagacttaaaacagtcgagtgcgactctttggggcccatcggtgcatcgtgggtgaattcccgcttccgccacttcgctaccgtttttggattaatcccatgccgcttggccagaacattcagactctcttgactattttgtatcgctcgacgcaccgccgctgtcgtgcgggcgcttccgtgtaatatctgtcccataaatcatccctccgtagctggttatatgttacaccagcacaccgtgggactaaacacctaagtaatgtgagccggtaacttttccggcagtaatagcctggcgcagcaggggagccagtttttcagcttgattggggagcacatttttgaaaagggcgggatgataaaccccgatgccgctgaaagtgagttttcggcaatccggacaagttgattcaaccagtttgtcggaaccgttatgtagcgaaaaatcaccttctggatgatgtggcgggttatttaccaggatcaggtgagccaatatttgctctgaatttgattgcatctgttgcaaaatcggccacagggtggagaaatccatatcgcagaaaatatcagcgttgataactgcaaaaggctggtgtttatcggggttggtgagcagtggtagtgcattggtaattccgcctgcggtttccagtacgatggattccggtgaatattggatatggaggccatagcgtttgccatcctgcagtgcagcttcaatcatgtcgccaagataggcgtgattaatgacaacgctggaaaaacccgcctgtgccagtttctccagatgatattcgatcagcatttttccacccgcccgcagcaatggtttggggcaggtatcagtgagcggcttcatgcgttcccctttgccagctgccaggatcatgattttgaacatcaggtgtttctcggtcagaaagtataaccggttgcaggtgttttttcttccagttgatccagcagtcgggccagcggatgaagctcgccatagcgttcgcaggtttttcgtagatattgcatgactgcgggcatgtcttgcagataggcgtctttctgatcccgatagtacagccgggaaaaaattcccagcactttgagatggcgttgtacacccatccattcaaaatcccggtagaaaccggagaaatcggctgcaacgggtaatccgctccagcgtgcacgttcccagtaacggattatccagtccagtacctgtgcttcttcccagtggatgtaggcatctttgaacagggacaccagatcataagtgatgggaccaagaacggcatcctgaaagtcgatcacccccggattgggaacagataccatcagattgcggctatggtagtcgcggtgtacgaatacctgcggttgcgcaacggtattgtcgagaatcagattgaaagctgccctgagtgtgtttttctggtcatcattcggcgtaacgtgtaaatggcgcgtcatgtaccaatcaggaaaaagttccagctcgcgggaaagcaacgtctgatcatactcagggaagatatttttttggctggcgctttgtatcctgatcagtgcgtcaatggcatcctggtaaagctgattggcattttctggctccgtggtaagtgcttgcagataagtagtggtaccaagatcggataacagcaaaaagccttgatccagattttgtgcgacgatgtcgggcacatggatggatgccttcgcaaatacactggcggcatgcaagaaaggtcggcaatcttccagttgcggcggtgcatccatggcaatcagtgtttccctgggaaaagctacacgaaaatagcggcgaaaactggcatctgccgaggcaggcgacaaagtgaagggctgatcggggtagagggttttcagccagtactccagaagttgcagacggtccattaaaacttattggttgaaggtaggttaaggaatggataatgcagctgtatgctgtccgatagttcgggcaggagctgccgatttgtgtttgcctgttcgtttaaaatatgagattttatcccggaagccgataataaaactttgaaatttaatggagagaagaaatgctgaataaaaatgtactggatgaaatcggcagcaaggttaatgaaatcttagcgggcagcccggctaaagatatcgagaaaaatatgcgcgccatgttgatgggtattttttcccggctggatttggtcacgcgggaagaattcgatgtgcaacaggaagtgatcaagcgtacgcgtatcaggctggctgaattggaagagaaggtgaacaaactggagcagcaggcacatccatcaacaatggttgaaggtaccgtagaagatgtaatggatacttctggccccggatcggccaatgacaggtagtgctgagatttgttacattttttttggtgaagcactggctcaccatgctttgatcgtgttcctttatgtctctggctattctgtatagccgtgcattgtgtggagtggacgcgccgctagtgaccgtagaggtgcatcttgctaacggtttaccaaaatttactatcgttgggcttccggaaacggaagtcagggaaagtaaagacagggtgcgcgccgcactgcagaatggacgattcaaatttcctgcccggcgtattacggttaatcttgcaccggctgatttacccaaggaaagcgggcgtttcgatttgcctatcgcgctgggcatcttagcggcaaccgggcagattcctgcaaataaactcgatcagtatgaatgggcaggggagttgtctcttgatggtcgtctgcgcccgattcgtggcgcactggccatgacttacagtgcctcccgttcaggccgcagtttcgttttgccagagcaaaatgccggcgaagcagcactggtcaaagaggcgactatctatcctgctgcttcgctgctgcagttgtgtgcatatctgactgggcaggagccatggcaaccttatcgtggcggatcggctgagttagaatcaaatgattatccggacatgggagatgtcaaggggcagatgcaggccaggcgcgcgttggagatcgctgctgcaggtggacacagtgtgctgatgattggcccaccgggcacgggaaaaaccatgttagccaagcgtatcccgggaattttgccgcccatgaccggacaggaggcgctggaatcggctgccattcaatctttggggagtggcagttttgatctggctaactggaagcgtcgcccgtttcggtcaccccatcatactgcctcggccgtagcattggtgggtgggggcagtattccacgcccgggtgagatttcactggccatgcatggagtgctgtttcttgatgagttgcccgaatttgatcggcgggttctggaggtgctgcgtgaaccgcttgaatccggtcacattaccatttcacgcgctgcacgccgagcagattttccagccagatttcaacttattgctgcaatgaacccatgtccatgcgggtatttggggcattacaccaataaatgtcgttgtacacctgatcaggtagcgcgttatcgtggcaaggtttccggtccgttgctggatcgaatcgatattcagattgaagtccctgctttgccgaaggaggatatgttgcgccccgggccgggtgaatccagcgctgttattcgagaacgaacgttgattgcccggcaacgtcagttaaatcgtcaacacgtacccaacacgaggttaggggtgcaggaaattgaaaaatattgtgttctggatgcagaggggaagcgtatgctggaacgagccatgacccatttgaatatctcagcacgggcttatcacagaatactgaagctggctcgaaccattgcagatttgtcaggcagtaaacctattttgggaaagcatgtggcggaagctattcagtaccgccgtatgggtataaattaattgttcggacaggttgaatcagtaatagtcagcggtacgtgcacaattttcaaatcttgtaaattcgcccagaaaagtcagatcaactttgccaatcggcccgttacgctgcttgccgatgataatttcagcaatacccttgtcctgagtatctggattataaacttcatcccgataaataaacaaaataacatctgcatcctgctcgatagcgcctgattcacgcaaatcagacataatcggacgtttgttggggcgttgttcgaggccacgattcagctgcgacaaagcgattacaggaacctgcaattcttttgccagtgccttcagtgagcgtgaaatctctgaaatttcggcggcgcggctttcactgttgggcgaggttgatgacatgagttgcaggtagtcaataataatgagccccagcccttcatgctgacgatacaaacgccgagcgcgggcacgcagctccagagagttcagtgcagcactttcatcaataaatatcggcgcatcgttcagctttcccaatgcatgggtgagtctgggccagtcatcatcatccagttggcctgtgcgtactttgtgctgatccaatcgcccgattgagcccaacatacgcatggcaagctgtgcgcctcccatttccatactgaacactgccactggtttaccagcttccagtgcgacatgttctccgatattgagtgcaaaggcggttttccccatcgaaggtcgcccggcaacgatgatcaggtcaccggcttggaaaccagaagttttttgatcgagatcgctgaagccggatggaatgccggtaatatcgctgggattgctccggttatagagcatctcgattcgctcaactacttgcttgagcaatggttggatatcaacaaatccttgtttcccgtgcgcactttgttcagcgatttcaaatattctgctttctgcttcatccagcagatcacccgcagaacggcctgcaggattgtaagctgaatcagttatttgtgtgctgacttgcgccagcttgcgcatgattgaacgttcccgtacgatttccgcataacggcggatgttggctgcagacggagtattctgtgcaatggcaccgatataggctagcccacccgcgtgttgcagttgggccgcattttcaagagattctgcaacagttattacatctgccggcttactttgttctataagacggcagatgtgttggtaaatgagttgatgatcctggcgatagaaatcactctcgataatgatgtccgctactttgtcccatgcctgattatccagcatgagtccaccaaggacggattgttcagcctcgatggagtggggcgggagcttgtaaatactgttatcagcaaggttctgaataaagttggtagtggatggattcatgtgaattaatggtggctaatagccagggtcggatggtagtgtctgatggagaaacaaaaaaaggaccgggtagtcctttttttgtttggtctttacccagtgatgtcagtttgttgtttcgcctaacaccgatacagtaatatgagccgatacctcgttatgcagtacaacgataaccgtataatcacctacttgtttgatttgtccctcaggcatacgaatcatggatttttcaattgcaaaatcctgtttgcacaactcctcggcaatatttgcactggtgactgatccaaaaagtttgccatccacacctgctttctgggagatttgtatgagtagtccatccagttttgctgcctgtgcgcccgctgcatctaaaatatcggcttgtttcttttccagttccgcgcgttgtgtttcaaattcggctataaccctttcggttgctctctttgcttttccctgagggatcagataattgcgagcataccctggcttgacattcacaatactgcccagtgaaccaagcttgacgattttctctaacaaaattacttgcatgctgtttctcccgattgcttagtgctgatcagtatagggtaataacgccaggaaacgagcgcgttcgatagccaagtttaattgacgttgatagtatgaacgtgtacctgtaattcgagccggtataattctgccattctcgctgataaaatctttcagcagctcaacatctttatagtctatttttttaattccctcagctgtaaaccgacagaattttttgcgtttgaatagtggccgatttgccatccggtccttcatcttgttctttgcatctttgtttcttgagaatctcatattatttctccattaagagcgtctatatttggtatctattttcagataattctggcatcactaacatgcaaaacaagctggttacttaagcggtttttttttgtcatgaagccggtaagttcgacatgactgccagatcccatgcgaacaattttttcagccatgtctgccatggcgattgccgcaagttcaaattcaatcttgcgctggatgccagcttcctcctggctggaaacatggctcagtctaaactcggcaatcataataccgacaggcgtatagcgaggtgtattcagatcagcaatctttccaccgataattacctgattcaggttcggtggaaaccgcatatcaggattgggtatcgttttccccagctgctgctacttgtgcgccactagccgaatcatcggttacgttcactgtgggagccgaagtgcccttgctattttcatcgggtttcgatttgtcatcttgcatcataggggaaggggttgtaaccggtccattcatacgaataacaagatggcgaagaatggcgtcattaaatttaaagctgtgctccaattcattgagagattcttgatcgcattcaatattcattaaaatatagtgtgctttatgcagtttttgtatgggataagtgagttgtctgcgtccccagtcttccaatcgatgaattcctccagacctttcagtgatcatattactatagcgctcaatcatggcagatacctgctcgctttggtctgggtgaacaataaatataatttcgtaatgtctcataatttccttgtgggtaaagccttcttgcaacgttttcggtgtagaacggggaagtaaggcaagggatcagcttagaacttatgcatcgatgttgtatcgaatcgcattgataaacctgttgcttctgtgagtatttaaacaacagtttgataattctacttaatcagtgactaaacttcaaaaaaattagatttttcttttcctgagcatgtgcgagatttgcaaaatacgagtagaaagttttgatgtaaatgggtttaaggtacctctgtaccaataatcattgatccaaaagccatgatttatttaaattttcctgagattttatcaattttaggcacaaaatagcttttttttggctatttctgtttcaaaacgcactatcccattacggtgcaaatacgcctcaccatgcaatactattagacagagcggccaggcagaaagcggctctgattttttgccaaactgcgatagcgtagcttgcatcaccaaagcaaactttcatatcccggaacacagattccactttggcgcatatcccgctactttacgatgcaaggccaggagcggacgtgaaattttgcagttgctctcagcttttaattgcttgagtttccccaggacgtggtgcaataacgatggctttgattgaagcggtggcctctgtctgcatctccgggcacttttgcaagccctgatagccgatatcacccaggacaaccgtttcttcgccacacagcagtgttggcaccaaaatgtcatgggttgccttttttgcttgcttgagtacatttcagaatcacgtttgccttcagtactcctggtagaaggcggtgcggcaatcaggctggcaatctcatcaagcgcatcttccatgtccggatcagagtagttgtaggcaatttggacaatatgcacgcgcaacatacttttcaattgcagtggttgttcgccacggcgcccacttgtcgggcaatacggtttgatcaggacaacaagctctgaccagagaagcaaacgctcaatctgtacaaaaaatcactctcgccgcgtgaccttcttcttgtgggcttgttcaagaccactgaaactcatctggccacatgaggatgacaatagaaaaaagataaataacaaatcttatcaaaggatttatgcagagactccttagagatgtttagtcccacggtgtgctggtgtaacatataaccagctacggagggatgatttatgggacagatattacacggaagcgcccgcacgacagcggcggtgcgtcgagcgatacaaaatagtcaagagagtctgaatgttctggccaagcggcatgggattaatccaaaaacggtagcgaagtggcggaagcgggaattcacccacgatgcaccgatgggccccaaagagtcgcactcgactgttttaagtctggaagaagaagccgctgttgtggcgtttcgcaaacatacgcttctaccgctggatgattgtctatatgccttgcaaccaagcattccgcatttaacccgctcaagcctgcatcgctgctttcaacggcatggcatcagtcggttgccggaggttgatggtgacaagccaaagaaaaagtttaatgcctatccaattggctacttccatattgatattgccgaagttcgtacgaaggaaggtaaactctatctttttgtagccattgaccggacatcaaagttcgtttttgttcaactccagaacaaagccaaccgcaacacggcaaccgccttcttgaaggccgtgatcgagactgttccctacaagatccatacaatcctgactgataacggtatccagtttacgttcccggcgcgttatcggaatgggccaacggctcagtatgtaacgcatatgttcgataggtgttgtcagatcaacggcatcgagcaccgtctcaccaaacccaaccatccctggaccaatggtcaggttgaacgcatgaatcgaaccatcaaggatgcgactgtaaaacggtattattacgactcacacgatcagctgaaggcccatctccatcgctttgtgatagcttataacttcgccaaaagactaaaagctctcaaaggcctaacaccctatgaatacatctgcaaaatctggaaaaatgagccagatcgttttatctttgacccattccagcacaccgtgggactaaacacttagaacctgttcaaagtctttgggagtatgagaaactcggaagatgagaagaagttacccgagcgacatcagtcgtgaacaattcgagcttatcaagcctttgctggagagcgcgcgcaggaaggccagccctcgacgaatagatctgtacgaggttttttgtgcggtgctgtatttgctcaagagcggctgccagtggcgagccctgcctaatgactttcccaagtggcgcactgtccactcatactgggccatctggagtgagccgcgcgaaggaggcagcctgctggagcaggcattaaaaaaatcaggttggcgaggttcgtaccagacaggggcgcaacgcctgcacgtcattcttgatcgtagacgcgcagagcgtgaagaacacggacacggcgagccagaagggctatgacgcaggcaagaaggtatcgggcatcaagcgtcatatcgcggtcgatacccagggtttgccgcatgccattgcggtgacgacagcggaagtgaccgatcgcaaaggtgcgttgcaggctttccggcgttgtcgttcaggcctgggccgggtggtggcggtgttggcggacagcggttatgtgggagagccgtttgctcaaggtgtacgcgatgtgctgagcgagactgtcgcggttcagatcgccaggcgcagtgagttgcataccttcgccgttatccccaagcgttgggtagtggaacgcagctttgcctggttggagaagaatcgacggctgtggaagaactgtgagcgcttactcaacaccagcttgcagtttattcacctggccttcctggcccttctactcaaaagactttgaacagactcttagatgtttttagaacctgttcaaagaagtcttccaagacaagcaacctctcccttcagtgaatcaaggcagagcagattacctctgctccagtttgttctttacccctcgcttttgatcaaggtccccactccttcatcagtcagtatttcaagcaaaagggcatgttgtacacgtccgtcgatgatatggcaggatttgacaccattctttacggcatccagcgctgatttgattttgggcaacattccgccggagatggtgccatcggcaaatagttcatctactcggctggcagtcaggcctgtgagcagattgccatttttatccagtacaccaggtgtattggtcattaatatcagcttttcagctttgagtgtctccgccaggcgacctgcaacaagatcagcattgatattgtaggattcaccctcttcaccgacaccgataggggctattacaggaatgaagtcgcgagcgtccagtagcttgatcagcgagggatcgatatactctatttcgccaacctggccaatattgatccacttctcggcatcttctttgtctttgatcagcattcttttcgcgcgaataaacattccgtctttgccggtcagccctactgcttgaccaccatgacggttgataagattgacaatttctttgttgataagcccgccaagtatcatctcgacgatatccatagtttcggcatctgtaactcgcatcccttgtatgaagacgccttccttaccgacgcgcttcagcatgctgtctatttgcgggccgccgccatggacgatgaccgggttcatgccgaccaatttcagcaataccacatctttagcaaaactttgtttgagtatttcctcggtcatagcattgccgccgtatttgattacgatggttttattatggaagcgtcgtatgtatggcaatgcctcagcgaggatttcgactttttcgttaacagcatgggaagattgcatggtgaagagggattttattgtttatggtgaaatcggaatggagtacccgggacaatttaactgcttgcttgaaggaaggatttgagccgtactagtgcaggcaaattcagcttgcgccaaagtctgttctggcggtcattgtatacatcggcgatgacagaccgctcgtcctcatgatctggctggcgagtaaattccatcagatcccggataccaagaacactttcagccaatatggcatagccagttcccggatgggaatctgtcaaaaagacccgggttctcacattaatgcgggttgtcttcttatccaggtaatgagccagatcacataagccgtaaatattgccgcgtacattgataatgcccagaaaccatagatgtgtcagaaaaaccggtgttattttcgggaccggcaatatttcactgatggcatccattgggatcagccagcgatcttcaccaatcgtgactcccaatacagggatggagagtggaacttcctgagttttattattgatttgctcagtcagcatggtattcagcgtgatctgtttttaaatattaactcagtctggcaattttttgcagtaattctgcagccataactggcttggtaatataatcctgcgcaccttgccgcagcccccagattttatcggtttgctgatctttggttgtgcacaggatgataggaatatggcgagttgcactatcttgtgcaagcatgcgtgttgcttgatagccgttgatgccgggcattactacatccatcaaaaccagatcaggccaagtttctcgggccttggtaacgccttcctcaccactttcagccacacctacctgatacccgttttgggtcagtatgctggaaagaatgtggcgatctgtcggtgagtcatcgactaccaatatcgtcctgactatcatgcgagattctcaataaaatttgtatttgtttacacggtctccaaataaaaccgggcagaaatatcaattttgtattttaaggctttacccgcagacaataaagcacagcggttaatcatcagtataggttaaagcaatgttagactatacgctttgtattttcgtataattttgctgctcgttcaatgacttgtgcccgagcgttttcagacttttattttgggtacatagattaagtttattttacgtttaaatcattatgcaaaacactttcatcagattgatattgtgggtacaggctttattattccttctaccaggttgtgcgccaatgatcttaacaggcgtgggggttggtgcgggagccggagcgttaatggtagaagatcgccgtagtagtggaatgtacatagatgacgagggaattgaacttaaaaccaatcgcagaattggcgaacgattgggcgacagagtgcatgtcaatgtcaccagttttaaccgtaacgttttgctgactggtgaggcccccgatgaattcaccaaaaaagagattgagaaattggcaatgagcattgaaaacgtacaaaatatttccaatgaaattactattgctcccaagagctcgttatcttctcgcagtaatgatgcgttaattacttccaaggtaaaggcccgtttcattaataacaaggtgttccagatgaatcacataaaagttgttacagaaaacggtgtggtgtatttactggggctggttaccagaaaagagggggacaccgctacacgtattgccagtacgacggaaagtgtattaaaggtggttaaggtatttgaatatcttgattagtaagtaccttttcagaacatcttcaggcatcaataaatgctgcccgctgagtttattcagttactacagaatctgattccatccgaccgtctctatcttgatccggttgattgttacgcttacgcttacgataacagtaggaagtattttccgcctgagtgtgtcatttttcctttgacgactgatgaagtcgtgaagataatccagttatgtaatcgatttaagattcccttaacacctcgtgggagaggtaccggcactgctggcggcagtcttgctgagcaaggaggagcttcactttcattggaacgcatgacacggatcatatcgatcgacacggccaatcgagtactcgttgcagaaccgggcgttttaaatgaatctgtccaggcggctgtcaagccttctggttttttttggccacccgatccttccagtgctgctttttcaagtatcggcggaaatcttgccacctgtgcaggggggccacatgctgttaaatatggcacaacccgcgatcatgtattagggctgactgcagtaacaggacagggtgatattattaaaacggggtgctataccaccaagggtgttgtcgggtacgacctcacccggctgttgatcggatcagaaggtacacttgccgttataaccgaggcaacacttaagttaaccccgttacctgcggcaagaagcggacttgttgctcattatcagaatgctgtgagttgtgcatcagcgatagcaactattatgaaagagccgcaaggacccagcgcgcttgaatttctggattccggctcacttgatcttattcgttccaggaatcctggaatgttgccggacgattctcgtgccatgttgatgatagaagtcgatggtacagaacacgaaatttcggaaacaacaaccaggcttctagctgcttgccaaaattccgagttgttaaaggcattacctgtccaaaatgctgcggatttgtggaaggccagaaaaacgttatcacccttgctaagagatatcgcgccgaagaaaataaatgaggatattgtagtgcctgtcgataaaattccccgactgttaaccggattatcttcattatgtaagcaatatcagatacccaacgtaaattttggccatgctggcaatggaaatattcatgttaatctgctgattgatccggataatcctggagagagtgggcgcgcgtataaatgcctgaatcagatatttgatctggtgatcagccttaatggaacactttctggtgagcatggtatcggttctgaaaagcgaccttatatcaataaagaactcaatgaggctactttgactttaatgaagcagatcaaattaacatttgatccttgtaatatcttgaatccagggaaattatttccttgaatgtttttcagccagataaacaaaaaaaacagctcgataaaaattacatctttaccgggctgtttttttagagaattcgtttgtttctggtatcagaaataaaaatagtgatccaccaatagcgcggtaaacagcaacgccagataaattatagagtagcggaaagcctccctggcaatttggtcagtgtagtgcaagtagatcctgatagcgtaataaagaaatattgcatcaagaatcagcacacttacgagataaatcaagccactcatctgagtgagatagggcaaaactgtagcgatacaaagaatgattgtataaagtaatacatgcaggcgagtaaactcctcaccgtgtgttaccgggagcattggcatcccaatttttgcataatctgacttacggtaaagcgccagtgcccagaaatgtggaggtgtccaggcaaaaataatgaggaacaataacaaggcatcagctgagatttcccctgtaattgctgcccaccccaatacaggtggcatagcgccagacgcccccccaatgacgatattttgtggtgtgagtggtttgagtattacagtgtatataattgcataccctacaaatgtgccgagagttagccacatggtcaaagggtttatccattggtggagaatgaagagcccaagcccgccaaccattaccagaaagaacagcgtttcaggaacacttacttttccctggggtaagggtcgtccctttgttcgagccatgattgcatcaaacttatactcaaccaggcaattaagcgcggcagctgcgccggcaacaagtgatattccaatcgtacccaggagcaacttgtctaggggcaccgcgccagggaccgataaaaacataccaatcacagcagtgaaaacgattagagaaactactcgtggtttagtaagtcggtaaaactgctgaatacgcacagtcgcctgttgccagactaatggatttgttgacatcactcactccttatgaaactaattcatagttacagatgttatggcacctgtttgctttctttcactaatatgctatctgggaatcttcagctaatactcgggatgtgaaagttttagcaatcttttcaaatctccaatcatcttttttggatctggatccttgggatatctcatcattaaattccccatcggatcgataacatagatgtgatcatcctgtctgctcacaaaggggaattcatccaatagatttcttccctgtgcaagaaccaatctagtaccttcatatttatccattatttcaggattaggtttgatatcgtcattaattaaccatattcgctgaaccttatccttatcaacattctgagccaagcgaatttgtctcattatgtaaagtttttcctgacaatatccatcacactttcccgagtcaatcgtcaataaactccacgtgccttttaattgacgacttcggaagattgtgttgtctttgagatttgttgctgtcccctgtaatggtttgacttccagtaactcaccataatttacggtttggtccggacggaaatcccatcggtgcaagatggatgagattacgattggcgataatatcaccagtattaatataattagagtaagtcgactacgcgttactttttcgtttgacatttaatacaatgtagatgataaaagtcattgcggcgaatgagaaccactgaagagcgtaacctgtatttcttgaagaaccggaatccggatttccccattgcctaattaaaccatcgtctgttgcatcattttgctgcaatagtaacaaaggttgcaaggtaagaccggtcatgccttgataagtatccaggtcaaaattttgccaaacgttacctttaatatcatcgtctgaaagcgatagcgttttgattgatggtgatactacgattccgaggatatgaaccaatccttttggggtgcgaatattgggcaaaactgaccggtcattacctacagctacccagccccgattgaccaatatatctattgagctgttcgctaatcgtaggggcgtaagtacatgatagcccgcaattccctgatgaattttgttatcaagaaatatactccgctccggatcaaaatacccatcaacttcaactcgacgatataaataatcgtttagctttacaagtgattctggaattataacgggtggttgctgggcatagtattctataagagaaaaacgattatctttttcctctgctctggataattgccaaaaacccagtttcaaaaagacagcgatcgcaaatatagtaactattgttgaccatagcgatggcttgaattgttgtagaaaaccaggcatcagatagccttgtacacaaccatataaatttttaaggttcgattctttatctgacagaatcgaaccttttctccgttatttacttctacgagttacagtaaatagacaaatataaacaatgccaaccaaacaacgtcaacgaagtgccagtaccaggctaccccttcaaatccaaaatggtgttccggcgtaaaatggccgttcaaacttctgaagaagattgcgatcaacataattgtgccaaccgttacgtggaatccatggaatcccgttaacatgaagaaagttgatccatatgcaccactggtcatcttgaggttcagatcagcatatgcatgtccatattcatatatctggaaaccaaggaacgtgatacccaatgctatagtcgcaaataaccatagctttaaagcaccgcggtcattcttttttaatgcccaatgtgcgagagtgatagtgataccagaagtcagcaacaacgtcgtattgatggcagggattccccatgctcccataggggtaaatttctcatcaaatcccggcccggctgtaggccatcctccggcaaaatcaggccaaagcagctcctgtccggatccagccagccaaggtactgaaagaacacgcatataaaacaatgcaccaaaaaatgatgcaaagaacataacttcggagaaaataaaccatcccatactccatctgaaggatttatcttcttgaaccttatacttgcctgcttcactttcaagtgcaacttctcggaaccagccataaatcaggaaggcgagtatggccaacccagtgagcaacatgccatatccaagaggcaatttactcatagtaaatgccgccccaaacgccatgaaaaagagagccgctgttcctatgattggccacttggatggagagggtacataataacccgttccttgactcatataatcttcctcctcattattaaacttaacctgctacaagcccgactattgataattaatttaaaataaaactgcatgctatgcaaagttactgattattgttgaacttggtataaataaagccaaacaatctctgtaacttgaaatagaagagtaccacttaataatacctttatttgtgcacacccctgtttaattagctttaactttgaaaaaggtatatgaaattgtcgcggtatgaatatcgtcaggcatttctggatctatcagaaatctgactggtaattgcttggtctccttaccaccgagttcctgttgtgagaaacaaaaacactcaacttttttcaaatatctttcaaggtttttggggctgtaacttgggatagcctgcccaatttgaggctcttcagattcgttactgatttcatacataacttctgtaagtttgccaggatgtaaacgaatatgagattgcagtggcttaaatttccagggaagtccacgtatatttgcatctaactgtaaattgatctcccttgtaatatctactttgatctttttagatactgtgtccggacgttctagctcgtatataccggttacttcacagaatttcttgtatataggtacaagcgcgtaaccaaaaccaaacataaccacactaaaaataagtaatttttttaatatatctatgttgctggtcttggtcacgtcttgttttattcctatttagatacagcggttactataaaaactactattaccaagataactagaattgatgcagtacgtaattttctgcgttgtaattctgtatccttattttcagtcatttctatacctgcttatttaacgacaggtggtgtttcaaaactatggtatggagctggtgaaggcaaatgcgtccattccaaagtatgtgccccttcccatgttttatctgcagccttttctccaccacgtacacatttaataacaatgtatacaaatagcaactgtgtcaatccgaatccaaatgcaccaatactggaaatcatattgaagtcagcaaactggagtgcataatccggaattctacgaggcataccagctaatccaaggaaatgctgaacaaagaatgctacattaaagaaaatcattgacagccagaaatgccacttacccaatgtttcgttgtacatatgaccagtccattttggtaaccagtagtatgcacctgagaataatgcaaacaatgcccccgaaaccaacacgtaatggaagtgcgcaatgacatagtatgtatcttgtacttgcacatcgattgggactattgcgcaaacaacaccgctgaatccaccaataacgaacagaacgataaaccctattgaaaacaacatcggtgtttcaaaggtcaaagagcctcgccacatggttgcggtccagttaaagaccttaacgccggttggtacagcaatcaacatcgttgcgtacatgaagaacagttgtccagtaacaggcataccaacagtaaacatgtgatgcgcccatacaaagcaagataacaatgcaattgcggcaatcgcataaaccattgatgtataaccaaacaaaggtttacgtgaaaatgttgtaataacctcggaaaccacaccaaacgccggtaatatcatgatatatacctccgggtgtccgaagaaccagaagatgtgttgaaacataaccgggtcaccgccgccagcagcattgaagaagcttgtaccaaagttacgatctgtaaggaccattgtcacagctccagccaataccggcattactaatacaagtaggtatgcagtaattaaccagctccacacgaacattggcatcttcatcaatgtcatgcctggtgcgcgcatattcaagatggttgtaatgatgttgatagaacccataattgaagacattccaaagacatgcactgcaaacaacatcatgtccgtccccataccaccttgtgtggatagtggtgggtagaatgtccagccaccggccgctgccccgccgggcacaaaaaatgaagttattaataacaatgctgcaatcggcaacaaccagaaactccagttattcagacgagcaaaagccatatctggggcacctatcattaatggtatctgccaattcgcaaatcccacccacgctggcattacggcaccaaataccatgatcaggccatgcaatgtggtaaatgaattaaatacttcaggctccaatatctgaataccaggcataaaaagttctgctctgatacccatggccaaaaaaccaccaacaaacaacatagccagactaaaacacaaataaagcgttccgatatctttatggttggtagtggttagccaacgcattataccggtcggatgatcatgtgtatggccatgtacatcttgtattaccgccattatcttctccttttttaatctaatttgatctatatcccgactaaccgtatctggatatatcagtttttactcgcctcatttttaacgagcgctgtattcacaactgcagctgatgcggttttttgcctctccgcaacccactgactatatttttcctgttccattacttctacgactaccggcataaatccatgttccttgccacaaagctcagcacactggccacgatagatacctggcttttcgactttaaaccatgcatcacgaataaatccaggtatagcgtcttgctttacgccaagcgcaggtacccaccaagcatggatgacatcattggctgtcatgagtactctaattttcttgccagttggtactaccacacgattatccacttccagcaaataattttcccccttaggcgcctggttacggatctgatcctgagaagtagacaactgactgtaaaaactgattccctcaccttctccttgaatgtagtcatatccccacatccactgatatccggtggccttgatggtaatgtctgcttcacttgtatctttcattgcaataattgttttggttgctggccatgatattgcgattaagatcaatacaggaatagctgtccacaccagctcaacaaccgtgctgtgatgaaaatttgctgctttatagccaaccgatttacggtgcttgacaatggaataacccatcacaccgaatacaccgacaaatattatcagacagatccataaagccattatgtgctgatcatatatctcctgtgcaatcggagtctgtggttcaggcaggttatacttgcttgatatcgccagccctgaataagaaccaagaactacaaaacttgatagcaacgccatcaacttactacccttcatatcttaccccccacattaattaccaaatcaatttcagcagctcgcctgtgatcctgtagcatctccacgcctcacaattagctgctcataagaatatttgcctagccgtttagccgaaccaacaaacagaagcaggagccgagtgacgatttttttggggcaatcttagcatccagacgctgcttgcacaagaaggaagatgcatgatttttatagaaaaaatatccatgtaattatcatggatattgctctttttatcttcttgtatcccaataccctttgctgccttgagatattttttattttgtcattttgtatggagtttgttcgtctacaaatatagagaatttgataaataatttactaaaacccttgtgataaagtggatatatgcggcagcttgagaatcgaattgcaacttttgtctcctcaaggtagcctaagttgctcacattcatttaatttttagtgaagataaaggatatgcaatctgattccaaatatgcagttcctgtattcctgattcctgtattaaaggcattaagtccaaatatacgtaacaaggtgttgagaaatacttatttgatgcgtgcattaaccatgattccaaccatagctggctcagctattggcgttaatacagatttttcgttcttggcacaatctccaattatgggttcacatataatgctggccgcaatgattggtttaatgtttgctgtcagtgctacacgcaacagcattggaggcgtaattcttctttccttgtttacctttgttgccgggtggtggttgggccctttgcttcagtatgcgctacagtttaacaatggtacccagctgattggtcttgctgctgcaggaaccagtatcatttttttacattggcaagcgcggcaacggtaactcgtaaggatttcgggttccttggtaattttttgctggccggactgatattggttattttagcttctctggttaatttatttctggtaatcccggcaatttcactggctattccagctgtagcaatactggttttctctgggtttatcttgttcgatgtaagccggatcataaatggcggtgaaaccaactacgttatggcggcaccgggtatttatctcagtctatataatttgtttataataaatctggtgcagttattgcttgccttgctgggtgaagaggctgaagttaatagcttgatgaaaaacaaataaactgtcttcatcaattactgaagcgctgtttgttgagagggcgaggtttaccgcatgtgccaaaaataatctgtaagagttgtgtgggggcgtatgtgatcttgatttggccgtatcagcaatcatcagttcagctctgttaaaaattctggcaagcaggaactttgtttattttatcttttagtaagaggagttttttatgccaacgactattgttcatatcaagggaatgacttgtggagggtgtgtcagcagtgtcaaggccgtattagaaaagcttcccggggtaagcaatgttgaggtatctcttaataatggacaggcagtcgttcagcatgatggctcgtgcgaagatataatttttagccaggtaattgaaggcgccggatttgaagtggtcagacagcaactgtcataatgatatagaggtaattggctttcggtgttgcatgcccgctcgattcttttagacatcaatgagtgatataggttaatcctgtatcatcgcgctttttcacttctttcaatcttatcaatttgcatgaaaaacgtctttctggactttgaaaaaggcattgaggaatttgaggcaaaaatagagcaattgcgctttgcccaggataattctgcattggacatctcggctgaaatcactcgcttacaagcaaaaagccaaggactgaccaaaagtgtttatgcaaaactaacaccttggcagatttcacaagtggcacgtcatcctctacgcccgtccacgcttgattatataaaacatctatttacagattttgaagaattgcatggcgatagaaatttcgcggatgatcgggctattgttggtggactggcgcactttaacggtcagactgttatgctgattgggcaccagaaaggacacgataccaaggaaaaaatttatcgtaattttggcatgcccaagccggaggggtatcgcaaagcactccgactcatgcgtcttgcagaaaaattctcgattccactgatcacctttgttgatacaccaggcgcctatccaggtatagatgccgaagagcgtgggcaatctgaagctattggtaaaaatctttatgttatggcagggcttaggatccctattatttgtattattatcggcgaaggtggatcagggggggcactggctattgctgtgggtgataccagtctgatgctgcaatattcagtctattcagtaatctcgccggaagggtgtgcatctattttatggaaaagtgcggacaaggcatccgatgcagctgagatactgggtattactgccgaccgcctcaaagaaatggccctaatcgataccatcattcccgaacctgttggtggtgcacaccgtgactacccggctgtgatgcaatccgtcaggcaggcattgcaagaatcactacggaaattgcaggatattcctttggaaacattactgcagaaacgccttgatcggctgcttggatatggcagattcaaaatcaataaacccgattaatgatataaccagctgttttttccataatctgaatgcacaaatcaggcctggtgattgtctggtagttgctctgagtggtggcgtagattctgtggtattgctacacctgcttataaagttttccaaattaatgccactggatgtatctgcaattcatgttgaacatggtatcagcacatattcaggtcaatggagtgatttctgccaaacactttgcgacagtgttgctattcccttatcaattcatcgattaaagatcagcaagcagccacaggaaagcctggaagcgattgccagagaagctcgttatcaaatattcaggcaaattcaggcagattatgtcttgttggcgcaacatcaggatgatcaggttgagacattgctactgcagctattgcgtggtgcaggtgttaaagggctcagtgctatgccgacagtcagattatttgaatcaggcaaagccatcaaattactcagacccttacttaatgttccgcgctcagaaatcatgaaatatgcaaagttgcatggtttgtcatgggtaaccgatgaaagcaatctggatgtttcttatgaccgtaattttttacggcaccagattttacctttaatagaacagcgctacccttcttaccgcaagatattgtccagatctgcccgacatcttggtgaagcagctcatttactggatgaactggcaaaaatagatgcaaaaaatactatgattgtggataaattgagcttgcgagggctgcgtgagcttgatctcgcccgtgctaggaatttgctgcgttatttgttagcacagcaaatggtgcggttgccaagttccgcaaaactggaagagattttgcgtcagctgcacaacatacaagctgatacccattttcagttcgaagtagatgctttggaaattcgctgctaccgtggactaatcgaatttctgcctgctgattctttgtcggaatcaatatcgccggttatctggcaaggccagcaacgcttggctattgaaccaatgaaaggcatgcttgaatttactcggcaagacaacgcgggaattgacctggccaaactggatcagcagattgttacaatccgttcacgatccggtggagagcgattccagccagattgtaaacgtcctcgtcgcagcctgaaaaaaattctacaggaagcctcacttcctccgtggaagcgcaacacattaccgttacttttctgtggggatcagcttgtctgggtagctggaatcggcatcgactgtaactttcaggcaccgataggaggagccgggctagtggtaacatggcgccccgatcagaccaatcaatcttcaattcactgatatatgtcaacgatcttgattaccggcggcgccggttttataggaacaaatttcatactggattgggtcaagaatacggatgagaatatcgttaaccttgacaaattgacctacgctggaaatctgcataatcttgtttcactcaccaataatcctcagcatatctttgtgcagggagatatctgcgatagtgagagaatatccactctccttgaacgctatcaacctcgtgccattattcatatggcggcagaaagccatgtggatcgctctatccatgggcccgaatattttattcagaccaacatcaccggcacattccggttgctggaagcagctcgtcattactgggaaaatttgtctgtctcacgcaaggaaaatttccgattcctgcatgtttctacagatgaggttttcggcacattagccaaggatgctcctgcatttactgaaaatcactgctttcaacctaatagcccttattccgccagcaaggcctccagtgactgtcttgtccgtgcctaccaccatacttatggcctgccggtactgactacacattgttccaacaactatggggcatatcagtttcctgagaaactgattcctctgatgatcgtcaatgctctagcaggcaaaccactgcctgtttatggggatggccagcagatccgcgactggctttatgtaaatgatcactgccaagctattcgtgttgttctggaaaaaggacaaccaggggaaacctacaatattggaggctggaatgaaaaaagtaatcttgaaatcatacacaccatttgcgacgtacttcagcaatttcaacaaagggattatcgcgcactgatcactcatgtggctgatcgccccggccacgatcgtcgctatgcgatcaacgcacataaaatagaacgagaacttggctggaggccgctggaaacatttgagactggtatccgtaaaactattcaatggtatctggaaaatcatgactggattgcagaagtgcaatcgggcgactaccggaaatgggttgaaattaactataccgggcgatcacagtgaaaatattgctctttggtaaaaatggccaggtcggctgggagctacagcgtagcctggctccgttgggcaaattgattgcactggatcgacgggatttacactattgcggtgatctgacaaatctgacaggaatgacacatacactgcaggctattcgccctgacgttatcgtcaatgcagcagcgtataccgcggttgaccaggcagaaaatgagccagaactagcttttcgcatcaatgccgaggcgcctgaattactagcgcaactggctgaacaaattggtgcctggctgattcattattctaccgattatgtattcgatggtagtggtgagcgcccatggttggaaacagatccaactttacccgttaatatttatggccagagtaaattacggggtgaagaatcaatccagaaatcaaactgcaagcacctgattttacgcaccagttgggtctacgcagctcgcggaaagaatttcataagaaccattttgcgactcgcgcaagaaaaaaagcagctgacaattattgatgaccagatcggagcgcctacaggtgcggaactactggctgatgtaacagctcaggccattccacaattactgaggcatcctgaaaaatcaggtatctatcatgttacggctaatggagaagtttcctggtgcaactacgcacaatttttgctgaactttgcttgtgaacacaatcttccggtcaaagtccgcccaagtgcagtcattccgattcacagcaaggcttttgtaacgtctgccaaacgccctttaaattcgcgtttgaatacagataagttgcgcaatactttcaatctctatctcccacactggcaaaccggagtgactcgtatgctaagtgaaatttactcacagtaaaaccagcactcagcggataagccacgcaaatctggtatcggtcagtaaatctgttgcgacccgaccaaaccgcttggcaaagcgttctgtaatcccttcctgaacggtataatcaacgatacgttctgcctgaatcacttcgcgagcaacataatccatgctgcctaaggcatcggccagacccaactctatactcctagctcctgtccagaccataccgctaaaaatctcaggattgtctttcaagcgatctcctctgccattctgaacgacctggataaattgctgatgaatttcctccagcattttcttggcgtgttctctctgtccagggtcggaaggtgagaaaggatcaagaaaccccttgttttctccagctgtcaacaagcgacgctctatccccaatttttcaagcgtcccggtaaatccgaatccatccatgagtacgccaattgatcctatgatactggccttatctacgaaaattttgtccgctgcaacagcgatgtaataacctcccgaagcgcaaatatcttcaactacggcatataagggaatatcaggatgttgtgtacgcaaccgatgaatttcatcgttaatagagccagcctgaaccgggctgccaccagggctattaatccgtaatatcacagcagctgtatttttatcttcaaatgcttttttcagtccggtattaatattttctgcgctgtttaaaccatccgaagtaatttcaccgcgcaaatcaaccagtgcagtgtgcttgccaaaaccacctgttgcttcggtatctaaccaacctagcccccaaaaaagtagcgtaaataaataagaaaaggttagcaaacggaaaaaaataccccagttgcgtgcttttttctgctccttcagagaggaaaacaccaaatctcgcagtgtttctctctcccatttttccttgttggtattttctgtatcagccataaatattagtcactcgccccggtcaacttattgaactgatccaccctgtgtttccgaaacgtagatctctaccctgcgatttcttgctcgacctgcggcggtattattcgaagcaaccggctgatacgagccgcggccatcaatctggattctctgaaaaggaacgccacgacctgccaggtattcacgcgtactggccgcacgatttacggatagagggttgttgactgcatcgctaccagtattgtcagtgtgcccgacaatggttacgtgagtgccgggattattcaataaactagttgcaaaactgtccaaaattggacgaaaacctggtttgatctgggcactccctgtatcaaatgaaatatcactggggatgttcaacatcaatcgattatccgctgtttgcgacaccatcacacctgtaccggcagtggcattttccatctgaattttttgctcttccattctttttgaccacaaataaccggcaccagctcctaatgcagcaccagcaccggcaccaatcgcggcaccttttccacctccggccaatgctcctattgctgcgcctgtgcctgcgccaagcaatgcacctgtgccggatccccgctgggttgcggtcatgtcggcacatccagaaacaataaatccaaccaaagatgctgttattactattgctttatacataaatccacctctctttttgaaagaaaatctagttgtactgtaacagaagtaattggaaaaataattaactatcattttttctttcagcctggttatttgactcggaattactaaaataaaaccaccagtttgagatcctcactaaatatctaggctattatccggaatggtacagtccaggtaaaaaaaactgtatttggaaagacatctatttttcaaaattgtgatcgttgatctgtatatccaccgatagactctgaatccagccggacagattgtctttagtttgtacatgaagccaattaccgtggtaggaagtggcggttagaggtgtattttttttcagtaagctgatcaccttggagtggctgtctggatctgttcgcaggctgctgtcctgggtgacaagcaagagaattggggcgtgaaaagataatacagcatcttgtgactccagatttcttcttgctgaattgcttatagcatcaataaattcgccagattgtgctgcgtgattcattgcgttgctgtaatctttttgtctgtaggcttccatcgccgcatccagcgagcgttgtgccagggattggaaagcaatatctgcttcactttgcctggtttgtttgagcgcagccatggccacctcaacctcagctatttttgaggcagtttctggttgtgtagccaatctgtgcagcttgtgcttggcacgactgatttcactggcggtttcctgcaaagcctgcacttgatccagctcgcggacatttagattcctgatgagctcgtctcttgctgcaagcgtctgtttcaaaaaaataatttcatcttgatacagtcggtgacaaggtaatttttctgggatcggaataatttccattttctctgttttttctgcattcgctgatttaagattaataaattgtcttgatacaagaggtttttgctgcaaataagatgcacaccctcccagccccgatcccacggatatcagaattaatacagttagtaattgtttgtcttgggattgacaaaaccttggcatctttgcttaatctctttaaattaatatataacgaaaagcgctgatgaacccatttatttaaatcggctatctgaagttaaactttagcgagaaaatagaaaatatttttgacccgaatattatttacataaagtttgccgtgttttttcagtcaacacatcaatttttatcattattctaatttttaaccactacagcttgaaatgcgccatcagataattcgctggatattaatccagcttgtctcggtattggtaattgttactgctgtaattatcatactgggcgagattgtgactggatcggcacctactgccgtggagaccttgctcccggatttcccggtggaagcgatccagatccctgtgaataatgattatgttgtacatggctggctggcacgtgggataaacgggcatggtgccgttttgcttgtacactcgatgcgcagtaaccggcttgaaatgctgggtcgtgcgagatttctcaatagcctaggctaccatatactcatgatcgacctgcaggcacacggagagacgccgggggatcgcatcaccttcggcgcgcgtgagtcagcagatgtcgctgctgcagtaacctatctccgggacacttttccgcatgattgcatcggcgccattggcgcaacacttggcgcagcagctattgtgctggctgatcctccgttgaaactcaatgccatgatactagaatcattacatcccactttcacggaagcagttgcaaatcggcttagattgcatttaggtgaatttggggaaagccttcagtttctgctgcttccttatttttcctttttgcttgagctgccggtggataacttaaatcccgtcgaacggattggtaacctcgccgttcccgtgctgttcatcacgggaacgcttgacgaacatacaactcagtctgaagcaagaaggctgtacgacgcagcgctgcctcccaaggagctctggattgtcgagggtgcgggtcactataatatgcatacctatgcaggtgaaagttacgaagaacatatcgctgattttctttcgatttatctgcaaagacgataattcttagaacctgttcaaacgctttttggcaggattaccagaaatgccaaatgaatgaactgcaagctggtattgagcaatctctcacagtttttccacagccgccgattcttttctagccacacgaaactacgtcccataatccatatggccttagaacctgctgctgcagcccctgtttgcaacgacgcagccgccagcaaagctcccttacggcctgtcacctcagtcatagtgactgctgcggttgcatggggtaattcctgctgggtatctaccgcaatgtggcgttgaatccccgaaactctcttacccgcgtcataaccctttaaccgtgctgtgtcggtatttttgacactttgcgcgtccacaatcaagaacatgttgctagcggtgcgacccggcttctctccggcgacgccaacctgattttttaaagcctgctctagcagagctgccaccttcgcgtaattcactccagatggaaaagtacgggtgtacttgcgccatttgggaaatttttcgagcagcatgcgccattggcaggcactcctaaataaatacagagcaccgctctaaatacttcagacaagtctatgcgtctgagataggtcttccagtgcaagcgctccagcaacagcttgataatttcaaattgttcacgactgatgtcgctcggataatttttctcatgccgcaagcttctcatacttcccgaaacttcgaacaggttctgagatcatctggacagcttgtcgatttttcttacatggcgctcaaagtagtaagggtcattccattattacttaatttaaatcagatagatgcgattaatggcacaaaaattgcatcgttaatgcatgaggtattaattcctcaatattgttgcgataacagcaaagacaaatccaggcacctcatcagaacactaccaggttatttcagtgttgctgtggtgcctgtcgaagccgacaggctgccggtaaataccggaagggtcagcagcagggcattaaaaatgctttatcgatatttattgtatttttacggaaattctgaaatgaagaaaacaattaccagaatagtctgtgccggaatatttctggctgctgcactggccctcggacaaaaaatgtttatggagaatcaaatcactgctagcaatcaggctgacgctcgcaccgatctcactgccagtgagatcggtgatggctatagcagaaacaggttaagtgcccataatagtgtgggaataaccaatattggtgacagcatcggcagctctgctgttgaaagtaacactactgcctttactagtactggtgaagattctgtccataagaatgaagatgacgttatcggcgacgattataccaataacatatatcacgctgaagacggtaaaaaaactacgggtcattccggccgcaacaacaataactctaaccatgccagttcaggcacaagtgcgggcattggagcaggtattggccgcagaacagcagattcacctccaggaagcggtggcagcttttttccaggtgggggtggtataggtggaggtgctgctccccatactgggaaagatggaaaaaatacgggcagcaatgacaatgccaacaaagaatactctggtaacgctgctggcacgagtaccggtgcaaatccgaatcaggacaatactgcagataaaaacaactctgaccaaggtagcgcgcccaataataacaagggcaatccaccgccaaatataagggatttgaatccagagcacaaagataaggataattcagaacaaggtgataggcctagtgacaatgatcacgatgacaagccgatcggtttcagctcgccagatacagagactccaaaatattacgatggccctcccggcagtgagccgtatgatccctcccagccgcacacccccactgcaggaaatgatcatccgagttacatcgataaaggaatgtctggagaagctggcgaaactgcagctagacctatccccgagcctgtcagcatttttctgatcgggctgggcagtatgatattgctatgggcgcgccgacgcagtacctgaaactgatttagccatgccaatattcaaataccggtagatatgcatcagacatatctgccgggtcaatgacacaaatctgcttgaaagatatgtcatactccttctttactttactctgtttcggaggagtgttttttcgtggccagctatgaattcctgatcggcttacgctacacacgcgccaagcgccgcaatcattttatttcctttatttcactgatctcattactagggatgacactgggtatgacggcactgatcaccgtcatgtcggtcatgaatggcttccataaggaagtgcgcgcccgaattcttggcgttgcatcacatgcccagattagtagctatgaagggagcctgtacgattgggaaaaaattgaggaaatcgtcactcggaatccgcagattgtcgcggctgcgccttacattgatgcacagggcatgctttcccacgacaatatggtgcacggggtaatggtacgaggtattttgccggatgatgaaaacaaagttgctgattttggcgataaaatgatcataggcaaactggatcagctggtaccaggagggttcggtatcgttattggccgggagctggcacgcaatctgaatgtttttccaggtgacaaaatcgtgctgatctcgccccaagggcaaatcacaccagccgggatactcccacgcctgaaacagttcactgtcacaggtatttttgaagtcggacactttgaatacgattccgggctggcattgatccatctatcagatgcacaaaagctttaccgcatggcacctaatcaggtttccggcatccggctcaaactgcacgatatgtttgacgcaccacaagtcatccgggatctggccgagatattaccccccgatctctatttcaccgactggacacaacaacacgccaactatttccgggcgatccagattgaaaaacgtatgctatcgctgattcttgcgttaatcatcgcagtggcagcattcaatattgtttccacgctagtgatggcggtgaccgataaacaatcggatatcgcaatcttgcgtacactgggagcaagctctggcagcatcatgaaaatattcatcatccagggtgcactgatcggtattctgggaactttgctgggattactggggggcgtgttactggcctataatgtgggggacgttgttgcattcatcgaacatatgtccaacactcagtttttatcgcaggaagtctattacatcagcaaaattccttctgatccacaattggccgatattgcaaccgttgcggttgtttccctgattttgaccttgctggccacgctctatcccagctaccgggcatcaaaagtcaatccggccgaggcattgcgctatgagtaaaatcatcattgcctgtcacaacttgtataaaagttactatcagggtgatcttgaagtacctgtgctgcacggtatcaatctacaagtaaatgaaggtgaaatggttgccattgtgggtgcttccggctcgggaaagagtaccttgctacatttgcttggcggcctggataagccaacgcgcggggaagtacttttgctggatagggaattcaccgcgattagcgaagcagaacgaagcacgctacgcaaccatgcactcggtttcatttatcaatttcatcatctgctacccgaattcagcgcacaggaaaatgtagccatgccgctgttcatccgccgcatggacaaaaaagcagcaatggaacaggcagccgagatactgcagcgagtgggtctgggccatcggctaacccatactcccggggaattgtctgggggcgaacgccagcgagcagctgttgcccgtgcactggttacccggccggcctgtgtactggctgatgaaccaactggcaatctcgatcggcacacagccggggcggtatttgatctcatgctggaacttaactacgaagccaatgcaggactggtgatcgtcacccatgatactcaactggctagccgggcagatcgagtattacatttggtggatggtacgctgcaataatagaatcaatctgcagtaattcttacgtcaatcctgtgttttcctcgctttttcgtcgagtgagcgtaaataagcgagcttctcgcttattctgatttccagaccatgagcagtaggccggtagaactgaacagcggacatatcatcggggaaatagttttcaccggcagcataagattccggctcatcatgggcatagcggtactcacgcccataacccagctctttcattaacttggcaggtgcattacgtaaatggaccggaacaggatgagagctattctcttttatgaagctccgcgcctgtttataagcagtgtaggcagcattgcttttcggcgcacaagccagataaagtgcagcttcggccaatgccaattcaccttcggggctgcccagccgctcaaatacctcacaggcattcagtgccagcgttaatgcacgcggatccgccagcccgatatcttcggcagccgtgcgaaccagtcttctgccaatatagcgtggatcagcaccgccatcgagcatgcggcacagccagtacagtgcagcatcgggagaagagccgcgaatagatttatgtagcgccgaaatctgatcgtaaaacgcatcccctcctttatcgaattggcgtacattgcgcatcagcactctgtttaaataagcaatatcaatttttacagttttttcagtatctgcggcatgctttacctgctccagcatgttcagcaggcggcgcgcatcaccatctgcaaatttaaccaataattcaacagcgtctggatcaaactgtaaattggagatcacgatcttgcaggctcgttcaaacagctgatgcaactccgggtcagtcaatgcattcagtgtgtatacctgggcacgggacaacaacgcgccgttgacttcaaacgaagggttttcggtggttgcaccgatgaacgtaatcaatccctgttccacatggggcaaaaaggcatcctgctgagccttgttgaatcggtggacttcatccacaaacaacaatgtcgatctgccagtatgctgcaacgtaaaccgagcacgctcgattgcttcccgaatatccttaacacccgacaatactgcagaaatagcgataaactcggtatcaaatgcctgtgccatgagtcgcgctagcgtggttttgccactgccaggcggcccccagagaatcatggaatgtggtttgccagatataaaagcaagtcgcagaggcttgccggaacccaacagatgaggttgtccgataacatcatccaaggtctgcgggcgcaacctttctgccagcggagctgctggattatgcgtagaacaagaatcagtcactgatcacgtccaccccttcaggcggcgtaaactggaataaatcaggcgtgagtactggattttgttctgtcccggaaaaaatcaaccatgtcacctgatcaaaactgtcgcgcaaaatcatttcgcgcagcatgcctgtttgtgagaagcccagccggatcagctcaaatgcgctttcctgatttttgggaattgcctccagccattctgtttcgccctgcacatcgatttcctgcagattaaaatcacgttcgatggtattacctcctgcgagcagtgcagccggggtgctacccaaagtttgatcaagccgatgtactgtaacctgtgcaaggtcctgatcataaaaccacacctgcttaccatcaccgacaatcagctgctgatagggctggtcgtatacccagcgaaatttaccagggcgctcaaacatcatgctgccactggcttttttaacgacctggaagtttttgtcgagtagtgtctgtgaaaaatcggcccggaaggtcagcgctttattgacgaaagctttcaggctctcaacggcacttgcctttgctgacacgggtaacagacagattgataacgcgaaaacgaacagtaaacgggacatgataaattatctgtttaagttgattgatcggaaacgaaactgtatgaaccagattttacttattcatttcgctcgggaaccagtacttcccggttaccattactttgcatgctggaaacgagaccggtacgctccatttcttcaatcaaccgggcagcacggttatacccaatacgcaactgccgttgcaccagtgaaatcgaggcacgacgggatttgatcacgatgccgactgcttcgtcatagagcgggtccgcttctccaccagcagatttgctgttatcaccgctattttcatcagtgcctcctccctcctcaccagcctgaagaatttcctcaacgtagttcgcctcaccatgctgtttaaggtattccaccaccttgtgcacttcatgatctgccacaaatgcaccatgtacacgctgggggtagccgctgccaggtggaagataaagcatgtcaccttgtccaagcagcgcttctgcccccatttgatcaagaatggtccgggaatcaatcttactggaaacctggaatgcgatacgtgttgggatattggccttgatcaaccccgtaatcacatccaccgacgggcgttgtgtcgcaagtagcaaatggataccggcagcgcgtgctttctgggcaagccgtgcaatcagcttctcgactttcttacccacaatcatcatcagatcagcaagctcatcgatcaccaccacgatcaaaggcatttcttccagcagttcgggagaatcgggtaccgagctgagcggattggtcagcggctcctcattctttgccgcttctcgcactttctggttgtaaccggccaggttgcgcacgcccagagccgacatcaacttgtagcgtcgctccatttcagcaacgcaccagttgagcgcactggcagcatcacgcatatcggtaactactggggtcaacaaatgcggaataccttcatagacggataattccagcattttcgggtcaatcaaaatcaggcggatattatccggtgaagctttgtagaccaggcttagaatgacagcgttgatcgcgacagatttgccggaaccggtcgtaccagccaccagggcatgcggcattttggccagatcagacaccacggggcgcccactgatatccttgccaagcgcaattgtcagaggagacgagttatccgcatagactttggatgcaagaatctcatgcaggcgaaccatctggcgtttcggattggggatttccagtcccatgacggttttacccggaattgtttccacaacacgaatactggcgaccgtcaaggcacgcgccagatccctgactagattgacgatctgattacctttgacgccaacagccggttcgatttcataacgtgtaatgaccgggccagggtaggcagctaccaccttgacttccacaccaaactccatcagcctgcgttcaattaggcgcgaggtatattccagtttgtcactggataatacttcaacgttatcctgcggttcatccagcaaataaagcggagggagaatcgcatcgggtgaattggaaaacaacggaatctgtttttccttgttgctgacccgctgagatttgggaatagcagtttcaggcatttcaatatgcagcggaacgaggggaagggattgcttcctgatctcgccagtctgaaactccgacgcaccggacaaaacccttccagcccgctgatccagccacctcacacatgcatccctgacagaaaaacaggcggcctcgactgcaccaccgattttttcggacaggcgcacccatgacagtccggaaaacaaactgagcccgattgcaaaaataatcatcagggccagtgtcgcgccggtaaaaccgagcaataacgatagctgtttgctgagcatttctcccagcaggccgccgggagccagcggaagtgacaggcgcaacgtatgaaaacgcagcgcctcaattccactactggcggtcagtaaagtgataaatcctgtaaaggacagcatgagtacacgcggatcatatacgctggcaatatcaatgcgacgataaccccaccagacagtggcgaaaaaaaatattacccaccaccatgctgaaataccgaaaaaataaagcatcatatctgccagccatgcaccggcactaccccctgcattactgatctgctggaatgtgccgctatgcgaccagcctggatcggtacgatcaaagctgatcaaaatcagggtgagataaagtgcgattccacccaacaccagagaaactgcttcacgtaacaatcggctggttctgggtggcaaaggattgctggcaatttttttcgccatcggtttgtccgtgaaactcatgtatacatcatctttaacttcaaaattcaggccggttcacaaaaccagctgtgtttttatgtgccacagaaaaaactacaccgctatgagaacgattttctgaatgttttaagcggcgccagtatagatgatcgtgggtggttttatgacttgtctgtataccatctgctcctggggatcggatcaaggtttattcaattccgaatacaaaaaattaatttttggcagccttgagcaattcaataatgtcaggaagtttagcaatatccagcacagttttgtcagtggcagttttaagttgcgtatctgcccctttttccagcagcaatttgactgtatcgatattttcattcaatacggccgacatcagtgcagtcattccatccttgttttgaaaatcgatatgagcacctttatccaacagcgcttcgataacctgattttgaccattctgcgccgccaagatcagtgcggtaaagtcattggaagctttcagatccggttgcgcaccctgatcgagcaatttctggacaattgctaaatgaccggataatgaagccagaatcaatgcagaagccccgttggcatcctgcaggtcaattttggcgccctttgccagcagcatgtcaacgatatccgcataatcgttcattgcagccatatgtaatgccgtagtcttggcgtcgttttgcaaatctggttgagcctggtgatcaagcagggatttggctataccggcataacctttcacggccgctaacatcagaggcgtcagtccgcttttatcctgcaaattgggattggcaccctttgccagcaacaaatcaacaatctcctggtgattatttttactggccagtagcagagcagttcctccctggacattggccaggtcaactgcagcctttcgttccagcagtagcttgacaacatcctgatggccattctgtgccgcaactgataatgcagtaaaaccctcgggggattgcagatctattttgatgccttcgctcaacattttctccacacctgcgacatctcccgtcaaagccgccttaagaaactctacgtccttgtcagtatcagcatacgcatgtgggattgacaggagaaggaataaagctgcaatgcctgccaagcaggattgtttcaatacggcagaaaataatatgttttccgttgatttcatttgaatgttggtattttttataaagaaataggttctgttgataaataagccaaggttgcttttcagaggatggttgttcaataggttctcgctttgggcgggaaagattcaacggtcagcggctttagtcgtaccggtttatagtccaggtgtttatccttactgaaaaacagagagtgcttgagccatttctggtcatcccgctcgggaaaatcatcacgagcatgcgctccccgactttcatggcgtgcttccgctgaaatcatggtagctacagctacttcaatcaagttatccaactcaagcgcttccactctggcggtattgaacaccctgcttttgtcctgaatttcagtgtacttaacccgttcggcgatttcgttaattttttccacaccctctttcaatacgtcagaaaagcggaagacaccacaatgcgtctgcatagttttacgcagtgccgcattcgttgcagcaacactttctccattcttctgggtttccagacgtgaaagccttgtcagtgtttgttctgctacatcctgtggcaatgatttgtgatgactatttttggtcagatcttcaataatttgattaccggcagcacgtccaaacacgacaatatccagcagcgaattcgtacccagccggtttgcaccatgtactgacacacaggcgcattcgccgaccgcataaagccccggcacggcttcttccggactggttttatagggagcgaccacctggccatgataattagtgggaataccccccatcatgtagtgcgcagtcgggacaaccggaatgggtgcctcaataggatcgatatgcgcaaatctgagcgatatttcccggatgccgggaagtttggattggatggtttctgcacctagatgatccagctttaacagcaagtgatcaccatccggaccgcatcctctgccttgcataatctccgtaaccagcgcacgcgatacaacatcccggctggccagatccttggcatggggtgcataacgctccataaaacgttcaccctcagcattcagcagatagccaccttctccgcgcaccgcctcactgatcagcatgcctgcaccatacacacctgttgggtgaaactgccagaattccatgtcttccagtggaatacctgcacgcgcagccattcctaagccatcgcccgtattaatgagcgcattggtactggcctcaaaaatgcgacaagctcctcccgtggccagtagcgttgcacgagcctgcaagatcatgatttcaccagtttccatttccagtgccgtgattcccagcacttcgccttcatgatcgcggatcagatccagccccaaccattccacgaaaaactgagtgttggagctgacattacgctgatacagagtatgtagcatggcatggccagtacgatcagcaactgcacaggaacggctggcctgctcttcaccaaagtgtagggattgcccgccaaacgggcgttgatagattttaccattcgccaatctgtcaaatggcattccgaaatgttccagctcatatacaacttcggaagcgtggcgacacataaattcaatcgcatcctggtcgccgagataatccgaacccttgacggtatcatacatgtgccaccgccagtcatcttcagttatattgcccaatgctgcggcaatccccccttgtgctgccacggtatgtgaccgggtcgggaaaaccttggataaaaccgcaaccttgaatccagcctcggacaactgcaatgcggcacgcatacctgctccgcccgcgccgacaatgaccacatcaaatttcctttgtttaactttcacgtcagccccacaaaatatccaagaaccatatcagatagcccaataatgccacgatacacatgacttgcagtgtcagacgaataaacatcgggtgaacataatccatcaggacattgcgcacgcccacccaagcatgccagcatagaccggcaaaacaaagcaatgaagcaatttttacccactgaatggaaaatagcgatttaaattcttcgtaaccttcaggttggtaaacaaccacaagcacaatcagtaatccggtatagaccgccattattacagcggtaactcgctgcacaagccagtcccttaaaccataatgtgccccggttataatacggcttacaggttttaccataaccatatccccgccaatactgttaaaatcgccccgaaaatcagcaccagtttgctactcaggcgagcgtgctgtaattgcaagccgtaatgcatatcaagccccagatgacgaataccggcaaacagatgatgtaggaaaaaccaggttgcaaacagcagaaacagcctgctcagcggatgaattagaattgattgcaagcgggcaaaactctccggtgattccaacatcatttgcagcccgcagagaaataacgggattcccggaaaaaaaagcaatacgccgctaatgcgatgcagaatggaaacgatggcgggaagaggttctctgattttaaacaggttcagatacttggggcgtcgtctcgccggatattgagtttccataaataaccaatcagaccagataaatttatcggtgggtggataaccccaacagctactcaagttttctagtttaatccgttccatgccagcagacaacttaacctgtcagctggaaatttacctttgccagagctggtgtgcgcattgtttcgatatatcaatactgttaaaatcacctcccatgactaaatttgtctttgtgactggtggtgtggtgtcttccctgggcaagggaattgctgccgcttctctggcagccttgcttgaaactcgtggtatccgggtaaccatactcaagctggatccttatatcaatgttgatcccgggactatgaatccgtttcagcacggagaggtgtttgtaacagatgacggtgctgaaaccgatctggatctgggacattacgaacgtttcattagtaccaaaatgacccggcgcaataatttcactaccgggcagatttatgaaagtgtaattcgcaaggaacgtcgcggagattatcttggcgggactgtgcaggtgattccgcacattacggatgaaatcaaactgtttattcgcaacggtgtttccgatgcacaagttgcaattgtagaaattggcggcacagttggcgacattgagtctttgccgtttctggaagcaatccggcaaatgtcagtccagctcccgcatcacgatacctgcttcattcacctgacactcctgccttacatcagctcggccggcgaacttaaaaccaaacctactcagcactcggtcaaggagctccgtgaaatcggtattcagccggatgtgttgctttgccgctccgatcgcccgcttccactggacgagcggcgaaaaatcgcactgtttaccaatgttcgcgaggaatcggttatttccgccattgatgtagataatatctacaaaattccggcactattacacgaacaaatgctggatgaaattgtgtgtcacagactgggtatcctggcaaaaccagccaatctgacaacctggaaaaaattgatccacgcactggaacatccggaacatgaagtttctatagcgttagtcggaaaatatgttgatctgaccgaatcgtataagtcgctgtcggaagcattgatccatgcggggatccatacacgctgcaaaataaatattcattacatcgattcggaaaatatcgaacgacatggaaccgactgcctggcaaacatggatgcaatcctggtgcccgggggatttggtaaacgcggggtggaaggtaaaatcatggcaatcagccatgcccgcaatcatcagattccttatctaggcatctgcctcggaatgcagcttgcagtcattgaatttgcccgcaattgcctgtggcttgaaaatgctcacagcactgaattcaacccggatacaccctatcctgttctcggtttgatcactgaatggcgtgatcgtcgcggacaaatcgagaaacgttccccccagacggatctgggaggaaccatgcgcctgggagggcaggaatgtctgctgaaaccacacaccctggcacgcaaaatctatggaacagataaaattattgagcgtcaccggcatcgctatgaggttaatgccgagtttattccgcagctggaacaagccggcctgcaggtaagcggcctatctgctgctgaaaatctttgtgagatgattgagttaccacaatccagacacccttggtttgttgcttgtcagtttcacccggagttcacctctacccccagagacggccaccctctatttaacgactatgtccgggctgccatcagttttgccgataaatccggccacacaaaacttcgtgaccataacatgcagaaaaatgtcgcaacagacagtacacactgattcatcaaaggaaatggcttcatgaatattttattttgacacccccttttatcttaaatagataagcagcaataacccatcaaccttattctccagttgaatgaaacagcctgtttccgacagtaaacaagataagtaaaataagcgcgattatgctgtcattttgtgaaatctcaaaaagtcatgaagtacgtcataataacaatgctcccggaacatatagcagcaaggtagtttgtatattctaaaaattctcccatcactaatgaataacacaaggaaagcagcatgagtgcaatcgtagatgtaatcgcccgtgaaattatcgattctcgcggcaacccgaccatagaggccgatgtattgctagaatcgggtgtgctcgggcgtgcttcagtgccatccggtgcatctgtcgggacacgagaggctgtcgagctgcgtgatggcgatacacaacgctattatggaaaaggtgtactaaaagcggttgaaaacgtcaacggtgaaatttctgaagaaatcatggggttggacgccacggaacaatgtttcattgataaaacgttaattgaacttgatggcaatgaaaataaatccagacttggtgccaacgcgatccttgccgtttcactcgcagtagcaaaggcagcagcagaagaagccagccttcctctttatcgttatctgggtgggactaactccaagtggttgcctgttccaatgatgaacctgattaatggtggtgtacacgcaaataatcgcctggatatgcaagaatttatgattataccgctgggtttgccaagcctgcgggaagctgtgcgttgtggtgcagaggtattcggcaaactcagaacattgctccacaaaaaaaacttgccaacgacggttggtgatgaaggtggatttgcccccggtttcgcacacaatgaagaagcattgggcttgattgtacaggccatagacgaagcgggttatcagcctggttcagaggtggcaatcggagtggattgtgccagttcagaatttttccgggatggtaaatatcaccttgctgtagacggcctcagtcttacttcggctcaatttatagattatctggcgtcctgggtggaaaaatatccgatcatcagcattgaagatggcataagcgaacaagattgggacggttggaaactgctgactgaaagacttggacaaacggttcagctagtcggtgatgatatatttgccaccaatacaaaaattttgaagaaaggtatcaatcgcaatatcgccaactctatcctgatcaagatcaatcagattggtacgcttactgaaacgctgaatgccatcgaaatggcaaagtgcgcaggctatactgccgtagtctctcatcgttccggcgaaactgaggatacaatgattgctgatatagcagtaggcactaacgccttacagatcaaaacaggctcactttcgcgctcggatcgactggccaagtacaaccagctgttacgtattgaggaagatttgggtgatatcgcacaatacgctggaagatcagctttttaccagttaaaaccatgaaaatcacaaccggactattggttcttatgattgcgttgacgcaatacccattatggttcggcaagggtggctggttggaaattatggaaatgcatgaacaaatcactgcattgcatgaaaccaaccagagccttcagaatagaaacacagtgttggaagcagaagttaataatttaaaaaaagggcttgatgcgatcgaagagcttgcaagaagtgagctgggaatgattcgcaagaatgaactgttttttcatgtagtagagtacgagaacaaataaacatctcgtcataataacttggtatttatcgcagtaaaacagctttaaggtgaagattcatgatcttcaaatggataattctaatcgctcttggttttttagttttctggttgctcaaaccattccgaggaaaacaaaaacactcagtagatacaaccccaggagcaactgaagatatggtgcgttgtacgtattgcggtgtacaccttccagagagcgaaggtattattggggatggtcagcatttctgttgtgtggagcaccgtcaattatatttacaatccaggtcttgtcacaagtagaaaaagacaggggaattcatgatctgaaactcaagcagatcaatgatgtttctgatatatgggtaatgatactccagtacagacaacaactagaaatgctgctcccggctaataatatttagccggtacggtatttgcaacagagaaactctcagcccggcataaaaaatgctttgctgatttccccagatattacttctgtaaatatcttccgtatttctgattgaatttctcaaccctgcctgctgtatctacgattttctgtttacctgtgtaaaatgggtggcaggacgaacaaacctcaacatgcaaaggcctgctcaaaacggatcgtgtcttgaattcgctgccgcagctgcatgttacgattatttcatggtactccgggtggatgccttccttcatttgatatccttattttatcttgtaagagctaaataaaaggcagctattatcacttaagataagtatggctgcaactaactacagctgcgttaactgaaataaaaacctccccacaagtagtaaggtattaaattgccacccaaattgagttggccaacgtggtcttcgcggtattacacgcgccgcatggaatcaaaaaaatcagcgttattttttgtggccttaattttatccagcagaaatgacattgcatccatctcgtccatcgggtaaagcaatttacgcagaatccatattttttgcaggatttccgaggatatcaagagttcctctcgacgagttcctgaacgattcacattgatggcagggtaaatacgcttttctgccatgcgacgatcaagatgaatttccatgttaccagttcctttgaactcctcatagatcacatcatccatacgtgaaccggtatccaccagcgcagtggcgataatggtaagtgaccccccttcttcaatattgcgtgcagcaccaaagaagcgtttgggacgttgtaatgcgtttgcatccaccccaccggtcagtaccttgccggaggcaggtacgatcatgttatatgcacgcgccagacgggtaattgaatcaagcaggatgacgacatctttcttgtgctcaaccaatcgtttagccttttcgatcaccatatcggctacctgaacatgacgagcagccgattcatcaaaagttgatgatatgacttcccccctcacggaacgtaccatttctgtaacttcctcagggcgctcgtcaatcaagagcaccattaacaccacatccggatgattggctgcaatagaatgtgcgatgtgctgaagcatcaccgttttacctgattttggactggccaccaataatccacgctgacctttcccaatgggtgcaattaaatcaataatccgacccgtaatattttcctcggatttattatcgcgctccaacgtcagacgctcagttggaaaaagtggcgtcagattttcaaacagtattttgcgcttggagttttcaggtggctcattattgaccttgtctatcttgaccagtgcaaaataacgctctccttctttcgggggtcgtatttcaccatcgactgaatcccctgtatgcaaattaaaacgacggatctgactgggggagatgtaaatatcgtcaggcccagcaaggtaggatgtgtctggagagcgtaaaaatccgaagccatcctgcaggatctccaatgtaccctcaccgaatatgctctcacctttacgtgcctgatttttcaggagggcaaaaaccaggtcttgcttgcgcattcggttggcaccctcaatatcattcgcgatagccatttttaccaactctgaaacatgaatgctctttaaatcagataaacgcatgaaagtgactcttgaagatcaaaaaaagtgcaggtgaatggagggaatattcagagcgtgctatgagatgtatgaaattattaccggcttactcaatatcggataataaaatcgcgatttgtaaagatcgctcacgctctaatgaaatagagtcgaccgaatgttaaagattgcacgtaactcactcggcctgtatcagtacttaaaatcggttttacagatggtcatcaacaaacgctatcaactgcgattttgataaggccccaacctttgtggcctcaatattcccgttcttgaacagcatcaaggtcggaattccacgaataccgtatttctgtggagttgattgattttcatcaatattaagtttagctactttaaggcgaccattatattcatttgcgatttcatccagaatgggtgcaatcattctgcatggtccacaccattcagcccaataatcgacaagtaccgggaggggacattgcaatacctctgcctcaaaagttgcatctgtaacataatggatgtgttggctcatgaaatcctcttctaaagtttgctggatcaaagtgaacgctgacggcagttacagtctgttgcaactgaccaattaactgaattcaaatgatagtgtcctaaacagccactaaagacaacttgaattctaaaatgactctatatttgtatactacagaaagaacgggcgggtaataagtaaactatgcagtgtttttgttttttaaaaatgtagcttttaccgtaactgtgaggcaaaactaaaagatctgaatattttatatattatacttacaataacattcaaatcaataaatttgtcaacatttttgaattttttgcaagtattccagcaggacaatcccggggattatcggcacaagcagactttgaatcatcttgtaataggtccaataatactgcaagtctgtaaattatttctttattcattatgtttgcgcacttagattaacccatatgaaaacctgattttaagctgacaactttcaatgaaacacctctctttacctgatcaaagcaaatacttcgaactgattcgcagcactctgaaacatttatcaggatttttacaaatgaactacgatttctgctcaactcgtccggcattcctgaacttcttggttaaaaatctattcaggctgataaattccagttattttccggatcgcctgcttttatttatgccaataatcctgattgcttattcttcagtttgtctagccgcacaaccaactcccatttcgcgctcagaagtcagaaattttataacgtatatggtgaaccaccatcaatatgaaatgaacgaattagaaaaaatattttctcagacaaatttccggcccgatattctcaagctgatctctaccccagcctcagcaattacctgggatgaatatcggaaacgatttgtcaacatacagcgcattagaggtggaattaatttctggaacaagcacgccagcgaattggaacaggcaagaaaaatctacggtgtccctgaggaaatcatcgtcgcgattatcggtattgagactgcttatggttcatcaaccggcacctaccgtatcatggatgcattgacaacactagctttcgatttccccagaagagcagactattttcgtgaagagctggagcagtatttattgctggcaagggagcaaaaatttggtttgctggacatcaaaggctcttatgccggggcaattggcatccctcaatttatgcccggaagctacaggcgctacgcagttgattttaatcatgatggaaaaattgatttatccgggagtgctgccgatgcgattggcagtataggcaattatctgaaggaatatggatgggaagcaggcaagccgattgctgttcgtgcgcggatcagatcagaaaactttcagaagtttctggatgcgggcatagaaccgttacattcagttaaaaaattacgcgaagccggcatcatcccactcgattcaattacagatgacactctgtcagccttgctggaattgaacagccaaggtaaccgccagttctggctgggattcagaaatttttatgcaatcacacgctacaaccgcagcactttttatgccatgtccgtttttgagctggccagagcaattcgcgttgccagatcttcatagccagcaggttgataaccatcaaatagacccttcgaggcggtgcccaaggtgatatagtctcactgacgacgattaatcgtcctgtaagcgtaccgcaagcacatcacattttgcatgataaagcaccctgttcgcagtggaacccaataacaatgcgagtccgtgtcttccacgcgaaccgaccacgatcagatcaatcctttcctgctcagcaatacgaataatttcctgtctgggctctccccaaatcagccagcggcaaccaggattgatttccaactcatcacctatttcattcaatttctgtttctctgtctccagcattgcataagatattttggtatccaacagaatcacggtgccgtaaggcgtatcaggcataggaatattatccagaacatgaataagactgagctttgccccagtttgcagcgccaaactcctagctttctgcgcaacctggctgtcctgtggtgaaaaatccacggcaagtaaaatatgttggtaaacagacatgattttcctgacaagttaataaagcagagttaaggaatcttcgtaccaataaccatcattaattttcaaaactagcgatattatgtttcattagaattaaaacagatagctcaacaggcattattctgcgctccttctctgattaggaataatatctgtctggcggaagccttgcttcccgcctgactgaatatctggtgtactacgccgctgacaggtgccttgatcgtaaattccatcttcattgattccaataccgctaaagcatcacccgtgttcacgtgctgtccttcacttaccagcaatttccatacaataccggttaaatgtgtgtttaccacacaagttcctgtaggtatggtgatattgtgcggtacgcagttgttttccgggggttcactggtcgtataattttcctgcccatccgctttccagcgttcacgctcagctatgtaggcagctttctgctttgttttgaaggcatcaatcgatacggcatgttctttcaggaagttattgtattgtttgagattgaaacgatcttcctcaatgcgcggactaaatcttccattcggaaaatctctgcgtatcttggccagctctgcctctgtcacagggtagaagcgcacctgatcaaagaaacggagcaaccaaggtttgccctctttaaaatcttttgtctgaatatggctgttccacatctgtatggtacgtcccaccagttgataaccacccgggctctccataccgtacacacacatataggcgccgccgatccctaccgcattctctggtgtccaggtacgggctgggttgtatttggtcgtgaccaagcgatgtcttggatccacaggtgtgcccagtggcgcacccagatagacatcccccaatcccatcactagatagctggcatcaaaaataatgttcctgacttcatcaatactgttcaatccattgattcgtcgtataaattcgatattgtccggattccatggcgcatccttacgcacagattgcatatatcttttcatagccagctgaacggatgaatcgttccaggagagcggcagatgcacgatccgtgtcggtacttccatattttcaacggaaggtagtttttgctctgcggaaaccagcgtgtccagcaatctactgcgtggcaatattctggaatcaaagcggatatgcagtgaacggatgccgggcgtcaaatccacgattcccggcagatcaccgccatccacagcctgctgcaaccattccatcagcgcatggatacgaaaacgcaggttgaaatcaagcgtcatcgagccatattctaccagcaggtttttatctcccgcctgccgatacacaacctgcacctgttcgcctgcttctggaatggtatgcaagatgggagtatcgggtgatgttgatgtcgccgtctttatcgtagttggcgccgatattgtttccgggagatgcaaactgcggacgaatgcatcttgagatgcctctagtgctgttgcatcatcggctgtgatgcgctgaaaggtaatgcgatcaccaggccggagttgccccattttccactgctcagcatacgcaactgttaccagacagacgaacccacccaggctgggaccatccggcccaagaataaccggcagatctccagtaaagtccaccgcgccaattgaatagggaacatcgtgcacattggaaggatgcagtccagcctctccaccatctgtccttgcccattctggtttcgggccgatcagacgcacgccggtacgatcggagttatggtgcacgacccattcggcagcaaagaaacccgtgacgcttttttctgtaaagaaatctggtgcgccatgcgggccatatagcactgcgattttccagtgatgggtatattgcggtacagctgcttgcggcagttcatgcggaacatactctgcatagaggtctgctgcgatgttcaacatatcgcctgcctgtaggatgcgaccttcatgcccgccgaactggcccagcatgaaggtggatttgctgccgagataatccgggacgtcaataccaccctgtattgccagataaacccggctgccctgatccagcacatcgccaaaaacaagtaatgtccctgcttcaaccttgtgcgatttccattgcgctaatggctttccgttcaaggttacttcgacgggagcgcccgtcactgcgatgacactgtcgcaatgaatacgcagggttggccccgcaaaagtgatttcaatagcagcctgcccttcctcatttcccaccaggcgattagcgagcctgaatgccaggctgtccatcggcccggaaggtggtacaccgatattccagtaacctcgtcttccagggtagtcctgtatcgtagtttgtattccaggtgtgactacttcaataacaggtttggcggctttactcgtacttaacgttttatcggacattctgttctccatgctcggtaatgtctggctcagggggcagggttcggctattgttacattcttggccagatcagcagacggataggggtggggttgtaggcattacacggattattcaattgcggacaatttgaaatcagtaccaccacatccatttcggcgtgcatttccacatatttgccgggcgctgatacaccatcggcaaactccagattaccttctttagtcactggaacattcatgaagaaattgatgttggcggggatatcgcgcttgctcataccgagtcgttcacacaccggatcatgcgccaaggcatgcagaaaattatcccgacagctgtgcatcgggtatttatccagcgcatagcgagtggtattgctttcggccgcgcaggcaccgcctaccgtatcatgtcgcccgcaggtatccgctgtaatggtgagcatgacattaccgaaattggaatacagcttgctgccggttgtcagatacagactatgttgccggcatatggtgtcggatgcgctgtaacgctccattgcatcctgtgcattgtaaaaaagtgtatcgactgcctgatttccttcaagatcaacgatgcggaatgtttgccctttttttatttccttgacccatggctcacctgcagcacaaatttcattgataacggcaagatcgggatttagtgtgcttttaaccagattttttgtgctcatttttcacctccataagcataaagacgtcgggtgttttccagtgcgcgtgcattctccgcaatgtgggcacatgcattctctgcggtagaggacgatgggaataccgccagatcaatcgcaccggggtgataggtttccgccggatccagtggatgcgaggctgcggatagcacgatcagtgtatccattacaaaagccagatccacatggcctcctgctttgctgtgatttacatgaaattgcaattctccagacaggccagcagtcaccttgctgaaaaaattgatgttgggtactacgtcacgcctgcccaacccccattttcccagctcaatcagcatgccatcgagtccgctgcgatacatatcgttacgcagttcctgatatcggcccaggccaaatttctggcgtatcagcccggcgtcactcagaccacaaaccgtatcgttccagcctgcagtatcttcagtgatgcaacaaaaaacccgtcccatatcggaatggcaagcatggcctttggttaagtggaatgtatgctgtgttttaagcgtatctgccatgttgtaacgctccagtttttcttccatgttataaaacagaacggcggcattgccgcctcctgccgcgtctgtcaggcgcaacgtggttcctcgacgtacaattcccgaccagtgacacccgccgggaatatgtgtttcccaaagataccgagtaatctgattcataccttcactcctcgttacagtgtgtttttatcaacctgcttccggatatctcccggagcagtaatatccaaaaccttttttatcgcgcgcttgtaccctgtttgcacatgcaatgttgttagaatcaacagggtgcccaacaccagtggtaccgcccagagctgccaccagcttgccccgggggcggctatatagtcgcgtggccaaccaatgttgatcagctcgaatagtgcccagacaaaagctacgatattgattgccaatccccatttccccagtcgaagcgcgcccaatgcgggattccaccggccagttagccgtgcatacagaccaacgcctgtcgtcatggaaaacatggcatataacccgcccgttccgaaagcaataatggttgcaactgcgccatcattcagcccaaaaagcagcccgagactggccataagcacggttccggcgattgcattgcgcggcagttgcgtttttcttgtgacatgcgaaaagaaggtaggcagattcccttcgcgcgccatcgagaaaacgatgcgtgcagcgtaattaactaccgatgatccacaggaaagaaaagctgtcatcacaattatcagaaatggcttggcagcccagactccgatggtgctggcaataatcggtgaaatggggtcagaagtagcactggattcgattaacgtagcgtgactaaccgacaacatcaatgcggaagaattgaaaagcactatgctgcccactgccaacagggacaggaagattgcacgtggaataattctctcggggttatgggcctcttcagcaatagtggagcaggaatcgaatccgataaatgcccagcctgcaatggctagtgccgccaggaaagcagttatgctggtaggtgccagccccgttcccaaatgctggaacaattcggaaacgggattgatacggaagaagaaaaacagaatcagtgcgacacatatcgagcccaatacttcagcactgaccccgagtaagttgattatcttgtaaattcgctggttaacgatattaactagtgtacaaatcaataggaacacaccgccccagataactgctgaggcaccttgtgtgtctccacccatgactactgcagaaagccacatcccccctgtataggcagtcgtggtcagcatcgcaattaccgagctgacataaatgattcccgcatactggcctgtctttggccctatcaaatgcctggaccatttgtaggcgccaccggcaatgggaaattgtgatgaaagctcggcatagacagttgctactgtaagctgcatgaatagactcagaataagtgcggcaatccatcctccgcctgttacctgattctcgacaccaaaaatagcgtatagccctactaccggtgatacgaccgagaatcccagggtgcaacagttccagacactcatacagcgacgaagctgtcctgtttcacgggtgtttccgtattctgtttcagttccgtcagccgaactgctatctgctgcagaaaataagtctttcttttctactgctgtcatatagttcttctcttgaaggttaagggcattttgtgctgctggaaacaacaaaatttactgctggaaaattaattgcagctgcggaagcccgcaacctgggagtatctgaacagggaaaacggatatgtaacagcgccccaactgctaaataatagccagcggttgatgcaaaaggataaatgaatgaaggatttgaatattgaacagaagtacatgcgtgcgataacttttccattgtgggttccgggagttaatgtaaaaacataacctcccgggcttttatccctccgtggaacccccttgaaagggcccgaaacccttggaccagtcgcctcccttggaaagccggaaccctagtttcgtaaagcaactgtacctctaattattttgtttaccgtgagaatcctgattggattcaatcttgacaaacaagaacacaatctcattatatacatcaagatttttgaaatacaagagaaatattgtgatttcagcaaagattcgctactcttgacgttgtatttttgtttcaacgagcaggacaaggttgctgccatgaatttgttgccagctgcttgaaattacttcgggctagggttccggctttccaagggaggcgactggtccaagggtttcgggccctttcaagggggttccacggagggataaaagcccgggagattacataatgccaggtgcattattggttctagttatttccgaccgtctggagatttgttatatgtatcgcctgcttttttacctttctttccagctttattccacacctcctgttttctttccaacaactcgtccatttacttgatgatcaggtgcttttagattgcctttatagcaccggtatttatttttgctgacataccatgatatggcttgtttaatcatatggagcctacagtaggagaacctatgtttacaaaaattctgattgccaatcgtggcgctatcacccgccgtattatccgcacattacgccgaatgggaatcagtagcttggtggtttttaccaaagctgatgcgttatcacaacatgtgctggatgccgatgagagtatttgcatcggcgaaggactggccagtgaaagctatctgcgtaccgataaaatactggatgctgcgtatcggacaggtgcccaggcaatccatcccgggtatgggtttctaagcgaaaatgcccagtttgcagaacaatgtgcgacgcaaggaatttgttttctgggccccacacccgagcagatgcgtatctttggcctgaagcatactgcccgcatgcttgcacagcagcttgatgtgcccatgctgccgggtaccggattactggaaagtatcgaaatagcctgtcaggaagcacttcggattggctacccggttatgctgaagagtacggcggggggaggtggtattggcatgcgcttgtgccacagccaacaggaactggttgatgcatacgaatccgtcaggaatctggcacaaagcaactttagcaatgccggtttgtttctggaaaaatatattgatcaagcccgtcatgttgaagtgcagatttttggtgatggccgggggaaagtgattgcgctgggagagcgcgattgctccatgcagcggcgtaaccagaaggtaatcgaagaaacccctgcgccaggcctgtcgccagtaactcgcacagcgctgcaggaaacagccgtgcgcttgggtgaatcggttcaataccagtctgctggcacagtggagtatgtttacgacgccgctgccgatcagttttatttcctggaggttaatacccggctgcaggtggaacatggtgtgaccgagatggtgaccggcattgatctggttgaatggatgattctgcttggtgctaatgcattaccgtcgctggaatcattcaacattcaaccacaggggacttccattcaggcgcgtgtatatgcggaaaacccggcgaaagattttcagccctccagtggtttgttgagtgcagtcgaatttccggaaactgcacggattgagacctgggtggccgcaggctgcgaagtatcggcgttctatgatccgatgctggccaaaatcatcgtgcatgctgcagatcgcgatcaggccattgatcgtttagtcgccgcactggataaaaccaccctttatggcattgaaaccaatctggattacctcagacaggtgttatccgggacagtatttcgcagcggacaagtcagcacgcaataccttgccgggtttcgctaccagcctcattccatggatgtgctgaacgctggtgtgcaaacgacggtacaggattatcctggcagaacgggttattggaacgtaggtgtgccgccttccggaccgatggacagcctggcttttcgtttggctaatcggctggtcggaaatccggatggtgctgcaggactggaaatcaccctgtccgggcccacactgcgcttcaactgtaacagcctcattgcagtatgcggcgctcctatcaatgtttggttggatgacaaacctctggcgcaatggcagtcacacttcatcaaagcgggctcgctgttaaagtttggcaaaatccgccaggctggtagccgctcctacctggctattcaaggcggaattcaggtgccggattacctaggcagtaagtctacctttacgctgggacagttcggcggacatgccgggcgtgcgctacgcaccggggatgtgctgcatattcggtttgcagaagaagctgaacccagcatattgcctgtcgagtgtattccacattacaccaaccattgggaaattggcgtgttgtacggcccgcatggcgcaccggatttctttacggaagcagatattgatatgttttttacgacggactggaaggtgcaccacaattccagccgcaccggcgtgcgtctgattggtcccaagccacaatgggcgcgcaaggatggaggggaagccggactgcatccatcgaatatccatgacaatgcctacgcggtcggcacgattgattttactggtgatatgcccatcattcttggtctggatggccctagtttaggtggatttgtctgtcctgccgtgattgtacaggcggaattatggaaaatcggccaactcaaaccaggtgatagtgtgcgcttttatccgctgacagtggaatatgcactgctgctggaacagcaacaggacaagatgattcaggaaccggatgcctttacactcgcggcgtctgatatgcctatgctcccggttgatcgagggaatcctatattacaccggattcctgcaactgacaggcaggtgcaggttgtttaccgacaatcaggagacaaatatctgttgattgaatatggtgaagcggtactcgatatcacattgcatctccgcgcacacgccttgatgacctggctgcaacagcatatcgatcaagggaatttgtccggaattcttgatattacgcccggtattcgctctttacagatccattttgattcgcgactactggcgcgtgaccagctcctggacaggctcattgctgccgaacaagatttgccggccattgacgatatggaaatcccctcgcgtatcgtacatctgccactctcctgggatgacgctgctacaagacttgcgattgaaaagtacatgcaatcagtccggcaagatgcgccctggtgcccgagcaatattgaatttatccgacgcatcaacggactggagaatattgatgaggtcaaacgtattgtttttgatgccagctatctggtcctggggctaggagatgtttatctgggtgccccggttgccacaccggtcgatccacgtcatcgtctcgtcaccaccaaatacaacccggcacgtacctggacgccggaaaatgcagtcggaatcggaggagcctatttgtgtatttatggcatggagggcccgggtggatatcagtttgtcgggagaacggtgcagatgtggaaccgttatcgtcaaacgcgcgattttactgccggcaaaccgtggttgctgcgtttttttgaccagatccggttttatcctgtttccgagcatgagctgcttgaattacgtcaggattttattacgggtcgcttcacgctgcgcacagaggatacggtcttcagtctgcgcgcttatcaggcatttctccagcagcatgcagatagtatcaagacattcaaatcccggcagcaaaaagcgtttgaggccgagcgtgaatgctggcagacagagaatataaaggatgatattggcgaaaatatgctcgatagcactcacacagaaaacgaggtcagcttgtcggatggtgcgcacgctgtcagttcggatgtgactggcaccgtgtggaagctgttgattgaaaccaggcaatcagtcaatattggagatccaattatcgtcattgaatccatgaagatggaaatcaccctgagtgcgcctgtcagcgggatcgtgcaacaagttagctgcaagcagggagattatgtatgttccggtcagctgttgctgattgttcaggaggaataagggctattgaagggtgcggtcagcttgagcgtcaatttctgtccaatagaaagccggtcgctccccttgttccacgaacgaacggtgttgatatcaattccgtagcgtctggcaatcgcctgaagtgtatctccctttctgacggtgtatacgaagtgttctggccggggagacttcgctgatgtcttgagtaggttatgcgccagataggttctttccctgatgctgttgccgtcacgtggcaccagcagtgtctgcccttttttcagcactgctcgctcggagataccattggtctcggccagttttgcaaccgggatgcgataccgattggataaatcctgcaaggtatctgctggctgagcctgataaacacgccacgaaaccagcgctttatcataattttcaagattatctacaaaagttttgaccttggtgatgggcaacagcaaggcgcgtggagatccttctgccttgatgacgggccggtgatacgccggattcaaggcattaaattcattttctgaaattccggcaagcctggcggccagttgaacgtcgatctgctgggtgattgtaatttgctcgaagtaaggccggttcgcgatgggtttcagcttgatgccgtaacggttaggatgggcaatgatatttctgatggcaatcagcttggagacatagtttctggtttcggagggaaggtcgatctgctggtagctgattgatttattcccaccatgattttcgtcaatcgcttttttcagagacccctggccccaattgtatgcggccagcgccaacttccagttaccaaacattttgtggagcatctgcaggtaatccagcgccgcctgagtggcggcgataatatcgcgtcgttcatcatgccaccagttttgttccagcccaaatgcttttgctgtcgaggggataaattgccacaatcctgctgcatgtctgtgggagtaggcgtccgggtcaaaagcgctttcaatgatcggcagtaacgcaatctcggccggcatatgtcgtcgctccacttcttcgatgatataaaacagatagcgctgactgcgctcaacgacatgatctataaaccgctggtttttactgaaattactttcgtggagtcggacttcctggctttgtgtattggtcagagagaatccagcccgtacgcgcatccatagatcatcttgctgtttgtgtaattgtgcctgatacggctttgtttccagaacggtaataccgttatttttttctaaagatctatcggcttgcgccgtaacaggagggaacgttaatactattgcggcaatcaatgccagtaaggtattcgattttgtcttcatccggaataaaacgaacggttcactcgcataatttttttctgaaaataaaaaaggctggtcacctctatttttgaattttaaagtgaaccagccggcccgtccaatattctacaccatttttcaatcagcaatcgattgatcagtatttcaatcccagcttaatacgcctcccgtctggtattcaattacacgagtttcaaagaagtttttttcttttttcaaatcaaccatttctgacatccacggaaaaggattgtctgcttcgggaaataatggatcaagcccgatctgatggctacggcgattgataataaagcgcagatattccttgaacatgggtgcattcaatcccagtacaccgcgcggcatggtatcttccgcataacggtactccagctccaccgccttgcgcatgagtgcactgatttcttcccgaaactcgcgcgtccataaatgtggattttccaactttatctggttgataacatcaatgccaaaattacaatgcatggattcatcacgcaggatgtactgatactgttcagcagccccggtcatcttgttttgccggccaagggacagaatctgcacaaatccaacatagaaaaacagcccttccataatgcaggcaaacacaatcagactttttaacagttgctgatcagtttccagcgtgcctgtctgaaacgtgggattcgtcaatgtgtcgatgaagggaatcagaaattcgtccttgtcacgaatcgatttgatttcatgataggcattaaagatttcgccttcatccaggccaatcgattcgacaatatattgataagcgtgcgtgtggattgcttcctcgaaagcctgacgcaataaatactggcggcattcgggattggtaatgtgccggtaggttcccagcacgatattgttggccgccagtgaatcagccgtgacgaaaaaaccgaggttacgcttgacgatacggcgctcgtcctcagtcaacccattgggatctttccacagggcaatatcacgcgtcatgttgatttcttgcggcatccagtggttggcacaggctgacagatatttttcccatgcccatttgtatttaaatggcaccagctgattaacatccgccttgcaattaataatgcgcttgtcttctacggaaacccggcgatgattttctgctgatatttcttcgtgcagcccttgctgttcagcagttattttttgtgtggggacgcttgctgggatatttctcggctgaaatacttcatcttcaaaattcaacatccttttattcctctttatatttttgaattatctggggaaatttttcaatacttactgacacgcttcacattcaggatcgtcgatcgcgcactgttttgtggcggaatggatttgccctgagctgtccgtatgcccattttgctgtgcagggaccgcgttcagcgtgccggtatgcactgttgatttttctgcagtggtcgcccccatggcgcgcagataataggttgtcttgaggccacgcaaccaagccaatcgatataaatcatccattttcttaccggaagcacctgacatataaagattgagggattgcgcctgatcaatccatttttgtcttctggcagctgcttcaaccagccatcggggatcgatctcaaatgcggtagcgtaaagggcgcgcagattttcaggaatccggtcgatcttgctggcagcgccatcgtagtgtttgagatctgcgatcatgacttcatcccataaatcctgcttcttgaggtcattaaccagcgattgattgacgaccgtaaattcgccggaaagattggatttaacatatagattctggtaggtgggttcgatgctggccgaaacaccaataatattggagattgttgcggtgggtgcaatcgccaggcaattggaattgcgcatgccgtattgtttgatccgctcacgtaacggggtccaatctagcgtggatgaggtatcaacctccacatggccgccacgttccgcctgcaacaacgccagcgaatcctgtggcaggatgccgcgctcccacaaactgccgtgataggtggcataggtgccgcgctcttcagccagttcagtagatgcccagtaggtgtgataggcaactgcttccattgagctatcagcaaattcaaccgcttcgcgggatgcataggaaatccctagtttatgcaggcaatcctgaaatcccatgatgcccagcccgaccggccgatggcgtaagttggcattgcgcgcttttgctactgcgtaaaaattgatatcgatcacattgtccagcatgcgcatggccgtggcgactgtctgcttgagcttagtcagatccagtttgccattcacaatatgtgccggcagattaatcgaccccaggttgcatacagcaatttccttttcattggtattcagcgtaatctcggtacacaggttggagctgtgtacgacgccgacatgattttgtggcgagcggatattgcatggatccttgaatgtgatccacggatggccggtttcaaacagcatcgtcagcatcttgcgccacagttgccgggccggaatacgtttatgcagcgccaatctgccctgcgtcgcctgctcttcataggcaatataggcttcttcaaatgccttgccatatttctcgtgcagatccggtgtgtcggaaggtgaaaacagcgtccattcctgatcttccagcatacgcttcatgaacagatccggcacccagacagcggtattcatgtcatgcgtccgccgccgatcatcgccagtatttttgcgtaactccagaaattcttcgatatcaagatgccaggtttccaggtaggcacagactgcgcctttgcgcttgccgccttgattaacggccactgctgtatccgaaaccaccttgagaaaaggtaccacgccctgcgatttgccgttagtgcccttgatgcgcgcccccattgcccggaccggtgtccagtcattacccagcccgcccgcgaacttggacagcaaggcattctccttgatggcttcgtagataccatcaagactgtctggcaccgtgctcagatagcatgaggatagctgcgagcgtcgtgtgccagagttaaacaatgttggcgttgaactcatgaaatcaaatttcgacagcagatgataaaactcgatagcacgcgcctcacgatcaatttcattcagcgccagtcccatggcaacacgcatgaagaatgcctggggcagctcgatacgccgttcggaaatatgcaaaaaataccggtcatacagggtttgcaagccgaggtagccaaattgcagatcacgatccgctatcagtgtttctgacaaccgtgccagatcaaattggcccagacgctcatccagtagcccggcctccatcccctgtcggataaaacctggaaaataatcggcatagcgtgactgcatggcctcatgggaaacatcttcacccagaacttcatggcgaatgttgtccagcagcagcctggctgtcacaaagctataggcaggctctttttcgatcaaggcgcgcgcagataaaatggcagatttcctgacttcttccgcaggcacgccatcatataaatctctcagcattgccttgacgatcaaccccgcattaacgacatcccccagatgctggcaggctgattcaatgcgagctgtcagtcgggatggatccagcggaattctttgtccattttccacaatatgcaacaccgctgcctgggtagaagtcggctgctctttctgctgccttgcccgttcccgcgcccgctcctcacggtacagcacataggcgcgcgcaacgtcatgatcacccgagcgcatcagcgccagctctacctgatcctgaatatcctcgatatgaaacgtgcctcctcccgggcggcggcgagtcagcgcatgcaccacttcgccggtcagctgcgccacgatctcacgcatactggaggaagccgcactttgtccgcctcgtaccgcaataaacgccttggtcatcgcgatggaaattttgcctggctcaaatgccaccacagcaccattgcggcggatcactttatattgggaataatcctgccgggttgctggcgaatcggtcatctctcccagaaaatttttctggagaatagaggaggatgaaggggcgtctgtagcgagctgcatgatcaatttctcctgttcaatccgggcgtactgctgattgaaaaaatgactaaaaacaagtaattgcaatgaaaatgacgataaccgtcaaatagcttgaaccacaatatattgtggtatggatggttaaataatggtacctgttgtgcatgccgattgtcaacagcagatgacgccgtattagaggctatagtttccgggaagagttccctataatcgaaagatcactatccgagaaggtttgccatgcattcaagtcagtggaaactgctttcaagcagacgttttttacccttttttgttacccagtttctgggtgcattcaatgacaatgttttcaagaatgcactggtgatcctgattacctatgccgccatggacaacgcgggcctgagcccacagatcatggttacgctggcggccggtattttcatcctgccatttttcattttttctgcgcttgccggtcaactggcggataaatgggacaaggcaaggctgatccgctatgtcaaattcgtcgaaatcattctgatggggggggctgctacaggattttatctggacagcgtactgtttctgctggggatattgtttctgatgggcgctcagtctgctttcttcggtccgttaaaatacagcatcctgccagatcagttgcgtgaagatgagctaattggcggtaatgcgctggttagtgcgggaacatttattgccatcctgctcggtacaatcatagggggattacttattctggctgagcaagggggatggattgtatcggctatcgtaatcagcgtggcattggcaggctggttattcagcctgtttattcccccggttcaaccggctgcagcagatacaacagtcagttggcatctcctcaaagacacgcgcacaatcattcagcaagctcggcagaacagcacagtgtttcacgccattctcgggatatcgtggttctggctgtttggtgctacgtttttgtcgcagtttcccaccttcgccaaggaaattatcggtggaaacgaacaggttgttacgctgtttttgacacttttttcagtggggatcggtatcggtgcactgctgtgcgacaagttgctcaaggggaaagtggctgccacttatgtgcctttgggtgtactgggcatgacgttcttcaccgtcgatttatattttgccagtgttgctgtcgtccccgcatcagatcaggaattcatcggtgccctgagttttctggaatcattcgcccactggcgaattctgctggatctgctggccatctcaatcagtggcgggctttacattgtgccgctgtatgccattgtacaaaactacgcagaagcttctcagcgatcgcgcgccattgctgccaataacatcatgaatgcgctattcatggtggtttctgcactgggaatcagtgtgatgctggcactggattttactgttcccgaggtattcctgacgatcgcgttgctcaatggtctggtggcaatctacattgcaaaattgttgccgtatgaattggccagatccattttgcattgggtctttcataccttttaccgtctaaagatcaatgggctggaacattatcagcaggcgggagaaagggtattgatcgttgccaatcacctgtcattcctggatgccgcactgctgagcgtatgttttcctgagcgcctgtgttttgccatcaattctgatattgcccggaaatggtgggttcgaccattcctgtttctggcggatacggtgacggtggatccgatcaatcccctttccacacgcctgctaatcgaacgagtcagaaacggtgacagagtggtgatttttccggagggtcgaatgacaatgactggagcgctcatgaaaatctacgaaggcccagccatgattgcagataaagtcgatgcaaaattgcttccagtcagcctgtcaggcccgcaatacacgcctttttccagattgaaaggcaaagtgagaatacgctggtttcccaggatcacagtgacggtcatgccgccagaaaactttaatctgccggactcaatccgtggcaggcgccgccgccgaacagccgggctaaagctatacgacatcatgaccaccactgtctttcagagcaatgccatgcagcaaaccctatttcagtctctgctcgacgctgctgctacacatggcggaaaacataccattgcagaagatgttgaacgtcatccgctgaattattcgcaactgatcacccgcagcttcatactgggtgctattttgcgccaccgtacgcatacgcaagaaaacgtggggatcatgctgcccaatatggtgagtaacctgatctgctttttctcactacatgctttcgggcgtgtgcccgctatgctgaatttttctgccagctccagaaatctggtgatggcttgtcggattgcacaaatccggacagtcattactgcacgcaaatttatcgaagcggcaaaactgagcgggcagatcgacagtctgaaagcacagcagatccatctgatttatctggaagatcttccgcaccaggcgcattggtggcacaagctgatggggctggtggcaggctggctgcccggaatgagttatcgtctgacggattcccggcgcgatccggatgcaccagctgtggttctgtttacttccggttctgaagatacgcccaagggagtggtgctcagccatactaatttgcaggcaaatcgcttccaggcatcctcccggatcgatttcggcccgactgatctggtattcagtgccttgccaatctttcattcctttgggttgacaggcggcatactgctaccgatattgtccggtatccgggtctttttgtatccatcaccgctgcattaccgaatcattcccgagctgatctacgataccaacgccaccctgatgtttggcacagatacctttcttgccggctatgcacgctatgccaatgcttacgatttttacagcattcgttatgtattcgccggtgccgagaagttgcgggaaagtacacgcagactatggtcggaaaattttggtgtgcgtatttttgaaggctacggcacgactgaaacctctcctatcctcagtctgaacacacccatgcacaaccatcccggatcggtgggccgcctgttgcccggtgtttgtagtagattggaacccattccgggaataagacagggaggcagactgctggtatccggtccgaatgtaatgttaggttattatctggccgcaaatcctggtgtaatcatcccccccatcgagggctggcatgatacaggcgacatcgttgaaatcaacgaggaaggttatgttttcattaaggggcgcgccaaacggtttgccaaaattggtggggaaatgatctcgttgacagcggtggaggaagccatcaatcggctgtggccgggttatggtcatgccgtaatccagcgtcctgatgcaaaaaaaggtgagcagattgtactgattaccacccaccagcaagcagatcgaagcgaaatcatcacttatttcaacaaaaatgatctgggcgaactgggaatcccacagaatattttgtacatcgacaaactaccgttactggcaacgggtaaaatcgattatgtactgttgcacgaatgggtgcagcagccaggcacaagccctggttagcgatttattgataaaacagatcatcctttcattatgcggtacacccggatcgtcgggaatatagctgttttatagcgaatcatgctatgaacaacagatatctggccaattatggccgtactacctgctcttccggcaagtgctatttgtttcagcttgtttgagcgctataatcagcggcttgaaaaaatcctggccggacagagtgcagccagcgttgcttgcttacagtgctgtacagcaacgaaatgaaggcttggcaacgtgaccggcgacacgccttcctgtctatttacacgctacaaaagttacatagcaagcagataacgaatttcgtgctgcaaaaagcttgctggttctgctgaccaagtaaaagaaaagggagttatatccatgaatactatgattaccgttacatccatgccatctaccgttaagcgcagtgcaatgggtttgcatttgattggtgatttatacggttgttcgtgcgatgaacgcttgatgctggatgctgattttctggaaacgttctgcaagcgatgcgtaactgcagctggtttaaccatcgttggcagtcttttccacagttttggcgaaggaggcggtgtgactggtgtagtggtactggcagaatcccatttatccattcacacctggccggaatccggttatgtgaccctggatgtgtatgtctgtaactattcgttcgacaatcgtcccaaggcacagcaactgttcgacagcattctggaagcctttaatccggctgatccgcatctgcatcgggttgagcgtgcgtgatggaagaatccggcaacgcttacgaagcgcgctatatagcagagcatctgagcccggattttggtttttatctgcgtgaaagccagcaactggcaaaggtagactcaatctggcaaaagattgagatttttgagaatccgctgtttggtcgggtgatgcgcatcgatggctgtttcatgacctcggagcgtgatgaatttttttatcatgaacccatggtgcatttgcctgccatcagccatggtgcactgcgccacgccctgattgttggtggtggcgatggcggcgcggcagaagagttacttaaatatcccgggttgcagcgcctggtactggctgaactggatggtgaggtgatccggatggcgcgagaatggttgccaactattcatcgcggggcatttgatgatccgcgcctggagctgcgcctgggcgatgcgctgccttttattgaaagtagcgttgaacgcttcgatcagatcattctcgacttgaccgacccgttcgggccagcaaccgatctttacacagttgaattttatcgtgcctgccaaaagctgttgaatcccggtggggtaatttcgctgcatatcggatcacccattcatttgcagatacccatggcaagaattgccgcttcgttacgggaggtgtttgccatcgttcggccctatttgcagtatgtcccgctctacggcacgttatggtgtatggccatggcttccgatacaactgatcctcttcttctgagctcagaagaagttaatgcacgtctagataaacagggattgcaggatttgcagctctacaacggagcgactcaccatgccctgctcgcacaacctaattttgtacgcgagatcctgcagcgaccggttaaattaattcaccggggtgaaatacttgaaggaatcaacgaccccgaatcattgcctggcgttaccgtcatcccggactgaacatactggacgtgctgtatatcgttaccagcggcagcagcaaaatcattttttgctgtttttcgcaggtggagtgtgcttcaccctctgcatagccgtcaggtaagcaataatttcttccagaaccttctctcgctccggtatttctgcagctagcgccggcatggtcgtgttgtagcgtagactggccggatcatcaatccagcgtttcaggtattctggtttgaagtattcggttacgctgataggataatttaattcaggcgctttccctcctccttgcccgttgatggtatggcacgccatgcaatatttgcggaaatgtagaaaaccacgtttgacctcagcagaaacacgcgctggaggaaacattcccgggaaacgggtggcaaaagtagcgagctcaatgccaatgatctgatacggcatatcagcggcgccttctgcaagcaggatggggaatttcaggttgttccataccagataaaccggccctaattccaccacttcatgattttgcagtgtgttatccagtataaaaggggagccgtctgcgctcgcaacggcaagataggcgtcgtaagcgagaaatttcgccaccgggatactgggctgatagccatctttgcagctaaagacaatctcgtctgcagctctccagccttgtccaaaaattcgatccaaaacgggctgtacaggataagccttatattgacgctccctgcgctcgtgcacttcaaaaatattcaatattgtctgcctgctaaaggtatcgagttcctctggttttagcaattggacgacgttatcctgatttttgaatttgatgaaagtatccattgcatcagcttgtgcatgcgccagatggataaggccgatcattaaacacacactcagtattaagcatctgcaataaggcgtaatgcaactatggtgattgcaatgccagttgagaaaatgtttttgatctcgttccatttattcaaccagaaatccgtttgtctgccgggtccacagctgagtgtaggcaccattggcagccagcagttcggcatggctgccgtcttcaataatacgcccgtggctaaataccagaatgcgatccaggtgtgcgatggtggaaaggcggtgagcgactacgatgacagttttattttgcataagtgtattcaggctgttctggatggcttgttcggtcacggaatccaggctggaagtagcctcatccatgatcagaatcggcgcattctttacgatcacccgggcgatggaaatacgttgccgctggccgccagagagctttacaccacgctcgcccactagtgattcatactgactgggcatgcgctcgataaattcatgcgcatccgcgccacgtgccgccagttcgatttcttcctggttggcatcaggacggccatagcggatgttttccaacagtgtgcggtgaaacagccccggatcttgcggaatcaagctgatttgtgcatgcagagattgctgggtaatgttccggatatcctggccatcaatcagaatactgccttgttggggatcatacagccgcaaaatcagattcagcaaggtagatttaccagaaccagaatatcctaccagcccaacacgctgcccgccttcaatccgcagattgagattttcaaataccgggctgccaggaacatagctgaaggtaacatcacgcaattcaatacaaccctgggtaacttgcagcggttttgctccaggggaatcagtgatctcgtgttcacgcacgatggtgtacaccccattggtgatattgccaatgtattcaaacagatcaatgaaacgacggctgatattgcgcacttcattgatgatcagcaatgaaaggctgatgctcatcacaaaatcagcgaccgatatccgatcccgctgccatagccatagcgcaaacagcaatgttcccactttgaggattagtgctagcgaatattgaaaccagaggattctctcgttggaccagagccaacgtcgtgccgcagtaatttcattattcagaaaattttttaggtaatcgcgctcaaagcccagcatggcaaacagccgcacactggcaagattggtaacagcatctaccactttgccaattgtaatactgcgtgcctcggccgatttatgcgccaatggccggcaacgtcgtgccagctgataagaaatactcagaaagagtaatgcccataccagcgtgaacaaggctagcggaatactggcataccacagcagagcgactgataccgtcagcgtgacgacaatcggcagaaaatcaaataccagtgtccacaatgtcatgttgacgctagtggaagtttccgaaatgcggctggccagcgcaccggcaaaattattgctgagaaagcgatgcgaatgatgttgcagccaggcgtacagctcgctggttacctgcgcgcgcaaacgcggagcaacaacaatccggcaagaggcgctggcacggctgaacagcacttcactcaggttaagcacgatgtaaagcccgagtgggaaggcaacggcggtaaagatctgttcccgcacattgatcgcatccgttaccccgccgacaatctgtccgatggcatacggcgtcagaataccgctggccgaagaaccgatttccaacagcacaaccagcgcacaccagccggtgtaatgcctgaaaaaatgcagcagaaaaggaatcggttcgcccggcaacgctggtgcatgcggggaaaagtgggtttcattcatcagaaacgacaggaaaagagtatttgggcctcatggtaataagatatgaggcttgtacaactgacaaagcaagatggcgatgtacagatgcagtgatcaaaccaactgacacgttagggtcagtgtgtggaagataaaaaccggagcccggacgagcgataagtttgcccgggtttatttgcatttacctgataggtactggctaaaacgggatatcgtcttccatatcgtcaaaacctgtgctgctacctgtagtgccagttttagcaggtgtgttacttgaatattcgttaccttggtcggctggtggatcatagttaccaccgctgccaccacctgagcggccaccaagcatttgcatacggtcggcgacgatttcggtggtatagcgttccacgttggatttatcagtccatttgcgcgtttgtaagcgaccttcgatataaatctgtgagccttttttcagatattctccagtaatctcagccagcttgccaaacataacgatccggtgccattcggtgcgctcctgtttctcgccccccttgtctttccaggtatcggtagtggcaatattcagatttgccatggcatcgccgctgggcatgtaacggatttccggatcgcggccaagattgccaatcaacataactttatttagtgaagccatttatctatttccttccaataactgaaccactttttcttcatcaaaacccttgagatcaaccttcaggtaagccacctgttcattggccagtacaagcgcctcatacactcccggcagggctgccaattcgcgtgataagtcattggcctgttcggaattcatttctccgacctgatacattttggaacggacagctgccggtgcctgcatggtggtggccagtatcaaccaaataatcaacaacccgctgcacatgatcgccatggcgtaaaagccaaaatgctggaacaagtaaccgcccaaactggagccaacaaacgcacctagaaactgggtactgctgtaaacgccaatggcggttcccttagcgccaactggtgcaattttcgaaatcagtgaaggcagactggcttccaggagattgaatgcggtgaaaaagaccagtaatgcgaaaaccaatccccaaaaagaagtattgaagatcgccagtaacacctgtgccagtaacaataacgccacagcagcaatgaaaatcggtttcatccgggcttttttctcggcataaataatggcaggcaccatcaatatcaccgcgcctaccatgacgggcaaataaacttgccagtggtgggcagcggccaggccggtttcccgcagggatactggtaccaccagccagagtgccatcaggaccgcatgcagggcaaaaatcccatagttcaatcgcagcagctgcggatcacgtaacacgttaccaaagcggctggtagtaacctcggtgtccgagtgaaaacggctgataaccggatcaggtactaccttgtacacgaccagcattgccaatatggccagacagccggtaatggcgaaaatacccgggacgccgacccattgattcaggataggcgcagatatcagtgacagtgcgaatactgcgccgatactgactccaatcattgccatcgccttggtacgatgttcttcccgtgtcaaatcagctgccagcgccatgactgcggctgaaatagcaccggcaccctggatgacgcgcccgaaaataacccagtaaatatcggttgctgatgctgcgacaaaactgcccacggcaaacaagatcaggccgagatacaccaccggcttgcgcccgatgcgatcagacagccagccgaatggaatctgcagaatcgcctgcgtcaatccgtaagcacccagcgcgataccgatcagcgtgtaactgtctcctcctggcagatctttggcgaaaaaagtaaaaaccggaagaataatgaacagaccgaacatgcgaagtgcatagacacctgccagactgatggatgcgcgcagctccacccgggacattttttcaggaagtttggttgctgttctggatgcaggtgttgcggacatgaagcgtaattgtgaattgtgataaaagcgggaagttgggtatattatcaggttgactctttcttaggtagccgatggaattcatcaggatccgtggtgcacggacacataatcttaaaaacgtagaccttgatctgccgcgcaaccggctgattgtgatcacaggactatccggctccggcaaatcttcgctggctttcgatacgctgtatgcggaaggccagcggcgttatgttgaatcactttctgcgtatgcacggcagtttttgcaattgatggaaaaaccggatgtcgatctgatcgaagggttatcacccgccatttccattgagcaaaaagccacttcgcacaacccgcgttccaccgtggggacagtcaccgaaatacatgattatctgcgcttgctgtttgcccgaacgggggaaccgcattgcccggagcatggcattgcgctggcggcacaaagtgtttcgcaaatggttgatcaggtactggcattgccggtagatacccggttgatgattctttcaccaataataaccgggcgcaagggcgagcagctggaattgtttgatcagctgcgttcgcaaggattcgtgcgcgtccggctggatggggaagtgcatgatatcgacgccctgccgaagttgcagaaaaataggaagcatacgatcgaagtggtgatagatcgtctcaagatttcactggagatcaaacagcgcctagcagaatcttttgaaacagccttgcactatgctgaaggcaaggcaatagcggtagaaatggataccggtaaggaatacctattctctgccagattcagttgtccggtatgtagctatgccttatccgagcttgaaccgcgtctattttccttcaataatcctgctggtgcgtgtcatcgctgtgacggattggggcagatcacttttttcgatccggcgcgggtggtggcttttccgtatttatcactggcgacaggcgctatcaaaagttgggatcggcgtaatcagttctatttccagatgttgcaggcagtggcaacgcattaccacttcaatcttgaagttccattcgagcaattgagtgaggctgcacaacaggttgtgttgtatggttccggcaaggaaaaagtcacctttacttacttcaatgagcaaggcaaagccaatcagcaaacgcatgtgttcgagggcattatccccagcctggagcgccgttatcgggaaactgaatcacaaactgtacgcgaagagctggccaaatttatcaatgcgcgcgtctgtccggaatgtgaaggtacacgcctgcgccgtgaggcccgccacgttacagtgaatggtgagacaatttttgcaatcagtgcctggccactgcggcaggccaaacagttttttgatgaaatgaagctggaaggccataagcaggccatcgcagagcgtattgtcaaggaaatatccagccgtctgcagtttctcaacaatgtcgggctggactatctttcacttaatcgatccgccgatacgctttccggcggagaggcgcagcgtattcgccttgccagccagatcggctctggcttgaccggtgtcatgtatgtgctggatgaaccttcgattggtctgcatcagcgtgataatgaacgtttactggaaaccctcaaacatctacgcgatctcggcaatagcgttatcgtggtggagcatgatcaggacgccatcctgctggcagatcatgtcgtcgatatgggccccggcgccggtgaacatggtggacgtgtggttgcagaaggcacgcccgcagcgattcaggaaaatcctgcctcattgaccgggcagtatctttccggaaagttagccattgctatcccagctgcgcgtacacctcctgatccggaaagaatactgatcatacgcggagcaagtggtaacaatctcaaacaggttgcgcttgatttaccggtcggactgctggtgtgtgtgacgggtgtttcaggctcgggaaaatccactttgattaacgatacgctgtatcgcgctgtggcgcggcatttgtacggcagcttgactgacccggcggcttaccgggaaattgatgggctgggctttttcgataaggtgattgatatcaaccaaagcccgatcggacgtactccccgttccaatcccgccacctacaccggcctgttcaccccggtgcgtgaattattcgccggtgtgccgcaagccagagaacgcggttatctgccaggccgattttcgtttaatgtcaaaggcggacgctgtgaagcctgccagggggatggtgtcattaaggtggaaatgcattttttgccggatatttatgttgcctgcgatgtgtgtcatggacagcgttacaaccgggaaacattggagattcaatacaaaggtaaaaatatccacgaaatcctgcaaatgaccgttgaaaacgcacgtatattttttgaagcagtgccggtgattgcccgcaagctgcaaaccttgctggatgtgggactgggatatatcacgctgggacaatctgccaccacgctatctggtggtgaggcgcagcgcgttaaactttctctggaattatccaaacgtgatactggccgcacactctatattctggatgagccgacgactggtctgcattttcaggatatcgatctgttgctcaaagtgctacaccgcctgcgtgataacgggaatactgtggttattatcgaacataatctggacgttattaaaacggctgactggattattgatcttggtccggaaggtggtgccggaggcggtagaatcatcgccgagggcacaccggaagccgtggcagcgatgcctggcagttttaccggacagtttctccagccattgctttccagtactacccaaacctcttcatgaatccgcgcgaacttctgcttgatagttttcatgctgctgttaatgcagctgatccgctgaaaattgtgccttgtcatctgcctgaaccgccacgcgggaacacgctggtggttggtgctggcaaagcggctgccgccatggcgcgcgcagtggaagagaactggccagcagatcatcccctggaagggattgtggtgacgccttatggtcatggtctggcgacgaacaacatcatggtgattgaggccagtcatccggtaccggatacacaaggtgaaatggcagcccgcgccatgctggaatcggcacgcatactcacgccaaatgatctgctgctgggactgttcagtggcggggggtccagtctgctgtctgcgcccattcccggagtaacgctggatgaactgaaatcaattacccgccagttattgcgttgtggcgcggcaatccaggaaatcaatatcgtgcgcaagcatttatctgtcgtactgggtggcagattggcagccgccagccgggcatcggtacacagtctgatcatctcggatgtcaccgataacgatccttcctccatcgcatccggaccctgtgcgccagatccctctacctggcaggatgtgctggcactgatagagcgttatgcaattaacattgctccgcaaaccatgggaatcctgcagaaaaatgtcaatacaggcagtaacgaaacccccaaactaggcgatccggttttcaggaacgtgaaaaaccggataatcgctacggcgcggcaatcactcgcggcggctgcacagttttttcgtgcacaaggcattacaccgctgattctcggtgacaccgtaactggggaggcaaaggaaatcgccaaaatgcatgcggccattgcgcgggaagtacgccattacagcaacccgtttaaaccgcctgtagccttgatttccggtggagaaaccacggtaacggtaacaggttctggcaggggcgggcgcaatgccgagtttctgctctcgctcgccatcgcactcaatggactggaagaagtttacgcattggcttgcgatactgacggaatcgacggcaacggaaccaacgccggtgcagtaatcacaccagataccctcaatcgagtagagcaggccgacgttaatccagtaagattgcttgatgacaatgatgcctggactttctttgaccaactggatgatctgattgtcaccggcccaacccgcactaatgttaatgactaccgggttgttctggttttgtagctctaaatattggataggtttatgtcttggtacatgaatcaagtatccggcccactggaaaaagggctggatacccaggacatcaaatcctgtagagatacctactggttttaaagcaatttacgcgtaagtttttcttaacacatactgcaaaatgccgccgtgacggtagtaatccacttcaatcgcggtatcaatacggctgcgtaatctgacttcccggcgcgaaccatcctgactgtgaatgaccagtgtaatttcttgttgcggttgaagatcacccagccccagaatatcaaatcgttcatcgccctgaatacccagagaagccatgctatccccttctttgaattgcagcgggagcacgcccatgccaatcaggttgctgcggtggatacgttcgtaactctccgcgattactgctttgacgcccaacaattgtgggcctttagctgcccaatcacggcttgaaccagcgccatattctttaccggcaaatactatggttggtatgccatcctgaatatactgcatggctgcatcaaagatactcatttccttcccgtcacgatcgccatcgttatagtacaacgtaacgctgccttcactgccaggcaccatcagatttctgatacgcacattagcaaatgtgccgcgcatcatgacgcgatgatcccctcgacgcgagccataactattgaaatctgcccgggcaacgccatgtgccagtaaatattgccctgcaggcgaagattccatgatggcgccggcagggctgatatggtcggttgtaactgaattaccgagaattgccagcgtacgtgcgccatgaatggcatctggcgctttggtttgatctatttccagggaaaaatcttcaaaaaagggtggttcggcgatgtaagtggaatccggccagtcatacaacttaccggtagccgaggtgatatcgttccaaagtgtatgatcccgagtgaaatcactgtataagcgacggaaagtttccgcctgggtcgcaaatttcatcatggattcgatttctacgttagttggccagatatcgcgcaaccaaacaggtttgccatctttatcctctcccagtggttcgcttgtcggatccctcagcaccgttccagcaatagcataggccaccaccagtggaggagatgcaagaaagttggcgcgaatattggagtgaatcctcgcctcgaaattgcggttaccggataataccgctgcgcataccagatcgtccttgacaacggtttcttcgatcacttttcgcagtggtcctgagtttccgatacaggttgtgcaaccataaccggccacgttaaaaccgagctgttcaagataaggtaacaaaccggcagtacgaagatactctgtaacgacacgtgatccaggtgcaagtgaagtcttgatatgttttttgactgccaggcctttttccactgccttttttgccagtaaaccggcagcaattagcacacttggattggaagtattggtgcaggaagtaatggcagcaatcagtatgtcaccgtggtgcaactcgattggttggatcggtgtgccgttggtggcagtttgaggggtagggcggttattggccatctcgaccacattgcgcgcacttccaggtagtaatgcagattcactttgactgctgtcgggtgcaacgcaaaggttggattgtgcatgcttgtcgcgggtggtataagtatttcctaatacttctgccgctttgccgtagccattttccttgataggtttgctgaataattcagtgaaagtagattttagatctttgagtgcaatgcgatcctgcgggcgcttcggcccagccaatgaaggtgtgatagtacttagatctaaggcgagctcctggctgtaatcgatatccccatggcgtggcatgccgaacagcccttgcgccttgaaatagcgttcgaaagcatcgatttcttcttctgtacgaccggtatatcggaaataggcaagtgttgcatcatctactggaaaaaagcccatggttgcaccgtattcaggagccatgttggcaatcgtggcgcgatccggcagactcagcaaagtaacaccttcaccgaaaaattcaacaaacttgcccactacattggctctccgtagcatttctgtgactgtcagcactagatcagtcgcggtaactccctcctgcagatgccctgttagattgacgccgactacatctggcgtcaggaaatagatcggttgcccaagcatacccgcttcggcttcgattcctcccaccccccatcccaccacgccaataccgttgatcattgtggtatgtgaatcagttccaaccagtgtatccggataaataaatccatccttttgatgtacgccacgcgcaagatattccagattgacctgatgcacgataccaattccgggaggaaccacgccgaatgtatcgaatgcttgcataccccatttaatgaactggtagcgttcccgattgcgctggaattcgatttccatgttccgtgcgagtgcttggctatcaccgtaataatctatctgaattgaatgatccaccaccagatctaccggtactagcggttcgatcaactccggattttttcccaatctcttggctacactgcgcatcgcggccagatcaaccaacaacggtatcccggtgaaatcttgtaatacgatacgcgccacgacaaacggtatttcctgagtgcgttctgctcttggctgccaactagcaagttgtttgacatgagcctcagtgattttcttgtcatcgtaattgcgcaaaatagattccagtatgatccggatggaaactggcaaacgcgagatggttcccagcccggctgcttcaagcgcaggaagcgaataaaactggattgtttcaccgttagatagaggtaacgtacttaagctattgaataaattgtgggccatgatggttccttgaataagagacgacgggcattttgtatttatgcagtaaccgtttaagtttatcattcgccactggctgcaaccaaatacttgacctgacaccgatggttacagcttttttgtatttttaaacgggagaataatgaatatcgagcaactaaatcaaaaatacggaattggggagcaggtagtttttaaagagggagaagggggtttaccctttattcatatcaagaatgaaaaggccaatgcactgatctcgatttacggcggacaggtgcttgcattccggccgatacatgcgcaagacgatcttctgtttttaagcaagcgcgcctattatcaacagggcaaggcaatcaaaggcggtgtgccgatttgctggccatggtttggcccggatccggaaggtaaagggcgatcagcacatggttttatgcgcaatcgcatgtgggatgtcatcgaaacatccacaaccccggaaagcggcactcgaatcgtactgggatcaaccgataccgaagaaacgcaatccatctggccacgcgcattcattttgagactggaaattaccattagcgatacgctcaatctggagctgatcactcgcaatccgggctcacaagtatgtacgatcacacaggcttttcatacctacttcagcgtggaggatattcggcagacacatgtatccagcctggaaaacactcgctatatcgataaagtgcacgataacctggaaaaaaaccagatcggcgttgtcaccattgaggcggaagtggatcgaatttaccagtccgtcgatagcaatctcatcattcacgatacagctcgcaaacgccgtatccgcatcacttctaaagggaacagaaccgccgttgtgtggaatccctgggcaaagatctcgacagaaatggcagatctggaagatgatgattacctgcgttttatttgtgtggaaaccaccaatgccgcgacagaccgggttcatatccagcccggcagtgagttccggttggttgccaattaccggattgagcaggactgacagaaaatctccagaattttctgtttgaaaacaaggaaaaacaatggctctaaaacttaacattatcacctgtagtactcgccccgggcgcatcgggcctcatgtcgcacaatggttctgcgaagtcgctgtccagcatggcaaatttgacgtggtaccggtagacctggcggaatttaatctgccggtgtacaacgagccggaacacccagtacgccagcaatatcagcacgcgcataccaaagactgggcagtcagtgtccacgcagctgatgcctatgtatttgtgactccggaatacaatttcggcccaccgccctcactgctcaacgcgctcaactacgtttacaaggaatggaattacaaacctgctgggattgtgagttatggcggtgtatcaggcggattgcgtgcggcccagattctgaaacaaacgctgactaccctgaaaatcatgccaatagtggaagccgtcaccatccagaatgtttccacacacgttgatgaaagcaaacacttcatcccaattgattctcatctccgtgctgcgacaaccttgctggatgaactgtacaaatgggcgcaggcgcttaaaacactgcggtaatactgctgttgccagcagcctctgttcggggtggatacctaatctaccctgaataactggctggatgcatgatgaatctccctcgtcgtcgattatctggaataggctttcaatccttctcctcatggacatcccagtccattgggcgcgcctcgccagtctggtagaactgcttcaccagcttcacgtaatccagaaagtcccggttctcggttgccagccggttggccatatcccagtcgatctcatcgcgctcgcgaaccggaatcaagacctgactttctgccgggttctcggcatccagtttgatcaagccgatgccgtgcgcggcgaacagcatccgcaattccttcagcgtatcctgcccctcgatttccgctgcgaccaaatagccgaggttcgcccacgaggagttggaaaccgcctggaagaagcattcacgcacgttcgaccggttgatcagcaacttggcctcgaacgaccacagcttggtgcgcttgtcggaatactgattcacgcagtcacgcacctcctggtgtcattcagcacccaagtcctccatcccgaccacgtccgggtacagccagcggttaccgtttggcccgcgtttgtttgatgagcgcctctcgtcgatccgcttcgagtggacgccaaactcctcccacagatacagtgagagcattgagtacatcgcatgctccccgagcttggcaacattgctgtctgccataggggtagcaatcacgccttcagccgccgcaacctcggccacgtcagatttctcggtgtagtagtacttgcgcggcctgccctcggtggtcttcagctcagggtgccgcttctgcaaactggatcgccgcgagccaatttccgccaccaactgctgcaccaagtcactatcggtcttgatgtagccgccctggctgttggactttttctcctggcaatctgctgggtaggtgctaaaaatccactcggcaatctgccttgccgtcagcctttcgtcagggcgagctttcaaacaatccagtacggctttcgccagattcaatgccatatcgtattccccgactatgaaatattgacgtagaagcggccgcttcggccaaggctgacgcctcgtttcaagtcaacagcgaaacactcgacccagtgtttccctctgtaaagggtgtgctcccatatctctgaaccggaatgatcgaacccgcccctgaggcaccttacggcccttgccgcccagccggtgttaacgatctgccatttgatcgctatgccatttgtgaaagagtgctttgcgctgaagtgaagccacgtgtctggcgacaaggcaggtccatcagagcggtaggttccgaggaaatttccctctttggacgaatgcagcgtcgcagtaatttcaattcgtccagcaggcaagacaggccaagggggccgggtaacgtgagacacatcatcaatctgagtctcgatcagctttgccgccttggtgagaaccactgacttggcaaaatcatcaccaaaaatccttcgccatttgacgatactctcgtcacgatctgtctctaagtaagcatcctcaacccactcagcgtagcgattgatgcaggttctgaagttggaatacttgtcttgatcccaatgtctagtgaatgattctgacggcaacttaggatttacaacctcgggcatatcagggtgctgctgcaggtatgcatccagtctcttgatcactgtccagagcgcggttggcgtgtctgagaattcgttcccccgctcatcaagccaagagatgcgttcaccaatcaacgtcgtcagcagaattgatttggctgaaaatgtcagtttgaaatcgcgcaggtacttcagaattcggacaaccttgatcaactggttgttgccaacatacccgttccgctgcaagaaccactctgtatatccatcgggatttgcctgctcctcgacgtcatccttgcgattcagaatccattccgtggtttcccaaatgctggctctgcggatacacggcactacatcgattgagaactcccccgcatactgaatcgttacgcaacgcgtcttgcgcgacaccttgtcagaataagtgccgtgcgccttgaactggtcatacaaatggtcgatgtaatctgccggagtccattcttcgtgtggctctaaaaaagcaaccacatccgcgtcaaatgatccagcgattccagctggcttgatgatggtgtgatgcgcccatgacccttggggtgtcgtatcgatcagaatgtcagaaaaaacatcaaaaccttcgacagcggtaacgatggcatccactcgcgctttcagcgtgtcaatgcgcgtctggttgagattgataacgtcaaccaagaacgtattgaaatgttcggccagcttcattgatttcctccaagcaactgccgaatggccgctgagttatgtgtgaagtccttgtctgctcggcttatcaaatcatcgagggtgccaatatcatcaagtgacaatggcagatctgactcgaaattcaccctcacggactgatgcttgtccaaaatgagctgtgtgacattgctggccgttgccgcttggaggttcaagagcatcgagatgaacttggaaatcccccagccgttcaggaatccccattttttatccgcgttagaaagcgggtagtagttcttgccgacccccgtccctacagataacaaccgaatcgcggaacactccgccccgaggcgggtaagagcttcggtaaccgcaattaacgaaggattgttcgcccatagcccgccgtcgctcaactgatatgggcctacccttgatggagcgaagtacgacggcgcactgcaagaagccaatacagcatcaacgaccttaacgttgcggtcgcgaacaaacttctcgtcgtatgcagacttgaaaacatgcacgccaccattgccgatgtctgtcgccggaataacaagtcttgtccgtgcatcagagagcgttgcatcttcaaaaacagaaaccaaagccgcacgcagcggctcgctcgaatagcgaggggcaatggtgccgccgaatgtccacctcttcggtctgaagatattcggccccttttctcgataaagctctgtaacctttgaaatcggaatgccaaatgcaatcgcggcggcgatgatggaaccagtgctcgtgccagcaatcagatcgaattcactgtgaaattcagttttgaattccttctgaatgcgctccaggacatggctagcatagattccgcgaattccaccgccatcaattgcgagcaatttcatagtgaccaatctcgtcacccgccgttcttgccggatgttcggatttgttggtacacagcccgcatcagatggctcgctgcaacattcctaaacgcctcatcgttcatcaggcgtacaaagatttcttcgttgccgtccatgcgttcgatgaacaggttctcaagctgcttgttgaataccggttcgaagttttcgatgctgttggccatgacggcctgtcgcaactgttcgttggctacggctgtttcacggacttgatcgaagaagagctggtcggccggggtgaactctgtgccgaagcgctcattgagcttgccaaccaaggtcgaaagctgcacatcttcatctgcttgccccgtgccaacatcggttggcccataaagagcctcagcctcacccactttcagatcaattgctccttcgctgattttttgcagtcggtagtacttgagctcgacctcatcgtcgacttgcaccgtccggttgtctgtggtgcgcggcagcttcgtcagcaggaaacgggcgtaggtgtacagcttctcgtgatcggagtcctggtaagggacgatctgggaaacaaagccgtacaggttgcggaagctaactagctgccccttgaacaggttctggtcttcttccccgaactgcttgaaccgctcaatcgccagatcaagcaggccattcaatttcttatgttcgccgcccgtggggttcagccggttgcggaaccagatttcgcaccaagcactgacctcggcttcggtatagattttccagttggctagtgtgtgcgccagcgtgttgagctgttgtgggtcggtatcgtcgcccttgtctgtcgcttcgtaatacggcttgaaggcggtgtagatgtccgcaggctcgttgacaaaatcgagtacgaacgtgtcggtcttgcctcgtgtcgttcgattcaggcgcgagagtgtctgtaccgcctggatgccagacaagcgcttgtcgacatacatactgtgcaacagcggctggtcaaaacccgtttggtacttctcggctaccagcaagacttggtattcctcagtgttgaacttctccggcagctcggattccttgatgccgttgttcatgctcacttcggtgaattttttatcggcgaactccttgagggtgatttctccggagaacgccaccagcgatttcacgtcggtgtagcccttgtccttgatgtacttatcgaaccccagcttgtagcgcacagcgtgctcacgtgagccggttaccaccatcgctttggcccggccgccaattttgtggcgagtatgggtgcggaagtgctccacgatcacttcgactttctgtgcgatttcgtagtcgtgaaactcaacgaaccgcgccagtgcgcgggcggccttgcggcgcggcacctctggatctgcctccaccttctggatcagcttgtagtagcgcttgtagcaggtgtagtgcgccagcacgtcgtgaatgaagccttcctcgatggcctgccgcatgctgtagtggtgaaaaggtgctttgccgttggggccaggttcattgaagacagccagtgtcttgaactttggcgtagcggtgaaagcaaagaaactcaagttgggttgtttggctcgcttgagttgttcgcgtagcagctccttctttgcctcttcgctcaaggcatcgtcatccatgtccaacaactgctcggcaatcgcggattcaatgccatccttgttcaggatcttgcgcaactccattgcggtttcaccactttgcgagctgtgcgcctcgtccacgatcaccgcgaagcgcttgcccgctgtcgagatggctacgcccttgccgttggcctccatcgtgcggatagcctgggtgatgaaagggaatttctggatggtcgaaatgatgatcggcacaccatcggccagcgacttcgccaattgctgtgtgttttcgtcgatcttttgcaccacgcccagcttgtgctcaaactggaaaatggtgtcttgcagctgctggtcgagcacacgccggtcggtaatcaccaccaccgaatggaagatcttctcgttgttggtgtcgtgcagactagaaaggcggtgggctagccaggcaatcgaattcgatttgcccgagccagcggaatgctgaatcaagtagttgtgccctgaaccatgtgcttgcgcgtggtgggtcagtgcgcgcactgcatccagctggtggtagcgcgggaagatcatcgtctctttgcggtggcgcttgatacccttttcagtgacgaccgtcttttcctcgacatccaaatggataaaacgggccaagatgtccatcaggctgtcacgggtcagcaccttgtgccacaggtaggtggtacgcacatcgcccgctgcaggcgggttgcccgcgccgtggtcatgccccagattgaagggcaggaagaacgtgtccttgccctcaagcttggtggtcatgaacaccagctcagtatccacggcgaaatgcaccaagcaccgctgcttgaaggcaaacaacaattccttggggtcgcgctcaaagcgatattggtacttagcattctccacgttccagcgcgtagccgacatcggattcttcagctccagcgtggccacgggcaagccattcaccgccaacaccacgtcggggatggccccgctcttggtattgacctgccgcacgatggtcaagcggttgtcgtcgtaacgttcagtactcgcggggtctagcccggtgttgggcgcaaagtaggccagccgcaccgtcttgcccacgcacttgaaaccctcgcgcaggatcgccagggcgcctttggcagcaagctccttcaccaagctgtccagcagcatcgcgggcgctttggctgcgtcgagctgaattaggcgcgtccagatcttgggctgggtcttctgcacaaaggcaacgacatcccccggaaacagcgcggtgtccgggtcgtaggttttgggatcacctttttcgtagtcaccgctgctgatcagtgcgtgttcgatgtcgttttcaaagtcaatttctttgtgcatctttctcaccctttaaatgcgttggattcggcttgttagcgaatcacctcaatattgctgttttccaaatccgccagcgacatgccattgaggtcggcatagcgatagtggcgtatcgtgtgatcgcgctgtaggtatttgccgtcagcatccaaatacggcgttggatctggatgattgctcagtacgtacttggtggcctgaatggcgctgcgcttggtggtgtacgcattgatggtggcgtgcagcgccttgagccaatccacactggctttcaactgatctggtacgtcgtgcggaatgctctctgacttgaactcaaagcagtacacatgcagtttgctcttgcgcaggttgaacaccacgaagtcacaccgcttcgaccaaggcttggcggtatcgtccagaaagtgaaacagcggcagtgacgagccattcttcttggtgtccagcttgatcaccaaggtctcacccgtggcctgcaagctcaccttgtactcaatcggcttgctgccgctttgaccgaacaccttctccttcagtaccacctcactgccattcgtctgcggctcgctatagtggttgatgttcaggtaggacttcaggcagttgaagtagccttgcgcgttcaacgccatttggttctgcctccattcatgaggcaatcccttcggcaggttgcgaaatctcaaaaccgcgtacgtcaattttcccagtgacggcgtttgtaaccaatgcggatcgatattccatcaatctatcgatgacggcattgatgagctctttttgcacatccatacgcgcagaaacgtcgtcgagaaatttgccaataaccttttgctcttcgagaggcgggtaggcgatagactcatttagataggattgactatccagattctggattccagttgtctgcttgatagatcgatagttaacacgcccggcgtaaagatgagaatgcaaatagactagaaaacgagggtcggagtcgtcgctggccaccatccttgcgatgaaattggagttcaccgcaggaaatgattgattaaattcaacgacggtcccaactagttgatgttcaccaccgccggatttttctagaagcaaatcaccattgtttagcaagcggttgcgacggtctttttcggcgatgctgcgcatcgtcagcttctccgtggagacacgcaaagactgtcgatcaaagtccgcaacacggatacagaccagatcgtcgtcgccatccggctcggccccccagacaccgttctggcaggacgagatagaccatttggctctatcaattacccaatgaacaggaatcttcccaagccacgctacccccgaatccttcatcgcaacggatgaatcaagtccctttgtgacagcatggctgatcagcgccgtgcgcttttcggcaagtttgtcgagcagcgattttttctttgcgatcagggcatcaatttgtgcggttttgaaatcgaggaaacgggcgatggcttgttgctcatctagtggcggataggtaattggctcatcgagataggcttggctatccagattctgaatgcccgtcgtttgctttattgacctgaagttgacccgccccgagtagagatgtgaatgcaggtagacgaggaatcgggagttcattccatcgcttgcaaccatccttgcgatgaaatttgaggtcacagcaggaaatggctgattgaattcaacgacggccccaacgagctgctgctcgccacctccggatttctctagaagcaaatcaccattttttagcaggcggttacgacggtctttttcggcgatgctccgcatcgtcagcttctccgtggagacacgcaaagactgtcgatcaaagtccgcaacacggatacagaccagatcgtcgtcgccatccggctcggccccccagacaccgttctggcaggacgagatagaccatttggcgcggtcaattccccaatgcgaggggatctcaggaaaccaatcgcacccagtagttttgtatgccggataggcggggtattgcttcatcacaccacctcactcagcatagccacgatgtctttttcgagttggctgatttcacccacaatttcttccagcgggcgaggcggctggtagatgtagaagtgccgggtcagtgggatttcgtagcccaccttggtcttgctgtggtcgatccaggcatcgggcacatgcggcagtacttcagccttgaggtaggcttcacagtggtctttcaccagcgctaacagcttgtcgtggccggtttcgttgtcgtagccgagcggcagcggcagtgcaatgtcgttcggcagtgcgacgatttcagtatcgcgcagatcggcatcgggttccgggttgcccttggcattcagacagacgtctgccttggggtcgcgctcagacagcgccgccaggatggttttcttcaccggtgcaccaaccttgatggctgccttctttaaagcggcttcgagtacagactcgaaagcgggccgattgcggtagagcgtttcaccgtccatgccttgcagggcggccttgattgccgcttgcgtttcttgccccgttgcaatttcggcgcgataggccgcatcgtccttgcgcttcttgctgctcgccagattggcaaaagcgctttggccatccagcttggcgatacgttcggcgctagcttggaagttcaagcgcaacgggcgttcgacggtaatcttgagaaatccaaactcgcggttgtcgaagagcttgctgcaaacccgacgttcaggcttgccgtccagcagcacttcactttccgcatcgtggtcgtgctcggcgtacaggcgcaccagttccttgatgtggtcatcagagagttcattgcgcttattgcccaggctcttgtccattttcttgaaatggcgcgcgccgtcgatcaactgcacctggccttggcgatgagtgggcttcttattggtgacgatccagacataggtgtagatgcccgtgttgtagaacatctggtctggcagagcgatgaccgcatcgagcatgtcgcgctcgatgatccagcggcggatgttggattcacccgatccagcgtcaccagtgaacagcggggagccgttgaagacgatagcgattttggaaccatcgccgcccacgttcttgccatcgaccagtttgggtggctggtgcatcttggagatcatgtgctgcaagaagagcagcgagccatcattgatgcgcggcagtcctgcgccaaagcggccagagaagccctggtcttcatactcttcgcgcacgaagtcttcttccggcttccactccacgccaaagggcggattggccagcatgtagtggaatttcctgtccgggtggccgtcgtgcggcacaaagccgttggtcttgttcttggcgtccttgatgcccagagtgtcgccgtagatcaggttgttgatcggctcgtccttgatcagaaggtcagagcagcagatggcataggactcggggttgtattcttggccgaacaattcgatgttggcctggggattcttggccatcgcggctttttcagattcagacagcatgccgcctgtgcccgcagttgggtcgtagacacttcggtagatgcccggctcgaagatgccgtcttctcccgtgaagaccagctcaaccatcaggcgaatgacttcacgcggggtgaagtgatcgccggcctcttcgttggcttgctcgttgaacttgcgcaccagctcttcgaacaggtagcccatctgcagattggtgatggcctttggcgacaagttgatgtctgccgagcagaactccttgatgatcaggtacaggcgattggcctcgtccagcttggcgatttcggtttcaaactcgaacttgtcgaagatgtcgcgggcgcgtggtgagaagccttggatgtaggcgatcaggttgcccgcgatgttaggtgcgtcacctagcagcttctcaaacgtgaaaccgctggtgttgaacagctcctgcttgcggtcggctgctgcgatgcgtgacagtgccttttccagcgccgggccagtgatgcctttgtcttccaggcgctttttttcgtccagcaccttctgcttgttttcggccagaaccagatcgaagcggcgcagaacaatcagcggcagcatcacacgacggtactgcggcgggcgataggggccgcgcagcttgttggcgatgttccaaatgaagccgaccaggttttggtgttgggcgttttgcatgggcgattcctgaatacgattagttgttatttacttgctgtttctgaggcggttactggcaatggtaaattgatctactaacgacaatataaaactgacccacctgaggcaaaattgctgccgatgattaatagaacaaggcggtgtacatttaatgctaacccaggagccattcatggaaattcatgtgttacgccgacaaggcaagagcattcgtgccatgcgtagcgcgccatcctgctcagccactttgtgggtatcgagcaactttttgcgctccagcaccgcctgcttggtcgactccagcacggcatcgagccgccgcagcacggtgaagggcaggatcacatcacggtacttgccgcgcacatacatgtcgcgcaggcggtcgtcagcgatgttccagatgaggtccgatatccacttgatctggctttggtcttgttgttgtttcttctgcatcgatacgttcctcagctcgctgccgttgcagcaagcgtgagttgccaatgattacgcttgtttttcttcacagggcagacaggtggagcagattactcagacaacgctgggcattccacgtattcgtgcggcaacatcataccaattgcatgaaaactgtaggtaatctattgtattttcagcctgatcggctttcagggagaggttatttatcccgcaggcgggttcttaaacgcgagatagcctgggtgtgaagctgacagatgcgtgattcgctgacgcccagcacattaccaatttcgcgcaggttcatttcctgttcgtagtacatacccatgaccagtttttccttggcaggcaatttttcaatggcggcgaccagcagttctctcagatttttttccagcaattggtctagtggctcattaccctggtcattacatagatgatcaagaaaatgatcttcttcatctacctgaaaatcctcgtaatagatcagttgcccgccccccgcttcttgcagcatttcctgatactcggctagtggcaggttaagttcatccgcgatttcctgttcgctgggcgggcagccaaggcgttgttccagtgtgcgcatagcggtttcgatctgacgcatttttctacgcaagctgcgaggcagccagtccgcttcgcgcagttcatccagcatcgaaccacggatacgctgggcagcgtagctttcaaactgacgtccgtaggaaccttcgtaacgattgatggcatctaatagtccgatcattcctgcctgaatcagatcatccacctgaacgctggctggcagtctggccatcatatggtaggcaatccgtttgaccaggggtgtaaattcaataacaaactggtctttatcaatggttcctgcttcggtatacatagattcactcacaccgtaaaatctgccgtatcaagatgactggttcgtatcagtctgcgcatgaaattttccacaccgtcgttatctgtccaaacgcccgtgcattgcatcagtttctcagccagttgccggtaacctgcagctgatttggatgccgggaaaatttccactaccggctggcaaagctgggtggagcggcgtagtttgtcatccagcagaatgcatcccatccactccagtctgacagccaggtttttttgggcaacgctggcaatgttgtcgaaaatatcgcgcccgatgttttccgatgccactttgttgaccagcaccaggaaattgcgccgggcgtattcctggctgatgagcttgattagcgcatatgcatcggtaatggcggtaccggaaccggaaagtacgatcagcacctgttgggaagccaggctcagtggcacgacccggctggttttcccggtagcggtatcgatcaataccacatccactgactgggacaattcatagaagcattgaatcaacctttcctgatcaatgagtgaaagttttgccagcgagtgaatgccacgcattgctgttaaaaccattacaccttccggcccttgtgtcatcacctgttcaagcgtcttatcctgattaatcacatgcagtaaatcgtaacgcgcattcaggccaagattagcattgacgtccttgtggcgcgggttttcatccagaatcagtacacgtttgcctgtttttgccaatgctgcggccaggttgatgactgaacaggtttttccaacaccagttcgtccaccggcgacagcaaacacgcgtaccccggtattggaagccagcgcagacagctcgcgcaggccggatgcctggtctttcctcacctcagccatgatctgcctcggcacgttctggttgtctgatagctggttgatcgccagcactgcttgccatgatcaatgcaaattccgggtcttgcagcgaaaagggagaattttccggagaaggcttgaaaatacggtgcagcaggtagcgggaactagcttcatgcagatcttccggaaccttctggccattggtgacgtaatgcagcaccaatttacgccggatgattgcatctagcgcaatacccagactggctgactcatccaccttggtaatgatgcagccatgaatgttatgtttctggtaggcggaaatcacttcgtccagcgtatcgccgctgctggttgcactgagtaacagtaggtgctttatttttgtaccacattggctcaacatggcgatctgttcagccagcatctggtcgcgctggctcataccgacagtatcaatcagcaccatgtgtttgccgcgcagttcgtgcaacattaactgcagatcctcaatatccttgatgctgcgtaccgatacccccagcaacttgccgtaaatgcgcagttgctcatgtccaccaatacggtagctgtcggtggtcagcagcgccactttgtcagcaccatgccggataacagcgcgtgcagccagttttgccgtagtggtagttttacctacaccggttggtccgatcagtgcataaataccgccttgttcaatgatttcgtcagcggttgcggtgcgtaaattaagcgtgagcagtgagatggtttttttcaggctttgctcgaaatcacggtcggccggcagtttttccagtaagtgacgtgacagtaacggactgaagcctgcactcagtagtgtgcgcagtactttcatgccacccggatcccgttgtgaaaaattgctccagcccatggtggtcagttgctcttccagcatttgtcgcatggcctggatttcctggatgatgtgcgtgcccgggctgtccatcgcaggtggctgtgtttccggctgtttgcggatagtcgctgtctgctctgttccggaagcagttggcttaactgctgaagaatgtgcagtcgcttcgtgcggcgtatcgctggtgagtatggaaatatccttgcctgccaacgccatgatttcaatcccgcccggtacttgtttgtttgacaaaatcacggcatccgcacccagctcttccttgactttgcgtaacacctcatgggaggtggcggctaaaaattttcttactttcattttttgttacctccaatgatcgatatgaattttatttttctggtatccggaatttcggaatgagccagcacccgtaattgaggcagcgatcgacgcaggaaacgggacagcagcaggcggattgcgtccggcactaccagcacaaccggtaatccgagttgttccagccgcttgaccgagctgctggcttcacgtgtcagggtgttggccaggccgggttcgatgccgccgtctgccactggatcggattgcaccacctgtatcaggatgttttctagttcagggtgcaaactcatgacctgcatttcagcgtcagacgggaaacattgctccacgatcatccggcccagcgctactctcaccagcgccagcagttcgctgacatcctgggtgcgccctgcatgttctgtcagcgtgtcgataatggtgcgcatatcgcggatattcacgccctcttccagcaggtgttgcaatattttttgtaccgttgccagtggcagcagcttgggaatcaaatcatccgtcagcttgggaattctttgctccagatgatcaagcaacttctgcaattcctcccgtccgagcagttcggaggcatgcatacggattagatgattcaggtgtgttgtaacgactgtgctggcatcgaccacggtatagccgctggtttgcgccagttcacgctgttctgtttcgatccagacggcgggcaacccgaatgccggatcttcggtacgattacccggcaacgccatggtgacctggccgggattaatcgccagatgcatgccgttgtaggattctccctggccgattaccgaacctttcatggtgatgcggtagccattggggcgcaattccaggttatcccgaatatgtaccactggcgggagaaagccgatttcctgggcaaatttcttgcggatgctgttgatgcgttttagcagatccccctgacggtgcttatccaccagcgggatgagacgatagccgacttccagtccgagcgtatcgacttggactacatcttcccaactggcatcctgagtttcagtggtagcgacttccggcgcttccagtgtggcatccggcgaagtggcacggttggatacataataggcaagcgtaccgatcattccggccagtagcaggaaaacgaagtgcggcatacctggcaccagacccaatgcgccgaggatacccgctgtcagccatagtgcctgtggcttgttaagtagctggctcacaaattgttgaccgaggtcttcatcggtgctgacccggctgaccaccagaccagcggcagtggaaatgatgagtgcgggaatctgtgctaccagtccgtcgccgatagttagcagtgtgtagtttttggcggcatcacccatgttcatatcatgttgcagcacgcccacgatcaagccaccaataatggtgattagcatgattagaatgccggcaatcgcatcgccccgcacgaatttgctggcgccatccattgagccgtagaaattggcttcctgtgcaacccgttcgcgccgtttgcgcgcttcatcttcccggatcagcccggcattaagatcggcatcaattgccatttgttttccggggatggcatccagagtgaagcgggcgctgacttctgcaatacgcccggcacccttggtaataacaacaaaattgatcacaatcaaaataatgaacaccaccaaaccaactgcatagtttccgcccaccagaaaatggccgaatgcctcgataaccttgccggcggcatccgggccgttatggccgtgcatcagcactactctggttgaggcgacattgagtgaaagtcgtaacagtgtcgtgatcagcaaaacagtggggaaaactgcaaattcgagtgcatcacgcgaataaaggctcaccagcagcacaatcactgccagtgcgatgttgaacgtaaacagcatatccaggatgaatggcggcagtggcagcaccatcatcgacaggatcatgatgatcagcaccggcccagctaggctgcgcatttggccgtctcgtaccaaagctgctaaagatagaatattattcattcagcatccattccaataataggtatttattcacctgtaaatctgtttcaggcatgatccagttccactggcaccgctatttccggtgatagttgtggcgcggtaccacccgccgtctgatatcttctcagctggaaaacgtaggccaacacatgcgctaccgcggtatagagtgtctcgggaatctcggtatccagttccacgtggtgatacagtgcccgtgccagcggcggcacttccagcaccggaatatggtgttcatctgccaattcacgaatgcgggcggcgatcagttgcgacccttttgccactactttcggtgcacgcattgagtgatcctgatacttcaatgcgacggcgtagtgcgtcgggttggtcaccacgacatctgccttgggtacttctgccatcatgcgtcggcgtgccatttcacgctgcatactgcggatgcgcgccttgacctggggatcaccttcatcctccttggcttccttgcgcagatcttctttggacatccgtaactggcgtgcgtgattccagagctggaaaggtacatcgattacaacgagcagcagcatggcaccaacaatcagcataaaggtcaggccgatcagtctgcccatgctggttagtcctgtgtccagcggcataccaatcaaatcaagcacgtcttgtttgtgactccagataatcccggccgcaacgccaccaatgactgcagccttggcgattgccttgaccagttcaatcaggccgtgtgacgaaaatatccttttaaatccattaaccggattgagacgtttgaagtcaggaaacaacgccttggagctgaacagccatccactcaacagcatgggcgataccagcgccacaatcactagccatcccagtaagggtgcgatggccaatagcccatcaagcgccagttgaaataacctgggcaacaacagcgccggattgaatgcaacttcccgctctatttgcaggccgctttccagcagggcagacagtttctgaataatgagcgaaccgatcacccacaagctgccggaagctgccatcagcatagtgaacgtggttaattcctgcgagcgcgctacctgcccctcctcccgggatttttccaggcgcctgggggaagcgggttcggtacgttcaagatcgttatcgtctgccatagcggattcctctcgatgaaccaggattatccgtgttcacgctgaaatcgatgtcgtaaacaagcaacgatttaggcggttaatcagacaattccggagagaaatccgggtgagagaacgttgagagcctgcttaccgttgaagctgttcgggtaacaggaaaaacaaaccggggaaaggcagcgagtgaattaaatcatctgctgcctaaatggttttttagtggggattgggttgattctgctgggaaatcagcttgctgtctgaaacagcaggccagcatgttcccgcattttgtggaagcggatgccgggccagttttcttcagccacgctgatttcggcagagaaagaagccagaaaagtgggggcatccactgcatcgtaggcgatacgatgcgtattggcatcaataaaacgctgcaattcccggggcgtttcagcagttacccaccttgccagttggtatttggcaggagcgacacgtgcctcaacaccgtattcatgcttgagacggtgggtgacgacttcaaactgtagctggcccaccgcacccagcagcaggatactgccgagatgcggacggaacacctggatggcgccttcttcacccagctgggtcaatcccaacttgagttgcttgctgcgtaatggatcagcaatttcgactgtctggaaaatttccggcgcaaaaaatggcaaaccggtaaattgcaggttgtctccctcggtcagggtatcggccagttgtagcgtcccatgattgggaatgccgataatgtcacctgcataagctgtttccagcaattcacgccgttgtgaaagaaaggaaactaccgtgctggtgcgcacatctttgccgctgcggactaccttgagactcattccacgcctgaattcacccgagcagatgcgcacaaaggcaatgcgatcccgatgagcagggttcatgtttgcctgaatcttgaaaaccaccccggaaaatttcttttcagtcggcaggatttctcgctgaatggccttgcgtgtaccgggtggtggcgccagatcaaccagtgtatccagcacttcctgtacgccaaaattgttgattgccgagccaaaaaatacgggtgtttgctgcccggcaagaaacgctgcctgatcaaattctggtgcagcaccattgatcagatcaatttcctgccgagcctgttccaggtttgttccgaagcgttttgtaactgccggatcgctcagatcggtaatgatggttgtatctttctgctcggcatgatccataccaggccgaaagacgcgcatcagttcgtgccgcaaatcgtacacgccatgaaagcgcttgcccgagccgaccggccaggtgaatggaaccacgtccattcccagcgtgcgctcgatttcatcaatcagatcgagtggttcgcgcacttcccgatccagtttattgacaaaggtaatgatcggggtattgcgggcgcgacagacttgcagcaggcgcaaggtttgtgattccacgccgttggcggcatcgatgaccatgagtgctgcatcgacagcggtcagcacgcggtaggtatcttcggaaaaatcctggtgaccgggagtgtccagcaagttgatgacacagccccgatactccatctgcatgacagagctggcaacagagataccgcgctgtttttcgatttccatccaatcggaagtggcgtggcgactggctttacgcgccttgacactaccggcgatgtgaatggcgccagcaaacagcagtaatttttccgtcaacgtggttttaccggcgtccggatgggaaataatggcaaacgtccgacgacgtttaacctcatgatcgatcgtcattaaaaatcctgtggttcttgagaaactgaatgataaagatggcaataagtggtgtgggtagcgctgaaccggctggtcgccggataaatttcccggcagatcggcatgacatgggggcagcgcggatgaaaataacaaccttgcggtacatcggccggtgaaggcggctcaccttgcaagcgtatgacttcacgttgggtgccaggttcatatattggtaccgcagacaacagcgcctgggtgtagggatgtttcggggcatccagcacttcttcagtgcgcccgttttccacaattctgcccagatacataacagctacttcatccgcaagatagtccacgacagctatattatgggtgatcagcagataagcaagttttcgctcctgttgtagcgttttcaacagattaaggatttgtgcctgtaccgaaacatccagtgcactggttggttcatcacagatcagcagctgtggattaactgccagcgcacgtgcaatggcaatccgctgacgttggccaccggaaaattcgtgtggataacgccatttggcttctacaggcaaacccacctgcatcagcagagtatcaatgttgtgttcattctttttctgcgtggataatttatccgagtaccggccaagtgcctgcatgccttcttcgataatctcaataatgcgcatgcgcggattaagtgatgaataaggatcctggaagatgatctggaattcggtgcgttttttcagtaattgcttccgattcagtttagataactcttcatcctgcacacggatactgcctgatgtaaccgtgatgagttgcatgatacccttgccaacggtggttttaccgcaaccggattctcccaccagcgccagtgttctgccgtggttaatttgcagcgacacaccatcaaccgctttgacatagcctgctgctcgcttgaataaccctttatgcaccgggaaatgcactttcagatcattcacgtttaacagaagattatctgaatccaaaccaggggcgtcaacactggctggaagattatcggttgttgcatgagcaatgtcggacaatgcttccacggaatgctccggataaaggtgacatcggacacggtgttgaggtgaaatttccacccagggtggaataatcttgtgacatttttcccaggcatgatcgcaacgatcagcaaaacggcagccggtaaaaacatgtgaaagggctggcacatttccctgaatgacgatcagtttctgattgcgtttttttctcgttggcaaagcagcgaacaatttatgggaataaggatgggccggcgattgaaaaaaactttcctggtctgcggtttcaatgatttctccggcatacatcacggcaatgcgctgcgctatttctgaaaccactcccagatcatgggtgatcagaagaatggccatgttttcctgtcgctgtaaattgcgcatgagatccagcacctgcgcctgaatcgtgacatccaatgcagttgtgggttcatccgcaatcagcagctctggtttgcttgccagtgccatggcaatcatgacgcgctgcttcatgccacccgaaaactggaacggatattccttgatacgacgcgccggatcaggaataccaacctgacgcaggagctccagaatgcgtgtttgtgccgctgcaccacgcagattagaatgttgcagcaatacttcttcaatttgtgcaccggtggtcatgaccgggttcagactcaacatcggttcctggaaaatcatgccgatacgattgccgcgcacctcacgcatggcggattccggcaaggccagtagttcatcaccattcaggcagatgctgccatgcgtgatttctccagcttccggcaacaggcgcatgatagataaagcagtcatggatttcccacaaccggattctcccagtaatgcaaatgtttcgcctggccgaatggcaagtgataatccatccacggcatgtaccggctgccggccggtatgcagctgcactttgagctcatttatttcaagtaatgcggtcatgtgcggggtatgtttttgtctggggaggccgttttttctgtttcactctgattcttgagatatctggctgaatcattgctgagggttcggctgtgcggattgaatgcattttgtaccgcatctgaaaaaagattggcgcttaataccagcgcgaacatgaaggtgaatgctgcaaataatgtccaccagaccatcggttcacgcgccatttccagcctggaggcattgatcatcgttccaaagctgatggtagagggatccacacccactccgacataggaaagaacagcttcggccagtaccaggctgctgaaatccattacggtggtaatcagtacgatatggatgacattcggcaaaatatggcgagtgatgatgcgccaatgagaaacgccaaacgcatgtgctgcctggatgtattccatttcacgcagtttcagtgtctctccgcgcaatactctgcacagccccgtccagctggtgatgcccagaataatacaaagaaacagcaaacgcagatcagcacgtgcggcggttgtatcaagcagatcggcatgcgtttcaatataaacctgcatcatcagcacggctgctgcaatcagcaatacgctggggatagagctgagcgtggtgtacacgtactggataacatcatcgacccagccgcgaaagtaacctgctgcaatccccagcagcagggcgaatggcagcatgatcaaggttgtcaatgttccgataacaagcccggtgcgaatacttttgagtgacaagtacaaaacatcctggcctaccttgtctgttcccaggacatggtagtgtgtggtcagtgctgcgacggcgccccccatggccagaataacagccagcgtgatcaatatggcgcgccagggaacttcagttgtaccgtgccatatagctgtttgtatacgaaaaaatgaagtgcgataccgcttggcctgcatactgcccaggccgagaaccaatccggcccagattagcaatcctgctcccgctcccgaaacggatcgccaccaaacatcactggtcagctccgttcttggatcatccaaatgcgcgccgccgaaggttaatcgggcaaaatcccatacctgctctccttcagtggtgatgatcatctgctttgcatatagataggcagataggggggcggagtaggttttttccatctgtgagcgtagtggagtggccaatagatcgaacacgctgagtacctcagcgctatagatattttccccggtggcacgagtttgttccagtgccgggcgaaagtgaatcgtgtcgagcaaaccgatcaggatgaagcataacaggatggtcagtgcagacattccgctggcgctgtgtataaccttgcgccaggaagctagcatgtgttcatgctgcctggcataaataccaagaataatacctgttgccagcagcagataaatcagagcgtctgtccagagtataacgggatggaaaggcattatgacgaagatcaaagttcaagttgtaataatgcggtattgtagcgtagtgacaacaggcaattgcatcgaagaaaaaagtggataccgtaatgataaatatagcctggttgaccagaatgtttattctgcgggttgtttttatttgtaatgacacaacgcaaccatgccatcatcgaaaatgacaaaaaaatattccggttttgctaaagttccggaatggatggtcgttagacgagcgtaacatatgcaaatatttattttagaaggaattccgtcgtgaaaataaaccagatatctccggggcgtacagagcttgctgccggggtagctcaaaaaaaagtggacagaacggataatgccaaagtgaatactgcaggtaaaaataacagtatacatatcagcacactttcatcgggagctcagacatcgaatgctggcagcgaaactgttaatgctgcgaaagttgctgaaatcaaacaagccattagcgaaggtcgtttcaaggtgaatcctgatgtggttgcggatcgtctactggaaaccgtgaaagaactaattcaaagcaaacgttcaacctaaaatggacggcaatcctcaggcaattctacagaaaggcgatacgctagcctcgactttgcgacttcagctggaaagcactcacttgtttcttgagcttcttgagcgcgaacgaaacctactggcttcaggaagtattgatgatttgcccccgctggttgcagacaaggatcgggtcgtgagtcaactttcacgattggatgcacaacttaaccagcttctcgctgcagctggcttgcctggtgatgcgcaaggaataagcgcctggctggctgccaatcattcaaaatcagctgttgcccgcgactgggaggagctacttaaccttacccgtcttgctcggcagcgcaatcaaacgaatgcaaatattgtttccacctggttgcaatatacacgacagacgctctatgcactgcatggtgcggcagggcgcatcatactttatgatcccaaaggccagatggcttgacatctcctgaaggcaccaccaaaattggcttttagacgaaccatggccgcatgatattcgctgtcgcgactatccatttgacatgtcgggctgttgcatcccgtgcacaagatttttagaggcgttcatggcacgcttgttacaaagatgtttcacgtgaaacatctttgcaattaccactttgtccttgttccgcgcccaccaaccagacactgtctcgcagtcgttgctgggcaagattcaggcacactaaaatcctaattggctgcgtatcggtgtcagcttgatcaatttcatataaaatacctccaactccttaagcaatcttcatcatatgactgtctaagtctgtttaggcgcactgcgaactggcatctgtatttatgcatttttcaagagattttgacattatcgttgtcggtggcggacatgccggaacggaagcggctctggcagctgcacgcatgggtcaaaaaacattacttctgacgcaaaatctggacacattggggcagatgtcatgtaatccatccattggcggaatcggcaaaggccacctggttaaggaaattgatgcactgggtggggctatggctgcagcaattgatgaagcaggcattcaatttcgcacgctcaattcaagcaaaggcccggcggttcgagcaacacgcgcccaggccgatcgtgtactgtatcgtcaggccatacgtaagcggctggaagcacaacccaatctgctgatattacaatctactgttgatgatctgctgctgctggacgacaagattacaggcgttgtcacgcatcttggaattaccttctcggcgcgcgccgtggtgttgacggttggtacttttttgggggggctggcgcatgtcggtgaccggaattttcaggcgggtagagcgggtgatccggcatcaatcaggcttgcgcatcgcttgcgtgaaatgaatctatcggtgggaagacttaaaaccggcacgccgccccgtattgatgcacgcactattgattttcagtttttgcgcgggcagccaggagatgagccaataccaacattttcattcctgggaaatactgcacaacaccctcgacaggtgtcatgctggatgacacgcaccaatgagaaaacgcatgaaatcattcgcgccgggttggatcattctcccttgtataccgggaaaatagaaggtatcgggccacgctactgtccatcgatcgaagacaaggtggtgcgtttttctgacagagactcgcatactgtctttttggagccggagggtttggaaaccagcgaaatttatccgaatggaatttcaacgagcctttcttttgaagtacaggtcgaactggtgcgttcaattgccggcctggaaaatgcacacataacccggccgggttatgcaattgaatatgattatttcgatccacgggcactcaaaagatctttggagacaaaagcgatcgacggattgttttttgccgggcagatcaatggcactaccggctatgaagaagcagctgctcaaggtttgctcgccggtttaaacgccagtctcaagataaaggaaaaagaatcctggtgtccgagccgtgatgaggcttaccttggagtgctagtggatgatctggttacccgtggtgtaacagagccttaccgtatgtttaccagccgtgctgaattccgcttgcaattaagggaagacaatgctgacatgcgattgacggaagccggacatcaatttggtcttgttgatgagaagcgctggcagatttttgctgccaagcgggaagcaatcgaaaccgaaaaagcaagattacggcgtacctgggtgcccgctggtgtcttgcataaattacaaacactgcaaacatccgaccaatctgacgatcgctcctattcattatacgagctgttacgacgccccggaatcagttatacagagctggtgtcattgtctgaagttgaaccgtcgatgattgacggccggatcgcccagcagttggaaattgatgtcaaatatgaaggttatgtagaacgacaaagacaggaagttgttcgtcatacacagcatgaaactatggttttaccaaaaaacctggattacagtaccgtgcgaggcctttctaacgaagtcacgcagaaattgaatcagcatcaaccggaaacaattggccaggcagcacggatttctggtattacaccggcagccatatccttattactggtacatctaaagcgtggtatggcacgccaggcagccaaacaggaagaaacgcatgaatctggaaaaacagttgcatgaaggtctggaagcaatttcagggttgtccgctgatgtggcacatttaagcagtcggttattacgctacattgaactcatcaccaagtggaacagtactcataatctgacttcggtaagaaatcccgaatcgatgattactcgtcatatgctggacagcctggtcgtattaccacatatcagtgggccaaatattgttgatgtcggtagtggcgccggcttgccgggcattcccattgcgctggcgcgtcccgaatggcaggtggtcatggtagaaagtaaccagaagaaagctgtttttatgcaacaggttgtggttgaactgcgtttgcagaatgtttcaatcagacaagagcgtgtggaaaaaataaagccgggagacaaggtggatactgttatctcacgcgcgttttccagtctcgaacgtttcatgcgcttgtcgaaacatctgtgtgaaaacaacgttgatcattgtcgtttcattgccatgaaaggagcgttcccggatatggagttgatgcaactccctccggaattttccgttgagcagattattcccgttgcggttcctggcctgagagccaagcgtcatctggtcgtgatgcggtgtcactccgaatgagatttattgagtgggatataagcgtattccataatcttcttgccagaacagaaacgtaatttaatggtcaggatacttgccattgccaaccagaagggaggggtgggtaaaacaacgaccagcattaatctggctgccagtttggcaagtatcggcaaacgagtattgcttgttgatctggacccgcaaggtaataccacgatgggaagtggcgtagacaagcgcctgttggatcataccgtttaccaaatactgctgggcgaacagaccatcgccaaggttcgtttatcgacaaaaccagggaaatacgacctgctcccggccaatcaggaactggcaggcgcagaagtggaaatggtgtcgctggaacagcgtgaatcccgcctgaaggaggctttgcagacaatacaggcagattatgattttattctgatcgattgtcctccagcccttaacctgctgacattaaacggattatgtgcagcacacgctgttatcattcccatgcaatgtgagtattatgcgctggaaggcctgagtgatctggtcaacacgattaaaagggtacggatgggttttaatccatccatcaggatagaaggcctattgagaaccatgtttgatccgcgcaatctgctggcacagcaggtgtctgatcaattgaaacaacactttggcaacaaagtttatcagaccatcattcctcgtaatatccggttggcagaagcacctgggtttggattaccggtgctttatcacgatcgacaatcccggggtgcccgggcttatcttgaattggccaacgaaattctggcaacagctagctagctgacgatctggccagaaatccataatatttttgattgggtacagtaactatggcaaaacctaaaggattggggcgaggtttggacgcgctactggcagacaattcccaggaaacagattcgctacaaaatcttgctgtggatttattgcaggccgggaaataccagccccggacgaggatggatgaagcatccctgcatgatttggcagaatcggtcaaggcgcaaggggttatgcagccaatactggtacgaccgcttgtggcgggtggctatgaaattattgctggggaacgccgctggcgtgctgctcggattgctggactggagcagattccagccattgtgcgcgaagtgccggatgaatccgcacttgcgctttctctgattgaaaatattcagcgcgaagatcttaaccctctagaggcagcgacgggaattcagcgtctgatcgaagaatttggtatgacgcaccaaacagctggtcaggcattgggttattcgcgcagtgcgatctcaaatttgctgcgcctgcttaatctggctgccccagtgcaggatctgattatgcagggaaaaatcgatatgggacacgggcgcgccctgctcgcgttggaggccgggaaacaactggaaattgcgcatctgattatgcaaaggcagctatccgtgcgtgaaaccgaaaatctgctcaagcgaatgagtcaagcatcttcagtaaggaaaccgtcatttccggatcgagacctgctacgcctgcaggaagatatatctgcacggctgggcgccaatgttgtaatcaaacaagggaaaaaaggtgctggtaatgtcatcattcattacgccagtcttgagcaattggacggaattcttgcgaaattctgaagaaccttgcgacaatcgccctgctgggattgttttacattctgtaatcttatcgcgtaatttctctaacagagtagtgaggattatctaagttattagaatcacgttaaaaacaaactcaaagtactcatttgtcgcacacaaatcaccgcactttttcgcctgtttttgcctcgctctgatgggcctcttgcccatgttttcatcaccctgcttagtggcaacctagatgccagcttgcttgcctcctgattgatttgcgtcaaaaaatcaaaccattcttaacagaatgtatgttgtaatgagacaaaatcatcacttcatggagtaaaccatgtgagtacattacgtgaaactggagtatggaaggcgctgcattcacactatctatctttccaaaagatacatttgcgcgggctgtttgcacgagataagaaacgtgctgagcgttacaccatagaagcagcaggctggcgcctggattactccaagcatcgtatcaatgacaaaaccctgaaattgttatttgagctggcacgtgaatgtggcctggaatcgcggcgtgataccatgttctcgggcaaggaagtcaacaccactgagcagcgcgccgccctgcacatcgcgctacgtgcccctgctgattcagtaataaatgtggcaggcgtgaatgtagtacctgaagtacaggcaatactcaaacgtatggctgaatgcgccgagttgatccgcgcgggagaatggaaaggctacagtggccgaccgatccgtaacatcgttaatattggtattggcgggtcggatctgggcccggtaatggcctgcggggcgctgtgccattatggcgaacgcaagttgagattacgcttcgtttccaatgtggatggaacgaattttgtagaggcagtacacggattgaggccggatgaaaccttattcattatagcttccaaaacgtttaccacactcgaaactatgactaatgcgcacactgcgcgtcattggctgcaaactgctgcagaaggtgacaggaaagccatcacaccccactttgtagcgctctcgaccaatgagaaagctgtcaatgattttggtatcccctccaaacagatgtttggtttccaggaatgggtaggcgggcgttattccatggattctgctattggcttatccattatgattgccatcgggccggaagctttctgcgaaatgcttgctggttttcacgccatggacgaacattttcgcagtgcaccacttgaacagaatctgcctgtcatcatggggcttctgaacgtatggtacgcagacttctttgatgcgggtaccgtcgcagtattaccttatgcacattctctcaagcggtttcctgcctatctacagcagctcaccatggaatccaacggcaagcatgtgacacttgacggaaaaagtgtggattaccataccggctccgtgttctggggcgaaccaggtaccaatggacagcattcgttttatcagttgattcatcagggcacacatttgattccttgtgacttcattgcctttgctgaatcgctcaatccggttggacgacatcaggatctgttgttcgccaacgtaatcgcgcagaccgaggcgcttgccatgggcaaaacacttacagaagtgcaaaaggaagggatatcggccgaattggcacctcataaggttatgaaaggcaaccaaccgtcgagtctattgtttgccaaacgacttacaccaacatcattgggagcactagtagcactgtatgagcacagtgtatttacacaagccacaatatgggatatcaacccctttgatcaatggggggtggaattgggcaaacagcttgcatcgcgcatagcagaggaaatagaaacaccggatgtgacgctggcacacgatgcttcaactaatgcctcaattcgctggtactgttacatgcgcggacagaataacagccaagaaaaacaagaaaaacgctgtgtactggcgctggatgtaggcggcagtaacgtcaaggcaagaataagcggcgagaaattaaaaattaaaatcccatctggttcagacatgacaccagaacttatgctcacgcaactggataaatgtttacacggatggcattacgatgcagtaagcgttggttttccagcattggttgtacatgggcgtattgcgaacgaaccagctaatcttggcactggttgggtagggttcgactttgccaaggcatttagctgcccggtcaggattatgaatgacgctgccatgcaggcacttggcagttacgaaggcgggtacatgctattccttggccttggcaccggtcttggttccgctgtcattgtgaatggacggattgagccaatggaactggcgcaccttccatacaaacagcatacctatgaatattacgtcggtaaacatgcgctccaacgcttgggaaagcgtaaatggcgaactgaagtgttcgcagaaattgaaatgctgcgcattgcacttgaacctgattacatcgtactgggtggtggtaacgcacgacttttgaaaaaactaccgaccggtgttcgccgtggaaaaaacgccaatgcattcactggtggttttcgcctgtgggaggatgagtatgaatgattcaacaaatgctgatcatacgatacaactcggttttatcggcttggggcgtatgggcctcaatatggtggagcgattgcagaaagccggtataggttgcgtggtatttgataccaattctgaagcatgtatcgccgctacaaaatcgggagcagaggcagcgatctcgcttgatgatctggttaataagcttgccttacctcgtgcagtatggctcatgctgcccaccgcagtagtggataaagtgctcacagtgttgacaccccttctcagtgccggtgatgtcgtgattgatgggggaaattcgcactatgtggcagatctacgccgtgctgcatcactcgcaaccagacaaattcattacctggatgtgggtgtcagcggcggtgtgtgggggcgggaacgcggttattgccagatgatcggcggtcctgatgcggcctatcagcggcttgagcctgtatttcgcacattggcgcctggtgtggaagccgcgacacgctcgccgggccgcagcggcgagccgacacctgccgaacatggctatttgcattgtgggccgaatggcgccggacatttcgtcaagatggtgcacaacggcatagagtatggattaatggcagcctatgctgaggggttgaatatactgcatcaggcgaacgctggaaatgtccggcaggaaataaatgccgaaactgcgccactcgaacatcccgcacgctatcagtacgattttccgctcaatgacgtggtggagttgtggcgccgtggcagcgtaattggttcctggttgctggatttgacagccattgagatgaatgaggatatgacgctttcacgttataccggacgtgtatctgattctggtgaaggccgctggacggcactcgcggcaattgaagaaggcgtcccggttccggtgcttgccgcagcactttttggccgcttcacatcacgcgggcatgatgagtttgccgataaggtaatgtctgcgatgcgccacggatttggggggcatgatgaaaaaaccgctccggatgacaaataaaagaaaaaggaggaggtgtgtctgatacaaaccttgtgattcttggtgcaaccggagacttgacgcaacgtttgctcatgccggcattgtatcgcctgcaccagtcgggatatacgcgggatcttaagattacggggtatgccattgaggactggagcaaggagcattttcgcgatcatattcaagaggcattacgtacatttgtatcggatgacaagattgaggataagcgtcagacagaattttgtgcgggcctggattacattaccggtagtcttgaagccgggcagatgaaagaaatcggacgtcgcgtgaaagggtcgatacttttttacctggcgttacctccacccttgttcggtgctgcagctgtagcgctaggtgaagcagggcttgcgcaaactactgaaggctggcgacgtctggtaatcgaaaaaccttttggtactgatctcgccagtgctgaaatgttgcgtaaacagattcacagtcaatggaccgaggaaaatgtgttgcgtattgaccatttcctgggcaaggaaactacgcagaatctgatggtgttccgctttgccaaccgtttcctcgaaccactctggaacagcgcgcatattgcgcaagtgcagatcagctgcccggaaacgttgggagtagagcatcgtgccgcctattacgatcacgcaggggcattacgcgacatgctgcaaaatcacctgatgcaattattttgtctcaccgctatggagccgccgtcaagctgggatgctgaagtgttgcgtgatcacaaagtcgaagtattgcgcgcggtagtgccattcaatgaacacacagtgtgtaaccgagttgcgcgcggtcaatatactgctggcagcattgacagtaaaaatgtacctgcttatcgtcaggaatctggtatccctgttaactcaaatactgaaactttcgcggcactgcgtttcgaaatcaacaactggcgctggcaaggtgttcccttctacctgcgcagcggcaagcgcatggctagtgattactcagagatcgcgatacagttcaggcaagtgccagacgcgctgcctgatggcagcgctgcgccgaataactggatgatattccgcctgcaaccacaggaaagtctcaatctggtagcgacagccaaaaagcccggtatggaatttgccacgcacaccgtggtacttactgcaccttatgcacaagaaggcgtcagagaattttcagcgtacgaacagttgctgatggacgcaatcaatggtaattgttcgcacttcctgcgttttgatgaggttgaatggtcatggcgcttgcttgatccggtgttgcatgcgtggcgcacaggcagtcctgaagaatatgcttccggctcggaaggaccgccatcacagaaccagttgcttacagctggccacagctggcggccagtacagatgcattcggaaaattgattataaatgtacttgactgatcagaattctggtcagtcaagtacgaatgctattattgatttattgcatgatgaatgggtaaatcgggttgaattttgtaaatatcatcctgagcacccctattcctggttgcgcacattttcggcataagccactgttgccgcgtcgcagatattgtttatgtattgtgcgtgggctgtttactaaaggtgcgtgtcttgaacgccagactcacaagcaggataccaaagatgatggcataagcaccaatcagccaaagcaaggcaagagcaccggccgctggctgcgccatgaggagaatgccaaagacaagtgatgcaaggccacccaaaatgagcaaccattcgcccgtcatttctttgcgcaggcgaatcgcagctacaatctgaagagtaccagtggcgactgcccagattgcaatataaaacagtagcgctaatgcggtgacaccaggaaccacaaatgtcaggacccccacaccaacgccaataaatccccaaaggagcaatacccaccaatgctcgtgtatcttacgccctatgactgcggtccagataccaaggataccgtccatcagagcaaaggttccgaaaagcaacaacatcgctaccagtgaaatctcgggttgaaaccaaagcaagatgccaaacaagatagcgatgatgccgcgcagtaataatatccaccaactccgggaaaaaatagtggttagttgattttctacaatgttcattgtcggctctcctctcagatgaagatcaaagttgattgactggattcgattgataaagttattttgtcaaatgattttacgttaagaacgaaactgtatcggactatccgtatttcacaggaatccggatactggtttatagtttttcatcgattttttatgatgactatacgtgaagagtaaggtacacagaacgtggcaacaagatatatcaaccggacaagcaaggtagtgagcatcgcgattcacctggaaaacctgcccgttacaaccttgtacgttaaccactttgatacagagtctattcaaataattcagaaaatagattattccctgcataaggaaacgtttgagcatggatgttcctggcttgattcaatcgtatggttacctggctgttgccgtgggaacttttcttgaaggtgaaagtgtgttgttaaccgccggtgcggcagcctttcatggctatctctggatgcctgcagtcattttgatagcagccgtatcgggttttctgggtgatcaaatctctttttgtgtaggacgcagatacggcaacagattactggcaaaattcccttccttgcggcgacgagctgcacgtgtaagcgcactactggagcgtcataacgtgttgtttatcctcgctgttcgttttatgtacgggctgcgtgttgccgggcctatggcgatgggtatgagtggtatttactggtctcggtttctggttctgaacctggcgggagcaattatctgggcgattacgattgccagtattggctatggactcggccaaggttttgtctatctgctcgctcattttgatgctgaagaaatctggttactggtcgctctcctgcttccagcgaccatctggagattgattgtgcgcaggaaacactcggtacgttcaaaacattcttaaatttgagcgatatccagttgtcgtatctggataaacatttgttataaagaggtacgaaaattcgaggtataagacccttagcgcatatgttctgatagcaaatctttggtatttcttgatattttcgtcaccacatctttctgtgcaggacgactgccagaattcgctgatagcatgacaacttaaatagttgtagtcatgaggctaaagatatgaaatccttttatcttttaaaaggatttcatatgacgccatcccattgcaggcatgatatttcagataaggtatggtcactacttgaggagcatttaccaggtagagaaggggcatggggagataatcaggagatgaatcgggcgagaaagggagctcaacaccaagatacatctggccgtggatgcgcatggtatgccgctcagaatccttgttacacaaggtaccactgctgattgcccgcaagttggccgcttgatcgaagggatggatgcagatcatctgctggcagatcgtggcatgacagtaatgccattattgaacaggcggaaaaacggggagtggaggttgttattcctccaaagaagaaccggaggacgcaaaggcattatgatcaagtgctgtataagctgaggtatttcgccgaaaatactttccttcatctcaaaaagtagcgttgctacagacacacccaaaatacctcttctttccttgccgccgtacaaattagatgtccgccctccggacaggtatcttgtgactatactatctaggatcaatcagaaatgatgcaacgtttatctgtcagcaaatggtcacgtcgtttctccgcactattctgggatggtgttgctgcactgctggtgctcggtctggtggtttttcttgcccaggccagccgcgactttatgcagcctctggtggaatcagggcacgatgtcatcagtcttgatccatccgccttaccggagtacgcactgcgaacatcactcaggatgttgctggcaatggtgctatcgctgatttttacctttacgtatgcaacctgggcggccaagagttggcgcgctgaacagattctcatcccgctgctcgatatccttcagtcggtaccggtattgggttttatctcgattacggtggtgttcttcctgtcctttgcacctggaaaaatgctgggtgccgaactggcttcagtttttgctatctttaccagccaagcctggaacatggcgttcagtttttatcaatcactgcacacggttccgagagagctggatgaagtatcgcgctcgtttcggctcagtccttggatgcgtttctggaagctggaagtgccttttgcaatgccggcactcatctggaacatgatgatgtccatgtcgggcagctggttttttgtcgtggcatccgaagcaatcagtgtgggtgatacgatcgtcaccctcccggggatcggctcttatattgcgttggcgattgatcagcgcgatcttggcgcgatcggctgggcaattgcagtcatgttgatagtgatcctgatttacgatcagctcctgttccggccattggtggcctgggcagatcgttttcgctttgagcaggaaaccggaggaatgccaccgccgcactcctgggtgctgactgtgctacatcgttcacaatggataacgtttaccacagctttgtttgccagaatctggcgatggacttaccggaaatcgcaacaacctgctcgaaaaaaagcatttacctggaaaggaacaggaacaaacctgaagccgtgggtagattggctgtggtatggaacaattaccgtagtttgtgccatcatttcatggaaaattacgttctttattttgcaggaagtggcgctggcagaagtgggaacggccatgttcctgggttttataaccatggtgcgtgtttttgtgctgatcgcggttgccagtgttatttgggtaccggtgggtgtctggcttggactgaggccaggcgcagcgcgtattgcccagccaattgcccaattcatggcggcattcccagctaatctactgtttccacctgcggtgtatgggatcgtagtactgcagcttgatccagatatctggttgagtccattgatgatcctggggacgcagtggtatatcctgttcaacgttattgcaggcgcatcgactattccaggtgagttgcacgatatcagcgctaatcttggtgtccgaggatggttgtggtggcgacgcattgcgctgccagcagtgtttcctttttatgtgacaggcgccattactgcctcgggtggatcatggaacgccagcattgttgccgaaatagtcagttggggaagtactacattgcaagcacatggcctgggcgcctatattacggaagcgactgttgctggggattttcatcgtgtcgcactcgggatcgcagtcatgagcgcgttcgtcgtcgtgattaatcgcctgttctggcgcccgctgtatgcattggctgagcgcaaattccgtttagggtgaaaggagaatcacatcgataccgtgttgcttgatattcacgagattcacaaatcatttcgcaaaccggatggcagtgaattgctcgtgcttgatggcatcaaccttgctgttaacaaaggtgaaatcatcggcttgctgggtcgttcaggttccggtaaatccacgttgttacgcttaatcgctggacttgcgccgccgtcggcaggctcgattatctatcttggcaacgaagtgaccgcccctccacctggcgtcgcaatggtttttcaaaatccggctttgtttccctggcttaccgtgctggaaaacgtgcaactcggtctggaggcactagggttgccgatcaatgaagtgcgccagcgcgctattaaagcgattgatctgatcgggcttgacgggtttgaatcagcctatccgcgtgaattgtcgggtggtatgcggcaacgtgtcggctttgcacgcgcattggtcgttcaccctaatatcctgctcatggatgaacccttctcagcactcgatgtgctgacagcggaaacactgcgtaccgattttcttgatctctggtcggaaggccagcttcccatcaagagcatgatcctcgttacccacaatattgaggaagctgtgctgatgtgtgaccgtatcttcatttttggcagcaatcctggtcggattattaatgagatcaaagttgaactgccgcacccgcgcgcccgtcttgatcccacctttcgcgatctggtcgagcgcatttatgtggaaatgacaacccgcgtggtttcaacatctgccggcaaacgcacagaatatttccctggtacgggaatcgggacgattctgccatctgtaacctcgaactcgctttccggcttgattgaagccgtagcagctccgccctataacggtgaagtggatcttcctgtcattgcatcctccttgcttatggaaattgatgatttatttccagtggctgaaacactgcagatgctgcgttttgccgaagtagccgggggcgatattaaactgaccacagaaggtctgcagttcgcggaatttaataccgatcagcgcaaacgcttgtttgcctggcatttactgacctatgttgcgctggcagcgcatatccggcgcgtactggatgaacgaccaacacaccgcgcgccctggagccggttttcaagtgagctggaagattacatgccacaaacagccgctgagcgaactctgcgaaccatcatcaccttggggcgttatgcggaaattttctcatatgacgacaaaaagcatatcttcagtctggataatccttaaagagttgctgactgatttctgctgtaatcatggactccatttttgacaacacacctcacccggtggcggaggctgaagaacgataccatcgtacacttgcagagcagacttcagagcctgttttgctttaaccaaacagcctccgcgatttctcccagaaattcaaaacccgacgccaccgcatccaggcccggatatctggcttctgccaccggtttgcggggttacctggatctgcgtgctgatccgctccttcaaggcaggcacgtgcgaaatgacgccgatcagcttgccgtcctgctgcaggcccgcgagggtttccagggcggtgtcgagggcttcctcgtccagggtgccgaagccttcatccagaaacagcgaatccacccggacattcttgctggccatatgggacaaccctaatgccagggacaggctgacgataaagctctccccgccggaaagattcttcgtggaccgaatctccccagcctggtagttatcaactacgttgagctccagaggctgagcgtcgtctcgaaccagcaagtagcggtcggtcattttttgcagttgccgattggcgtgaccaatcatcatttcgaaggtcagcccttgggcgaaattgcggtacttcttgccgtctgcggagccaatcaattcgtgcagattttcccatctgcggcactcttttttctgggcctcggtagccgcttgcttctcctttatccgctctttggcggcggcattttcactcaacttgtgcttgaggccggcaaggatatctcgcaactctttcagggcatcctcttgctctttgaattggggctcgagctcctccaacgatttgtcggtgacttgccgggccatttccgtggtcaagcgcatttcccgatccttccggcgggcatggagatcggtttgacgttcatccagattcctggccgtcgccgtcaactcagcctttcgttcagagggaagcctggctgccagaaactgttcttcagttgaaaagcccacgggcgcaagttctgcggagaattcagtttccaattttttcagttccggcgctcgttggtcgatgcgttttttcagagattcgacatgggcctgcgcggtattccatttttgctgacgctcattgtgccgttctctggcttgtttttcggcaccttcggcatccaaaatcgctttgctcaaacggcgctcctcatcgtcgggatgcttgtcgccgtacagtgcattacgctcatcacttccagcggcgaattcctttttcaaggtacccaggcgctcccgcttttcggccagagcagcgctttgcgtttcgatcaccgcattcagccgcttcatctcgctgtcgatggcggcaatttgtttctcgatgtccgcctttttcttgacctgagcttgccatgcctccagccgcttcttaagggtttcgatcagtgatgaaatgtccgtttcagggatgcccacaataccaagcggctggagtttggtagagacagtctgcctgcgctcggcaaaatcggcccggagctttaccaggccgtccttcatctcggccagggctttctcggcagccttcttgtcattggccgctgctgactccagcttttcagcctccgtcaaatttttgcgggccagattttctgcatcgaagagtttcttgatggcggcttcctgatcctcggctttgctgatcagactggtcagggaatcaatcttcttttcggcttcatcagggacaggaacattcccttccgcgaaggggtgttcggttgcgccgcaaagaggacagggcttgccgtcttccagttttgcccggtgaccttcaagctccactattttcgcaagatacgccatctcacgcagcagcgtttccttctcggcgcggtattcccgcaacaagcagtctcccagcaactggctcaatgcgtctttgccccgctgaagctgttttgaggtgtcctccagttcctgcttccgaatgccggattgtttctgacggtcgccaagtgactttgtcgccagttccagagctgtcgtggccgcttcttgagccgcctctttttgaacgatttctttttgcttggaaagtagggtgttcaactgttcttcaactccggccaaaccgctgatcagccattcatcccgtgcatgctccttgaggtagccgtccacaaactccagcgtctcctgagctctggatcgttttttctgctcttcgagccgggctttttgatccgcatcaatctttgctgcatccttcttacaaccctcatcgccttccgaaaccacctttttttgatcggcaagtttttgatccagggaacgcaccttctgcaatgtcggcgcggccgctttcagcgcttctttggctcgaacggtttgttgctccgccgatttcagtgcttcggcctgttccttggcggaggatgtcagttccggaagcgcctcttcctcagctttcaagcctgctctatcatccgcctgctgtttgcgggtggcggtgagcgttgcgaatacaccgtccagtgaggcggcactcaaagcccggcccagcttttcacgatccggcttgaacgcctcgatatcgttttgcagcttgctcgcctcgtcagtcaggttgccaatttccttcttcaggccatcgatggtgataagccagacaatgcccttcccggtatcagcggatttagcagcaagatctatctcttccttctgctttgtcgcgagtgcctgcccaatcgcttgttcctgctccggatcaagcatcacgatacccgccgtttcagcctggagcaggttcagcttttcccgctcttcgcgctggcgctcatgaacacggatggatatctgactgtagatctctgtacccgttatctgctccaggattggagcccgatcatccggcgccgcctggaggaacgcggcaaagtcgccctgggccagcaacatggagcgagtgaaacggtcaaaatccatgccggtagccgactcgatctgctcggctacccctctgattttggattcaaaaatctcgccagaatcggcattggccatttcgtgtttcggggcctggagctcgccatccggcttcttgcgtgcccggtgttggctccagtgacagcgaaagcgcccagaccgcgtttcgaaggtcacctcggcgaagcattcgccggtctggcgggacataatttcgtttccgctcttggtaaccttgctcaggcgcggcgttcgcccgtaaagggcgaggcaaatagcatcgaggatggtggttttccccgcaccggtggggccagtgatggcaaagatgccatcagaggtaaaggccgggtgcgtcaggtcgatttgccattcgccgaccagcgagttcagatttttgaagcgtatctgcaatattctcatcgatagccgctctactccgcctgtacgttatcatcatagagagacaagagcgtctcctgataggctcggtgcaatttcggccgctgcgcttcaggcacgtcatgaacggcgagacatcgctcgaacacgtcgttcacgttcagatcgtcgagtgtttcctctgcatgcatttgtcccagcacgcggtcgatgatgcggttgttctttatccgcagaatttccatttgggtgccggcaatcgctatctccaggcgctcgcgcaggtcgccaatgacctcaatgccgtcgtaaatgatttcgagccaagctttgtccgttgccgacaattcgaggagacggcttgagatgccatcccagtctcccttgacacgctcgagtttctgaaacaccggcacgttgatcaattgtacggatgcagttgtgctgtggccatcgtgctgcccaaaggcaacatggcaaacgctcttctgctgtttggcttctccgaaccccatgggtaatggagaaccgctgtaccgtatggtctcaaggccgttcaccttttgcgggacgtggagatgcccaagcgccaggtaatcaaaactcgcagggaaaatccccgccgtcacatgcgccagggagccaacgtagagttcacgcacgccatcgccgtcaatagtttgtccaccagcggtaaacagatgtcccatgcccacaatgggtagatcaaccccaagttcctcgcgcttctgttcggccagggcagcaacagtggcgtaatgcgtgcggatgccgtcaatcaatttccgctccttgtcctcgacactttcacccgcttccgccacgcgtatatccctgtcgcgaagatagggcacggcacagacaatcagttccggcacaccctgctcattacgcaacaccagcacttcgtcttctgggtactcgatcgtcgcacttccaaccacgtggacatcaagggccttgagcagctccctgggggcattgagaaatgaaggagaatcgtgattgcctgcgatgacaacaacgtggcgacaagatgaggcagccacctggcacaggaaacgataataaagctcctgggcacgattgctcggagcgctggtgtcaaaaatatcacccgccaccagcagggcgtcaatttcattctgctggatcgtctccgccagccagatcagaaaagcctcgaactcttcatggcgtttcctaccgtagagcgtgcggccaaggtgccagtcagaggtgtggaggattctcattgagcttcttcaattgctacaactttttcttcgagagactcctcgttcactccaacacttttgagcaaagccgaatactgacccttatcttctttcagtcttccaataatttgccacgctgcagtcagcatctccggcacctccactggtgttgatccacgctcgaacactccgcataaatgcgaatattcgttattgattctgttcgttaatacagctggtattttttcgtcaccgaagaaaaggcgtagcgtatcctcggtcataccttgatctggatacttgtaatagaggtaaatctcaaagaatttcctggcgttgtttgcgaagttgtaaaaggttgtgtagttcgtgtcatcaacggcttcaattgctgcgcattggtgtatctgatggaataggtagttgaattctgttacgtattctttgaggtattttggcatcactctgacagtagatatcttgtcctggcgggcgacaacgaaatgatccttgtgatagtctttctgttttccatctatgtcaagatactttccattcaaccgcttcaaatatttcaggaaatcgagattatgcgttgaaacaaagagctgttcaaattttccgttagcaacaatctccgcgtttaacaagctatatacaaagaagatatgattaccattgagtggtgatatcggatcgtcaatccagattatcggcttagatgtttagatgtttagtcccacggtgtgctggtgtaacatataaccagctacggagggatgatttatgggacagatattacacggaagcgcccgcacgacagcggggtcgcgcgtcgcgcggccagcgctgtgtggcttcggtgccccacggccactggaagagcaccaccttcattgcaggactgcgtcacgatgcgatcaccgctccgttagtgctcgacggcccaatgaacggggccacgtttctcgcctatattcaaacctgcctgtgccccacgctgcagccaggtgacattgtggtggccgacaacctgtcttgtcacaaggttccaggcgtccgcgcagccattgaagcggcaggtgccacgctgctctacttaccaccgtattcacctgatctgaatccaatcgagaaaatgttctccaaactcaaagccctattacgcaaagccgccaaacgaaccatggatgccttatgggcgcagatcggcaaagtgttgcatctgttcactccggaggggtgtgccaactacttcgcttcatgtggatatgtaaacaaataaatcaaaaatactctagccgggcagcagccccggtgcatgagcttgttgtggtttcagcgcaatccgctgccgaccgactgggcggcgcagcgcgaggtggtaacggcgtttgatgcctgaccggtcgccgtggttgacgatgaaccgccgcgcgtaagttgttgattttgcgagagccaaaactgcgcctacccgcagaccaaatggagaatagagacaggcttggagccggaatcgctgaaaacaggctgtttcggcaggtggacacccacagcaccgatggctggaaccccgcgcggcgcggggatttcaggcaagaaaaagggcccggagattatccgagcccttcaatttggtggtgggatggtatccggcatcaaacgactattgaaagtacggaatcgaagcgctgcgggttgctgcgaaccggtgcgaactggatcgaaaagcctgccggtacgcccggcggcaccggacgatcaagcaggtttttcggactgattggtagccggaatacggcctcaacctcgtctgctttccgtggccagttcaattccgaaaagggaactgaacccgcgtcccgaagtccctcaacgcaggccgtaccaaactccacggccactgccatgctgatcaagtgtgccgcgttccaccagcgcccggaaatgctgcttgagcgtgttgcggctggcgccggtcagcttgatagcctcgccaatggtgacgcgcccatgctcgcgggcgaactcgacgatctgtagctgcaattccggcatggccgccagcacgatcttctcgcgctcgaccttcttctctaggcgccgaacctgctcggccagggatcgcagaaagaacaccagccacggctgccagttcggcgactctgtgcggatcgtgccctgggtctgacgcaaggccaagtagtaggcttccttgctttgctcgacgacgctttccagcgagctgtatggcacatatgcgtagccggcctgcagcagcaggagcgtggtcagcacccgggagagccgtccgttgccgtcctggaaggggtggatttccagaaatacgacgacgcacagggcgatgatcagcaaagggtgcaagagggccgtctcgcgctcctggttcacccaggcgaccagctccgtcatcaggcggggcgtgtcgaagggcgacgcggtctggaacacgatgccgatctgcgcgccggtttcatcgaaggcagcgacgctgttcgaattggtcttgtagctgccgcgatgccaggtgtccttttcgctgtagcgcagcagtatctgatgcagctgcttgatgtggttctcggcaaacgggatgtcctgccaggacgcgaacaccaggtccatcagctcggcatagccagccacctcctgctcatcgcgggtggcgaaggacttgatctccaggttcgacagcagctgctccacctcgcggtcggatagtttgctgccctcaatgcgggtcgaggaaccgatgctctcgatggtcgccacgcggcgcagcgccgacagacgatcgggcgcaagcgtgcccagggcgcgccaagcgcccttgaactcgtcgatcctggcgatgaggctcaggatctctggggtgatctggatggtgtcagttttcagcatgaaccaatattacacccatttacacccattttcgaggtgcacccattaagacgcccatttacacccaatttgcccagattggggtcatgcggggaataaccggcctaatctccgcaaacgatgcggcgaataggtctctgcaaggagaacgcttggctcgcggccggaacagcgccttcatggactcctgccaactcattcggaaggagaccaagatggaagtcgctcacctcaaccaaaaacaactcgctgcccgctggagtatcagcgaagccaccctggagcgctggcgcagcgcggggatcggccccaagttcctgaaactctgcggccgggtgctctatcggcaggtcgacatcgaggcttacgaggaatcgtgcctggcgacctcaaccaaggccgttgcggttccggccagcgccggctgagccatgttccgttttgccggcaaatgtttacaagtaccgacgcatcacaacatgcctgccctcgggatggctcgggcgaggcgaatttccatcgcaatgaaagtccgcagtccgcaagcgcggaccgatcgaccgtctcgttgaaaatcaatggtctggcatcaggccgtgcgggctggtgagggttcctgcgggttcgtgcggaaagattcgaactcctgcgggttttcggtgggatggtacccggcatcaaacgactattgaaagtacgcgataccggcgttctggcaagttgcgaagccctgcgtactggtgcgaaaagcgggggttgacaggcgaatctgcggacaatcaagcaggtttttcggcctgattggtcaccgaaaatggccctcaacctcgtctgcactccaggacctgttcagttcccggaacgggaatcgaacccgcgtctggcaccccgaccaaaagcacgcccatttacacccattacggggcaaggcagccctccatgcggcgaatggtgcccctattcaccgcaccgtatgcgtggaaagacttgcgtgtgcggagaatgcgcctcataatctccgcatgaatagcggcgattacaaatacatctggcagtccaaagactggccgaactggcacttcgacctggcagcattggctgggccaatggctgagatcagccgcgcccaggggctgttgatgggccgtctggccgacgtgggcatggcgctgcgcgatcaggcgagcttggcggcactgaccgaggacgtggtcaagaccagcgagattgagggtgagcagctcaacgtcgaatctgtgcgctcttccattgcccgcaggctgggcgtggacatcggcgcgcttgcgccggtcgatcggcacgtcgagggcgtggtcgagatggtgctggatgccacggccaactgccatgcaccggtaacgcgggagcgtctcttcggctggcatgccgcgctgttccccaccggctactccggtcttgccaagatcaaggtcggcggctggcgcgatgacgccagtggccccatgcaagtggtgtccggcctcatcggccgccagcgggtgatgtgtcaacacttttctggacacaaagttaagcagcattttgctgcaactcgaaatcaacaggcgatatatatccattagctgaatgcaatcgctctcggttgtaaaacacttcgatatattcaaacacagcctgtttagcttcttcccgagaatgaaacgtttgatgatggatcaattctatttttaaggtatggaagaagctttccgacacggcgttgtcccagcaattgcccttccggctcatgctttgttggatgccatgctgctttagtaattgccggtgactttctgaggcgtattggctaccccgatcggtatgccataacaggcctttgtcgggtttacgtttccaaatagccatctggagcgcatcgttgactaactgtgttttcatatgtgcggccattgaccagcctacgacctgccgggaaaataagtcgatcacgaccgccagatacaaccagccttccagggtatgaatataagtgagatcgcccacatatacctgatttatctgatctatggaaaactgacgatccaaataattaggcgcaataggcaattcatgctttgaatgagtggtagctttaaatcgacgtttggttttacaggccagtccggcttccttcattagccggcttattcgccgccgacccacggatcggccttggtgagacatagctattttgagacggcgggtgccgtatgtattccggctttttttaaatactttttttacaatactgctgagttgctcgtcttctcgttccctgaatgaaggaattcgatgcagccaatcatagtaagcactctgtgagacctgtaaaaatcggcacatcgataacacggtgaattcaccttgatgctgtttgatccaggcgtacttcaccgttgctccttggcaaagtacgcggcagccttttttaataggtcgcgctcctcggtcagtcgggcaacctctttttttagccgctttaactcttcatagagatgttcgtcagtgcgcactgcctttatgttatcaaccggtcgactgtatttactgatccaggtatgcaaggtgttttcattcacgccaatttccctggcggtttgggctacaggtttatccgattcaatggccaactttaccgatgactccctaaattcagctgtatagactttgggtttttcttggatcatttaaatacattccttctttcagttattttaaggaatgtgtccggtttagtgtagccacatcattcaccgtcggcactgcggtagtcccacttcgcggtgtgcgggccgagcgtgtcatgggcagcggacgacttcgccggtgccgggatgaacgaggtcggcaccaccagccaatcaccgacgtcatccagcagttccccaaaatcgcgcggtacggcaaaccctcgcgccgccgcccacagtgccagcacgtcgccggattcgccggtggcgaagtcgatccataccccgcgcttcgggccttcgagttcgataaccaggctgtcgccggcatcgccttgtacattgccgaccacgaagcgcgtgccctggcgcttgccgttcgggaacaggtacatcagcacggcttcgagctgatcgagcaggcgggcgcgcaactcgtccttgtcctggcgtcgctcgatacggtcgggcgcgtcgttgaagtcgaaaaagggatggggcggaacgttgatcgcgtcgattgcggccgtgctcattgggtgtgctccccgtcgagccgcgccttgaaccagtcgccgttggcgcgcacgcagtagtaggaacgccccggtccggcgtgatccgtgtcgggcacgatccagagcttctcgtcagcgtcatagcgccagctgccggggccgaacatcttgtcgagcactggctcgatgccatgccgggcgatgtgggcgcgcagttgccgcgtcatgcgttcgcgctcccggcgcttctggcggtacatcatgcccatacctcgctcggtcgatcgcctgccgtgcaccggcgggtgcgttcgcgttcatgagcttcgatctcggcgaggctgtagagcacgcggctgccgagtttcaggaaggccggtccggtgccgagcatccgccagcgttcgagggttttttcagacaaaccccagcgcgcggcgagctggcgcgggctgagcagttcggtggatggcagggtgacgttcatggggtaactcccgttcggtgggcggtgcccgtagtggccctcgctggggctcggtgacacctgatggacgggattcttcgcggtgttcgccggtgcggcaatgacgcacgcagcattgaaacccgcagccgttggcatcggttcgaagcgcttcgaggttccatgccatttcattcccggacgtgcaggcgtgcgcaacaacccgcgtcggttatcgacaggccgcgttcgcccgctgcgccctgatcgaccaaaccagtctctggcagcgaccatttcgacagtgcgaaacggtcgctgcgacgtggtgtcgtggcgatgccaaccccaggagcccgcccatgaaatcgaacccttcacgtcgccagtcattcaccagttaccgcgacactctgcgcagcgaactcgacgcattgacccagcagttgcaagaagcagaggctgccgccagctccgcacagcaggaggccgatgccaaacgtcgcgcctatcacaaactcgaaaagcgctcgaactccacacactggtcggtgaccgagcagcgcctgttccgcgagaagaaccatctcgaaggcgtcgcccgacaactgcagcaggatctggtgccgctgcgtgaagaacacgcccggctgaaatggaaagtccaggcgcccgcccagctggaggcagcgcgcgtcgagatggcggcgctgaccgaccggcgcacggcgctggcccaagagatcaacaaggccaagaccctgcagaagcagctcgattcccgcatcgagtctgtcgagcagcggatcgcccgcgatacccaatccaccgcaagtcgtctcatcaatgccggtgagctgaccgcgctcccgccagcactcgcttccctgcacgcggaactgaccgccacccgccacacccgcgatgaagtggcacggcgcatccaggctctgcagcatgagcatgacgccttgccggagcagatccgtctggcacgcgacagctaccagggcgcgcaggccatcgtggccgagatcgaattgcaggcgcagttgccgaccttcatcggcgtgatcgcccgggcggcggtggcgcggcaccgggcggggttcacgcgggagcaggggcggtacgagatcgagatccctgtggaggccctggaggcggccagtaacgcgctggatgccgatcttttggctcgctgagaggggtttcaccttggcttctgcccgccacagcgcgttcatcgacctgtctcaaacacaggaatctgaacgatgaccgataccgcaatgaacgacagcatcagcgcgcaggtggcggcgctgcccggcctgccgatgaaagacctttgggtgctgtgggatgcgcacttcccgcgccgtcccgcccacactaaccgccactacgtcgaatcgcgcctggcctaccggctgcaggagcaggcctacgggccgctgccggcgggtgtgcgccgctatctggtggagcgcggcgcgcagttctcgaagatcaagcccgccggacgcggcaccgaatgccatctgatgcccggcacggtgctggtgcgcgaatgggacgagcgcgagtaccgggtcaccgtcacggcggagggcctctacgagctgaacggccagcgcttcaagagcctgtcggcggcggcgcgccacatcaccggcacgcagtggtcggggccgaagttcttcgggctcaaagcaggcaaggggggcaaacgatgagcaccgccatcctggcctcgcccaagcgctgcgcggtctactgccgcgtctccagcgacgaacgcctcgaccagtccttcaactacatcgacgcgcagaaggaagccggccacgccttcatcaagagccagacccacgagggctggatcgcggtggcggacgattacgatgacggtggcttctccggcggcaacatggagcgccccgcgctcaagcgcctgctggccgacatcgaagccggccgcatcgacatcgtggtggtctacaagatcgaccggctcagccgctcgcttgccgacttcgcgcgcatggtggaagtgttcgaccgctgcggtgtgagcttcagcgccgtcacccagcagatcaactcggccacctccatggggcgcttgatgctgaatgtattattgtcgttcgcccagtttgagcgtgaagtcaccagtgagcgcattcgggataaattcgccgccagcaaagccaaaggcatctggatgggcgggccggtgccactcggttatgtggtgcaaaatcgcctgctgatcattgagcccaaagaggccgccatggtgcgccgcgtctttaccgattatgtcacggtgcgctccactaccgagatggtaaaaacctacgccgaagaagggctgaccacccgcaaaggtggaccctttaccaaaccatcgctgtataaaattctgcgcaaccgtatgtatctgggcgagctgctgcataagggcgagagttttcccggccggcaccagccgattattatgcaagcgcaatgggatgccgctcaagcagttatcgataaagatttcaaagagcgccggcgcgatacctggggccgcagacgtgcgcccgtgttactacggggcctgttgtttgcgcccgatggtgaaacctacacgcccagctacaccaacaagaaaggcaagcgctatcactattacgcgcccctcaaacaacgccgctttggcgcctgggcttgtgagcatgcgcccttgccagccgaacccatcaacgaattggtgacccagcagattctggcggtactatcggcaccccacagcgtgcaggtggtgtgggagagcatccaacaaacgcacccggagctcaccgagccggatgtgctcatccccatgcgcaatctggcgagggtgtggaatgaattatttatcgaagaacaatgccgtttggcgcagctgttgattgagcgcgttgtcgttgccgatggcggtttggaaattttctggcgcgaccaaggttggccagcattggtcaatgaactgcagcccggcaccttgggtgccgaactgcaagcggcggaggatgcgcaatgaaaccgacagtacaggtgttagggagtacggtgtcgcgcacccaacagcaaaacggcgaggtgagcctttccacgtttattccgctgaaaatccgcaaacgcggcgggcgcagagtggtggtacgccccgatggcgaaagcctgccgcaaggcagtaccagcacgccttttgatacgccattactggtcgcgttgagccgggcgttctactggcagcaattgatcgacgatggcgtggtagaaagcggcaccgacatcgcccagcgcgaaggccttcatcattcaacggtcaatgagttgctgcgtttgaccttgctggagcctgccatcgtgcagtcgatctttgccgggcaacaaccccgctgcatgagcctgcgctggtttcaggtgaatccattgccggcagattgggtcgctcagcgggagatcatcggtaagtttgatgcgtgattttgcctgtaaatgttcaagttggtacgaatgctaggcatagcgaactgcaaaccctcgccctgcaaagccgcataaatgcagggttttaccccgagactacccgcaggaaaaacagagaacagagccagctctgactgcaaaaatgcggaaaataatggattttatcggtaggcgacccgcaggacataaggccgaagtgccgcgccacgcggggatgcgcgcaaagaaaaagggcccggagattatccgagcccttgcatatggtggaggcggcgggaattgaacccgcgtccgcaagtcctctacagacagttctacatacttagccatgttgtttaatttaacctagcatccgccaaccggcaagctgatgataggcgagctacctattttttaacgctttgtaaagtaaccctgcaaagcgcgatcctcgttagtgactccactgtctgttgccagacccagcgttgaggcccactggcgtggagtttagccggattaagcggctaaagcgtagttttcgtcgtttgcgactatttttttctcagctgttttacgagggtactgaacctcggtatgccctgcgctgctttgtaacccacgtcgaaaccggatcgcccccgaacatgaattcttaatatataagagctggtgtggctcagaaagttcaaccggaaaattgtaacagattaaatataccgtaatagatcacctgggtggttaattagttcaaatgctccccatgtttccggtggatcaccggtaccgagatagccataaagcgctacaatcggttttactccagcagcaagactggcttgcacatcacgaatatcatctcccagataaatacaatgatcaggagctgcgtttatctgacgacaagcagtaagtaatggttccggatgaggcttggtgtagatagtatcatctccactgataatacaggctgcacggtgatgtaatccaagcaggtgtatgagcggccgagtgaatcttgctggcttattagtgacgattccccatgggatggcctgatcatccagttgttccagtaattcagggatacctggaaacaggcgagtatcctggcaaagttgttcggcataaaaggagagaaactcctcccgcatgactgggtaaccaggatcatccggtttcaaaccaaaaccaagattcaacaacccacgtgcaccagcagacgcaacggtacggatcagttcgatcgacagaggcggctgatcacgcgcaatacgctgccggttgagtgcgcggccaagatccggtgctgtgtccgcaatggtgccgtcgaaatcgaacaggacagcttttctgatcatcaggaatacttgatgtgcttgtattaaatcaggcttggaatgtcatgatgtagttgacactggtatcagcttccagagcatagatttttgtgattggattgtaggtcatgccgataatcccggactctatcaatccggcagtacgcgccatgcgcgccagttcagaaggtttaataaattttgcgtactcatgcgttcctcgtggcagcaatcgaagaatatattcagcaccaatgatggcataaagatacgctttcggattacggttcaaggtcgaaaaaaatacccatccaccattttttacaagacgggcacatgattgaatgacgctggcaggatccggcacatgttccagcatctccatgcaggtaacaatgtcataatgctgaggaaattccgacgcaagcgcttccacagttattttacgataatcaacctgatggccactttccagaagatgtaattttgctactttcagcgccttgtcgctcaggtcaatccccgtcaccctggcaccgcgtgctgccatggattcggataatatcccgccgccacaaccgacatcgacaactgtttttccatccaaccctgcaatttcgtcaatatagttcaaccgaagcggattgatttcatgcaacggtttgaattcactgtttggatcccaccagtgatgcgccagttgactgaatttctccagctccattggatctgcgttgatgccatcatttttcatacaataatttgcctgcaaatttaactgaaaagatacttctgccaataactgcatccctgaacagtttagctttgttcagggtatcaagttctcgattacccggcaatatccgcttgaacgatcaatgattaatcggacagggtcacttttcatgctttcatagcaaaaagccctgcacgctggcagggcttttaggtgatccacgttgaatgcgcggtaaattttagttaatggtttctctcgtaccagccacttcaatttccacacgacgatccggtgccaggcaattaattaatgttctggttgctttagtgccctggcaagaatcaccggtaaccggattggctttacctttaccatcggtaaagatacgatctgcaccgattcccttggaaaccagatagtttttgacggcttctgcgcgtcttacagaaagtttcttgttatacgcttccgagccgatgcggtcagtatagcctacagcaatgatcaaatcgtaattcaccccttccaggtttctggaaaaatcatctagcgcctgcataccggctggtttcagaacagccttgtcaaaatcaaacaatgcatctgccgagaaagatactttctcaggttcagtcacgaccggcactaccggtggcggggcctcaacaacttgctctggttgcttgaccagatcaggatcacattcataaatagccttggcaggtgtccagtagccggtgcgccagcataggcctgttgagtttctggcgacgaccccgttatcatccacagcataagcttcagctttatctgccgcgctgaagccttgtctttgttcttcatgtaaatcagccattacaatcccggatgccagcaatccgggcaaaataacggctcccatcagatatttcctggctaatatcatttttttcatgctattgtccttgttcttaagtataaaaacctgtatcacaaccacccacgatcacttttttatacgatcattcatactgttacgactctcccactcatcgtaatcagatcagcattgctcgcatactaccggcaacgattatgagttgatccttttatctttgtcaaaccgaagtgtatcttccgcacaacactgtatcaaaccacatagcccaatgtggacaaaccttcgggcgcttttaacgatacatgctccataaacggcgcagcaattacagagttaaccaagattgtctttttagccgaaaaatctggcagagcaggtaatataatatgcaaatctgataataaatattgccgtgaccccaaataatacatatccagttattgaggcggatggtttaaaacgctgcttcggccgtcgtgttgtcgtgcacgaggcaaacttgaaattaggctgcggggatgtcctcggatttctgggtccaaatggtgccggcaaaagcaccaccatgcagatgttaaccggcaatctcgcacccgacagtgggagcgtccggatttgcggggtagatttactgaaaaatccacttgaggcaaaacgttatattggttatctgcctgaaatacctcctctctataaagaattgacggtagatgagtatttacagtttgctgctcggctgcacggtcttgctaacacatcggtacagatcgcactggatgaggtaaaacaacaatgtgaactgagtgatgtgggaaagcggctgattggtattttgtcgaaaggctatcaacagcgggttgcaattgcccaggcaattattcaccggccacaactgattattatggatgagccaaccgtcggtcttgatccaaaccagatacaaaaagtacgcgcactgattcgcgaactcggtaaaactcacgccatcattctctcctcccacatcctctcggaagtagaaagtgtatgtaatcgtgtacaaatcatgcaccagggcaggctggtactggacgacaatctggacaacctgaaacagcgaaatatgaacctggaaaatatatttacgcaactcacggcagagaatgcacctgcctgggaatgggcgcaatgacgatgtttactatcgccagcaaagaactcaagttgttattcgtatcatcgctagtgtgggtttttctggcagtgatgcaactggtgctggcctgggtatttctggggcgactaaataccttcctcgaaatacagcctcaactggcacagctcgccaatccaccgggtataactgaagtaatcgtggcaccagtattctccatagcatccatcgtactcctagcggtaacccccgtactaagcatgcgtttattcgcagaagagcgccgtaaccatacgctggtcatgctgatttcagcaccagtttccataccagccatcgtgctgggcaagtttctggcactcatgatttttttctgtctgatgccgctgttaatagtcatgctatccatttcattattgacagggggcatgctggatttcgggctgctgggcagtaatgtaatcgggctgattttgctggcaagctgtttcgcttcactggggctgtatatttccagcctcacgtcctacccggccattgccgcgctgggcagtctgggggtgttgctgtgcttatgggtaatggatatcgtgaccatcgaatcagaaagtgctgtacgccatttttccctgttcagacattttgaaaacttcaatattggtctaatcgatacgttcagcctggcttttcttcttctttttgccatcacctttctggtgctgaccatataccatctggatggagagcggctgaatggctaagtttctgatccaaccggttttttatgaccacgtttaacaaaaaatcaggattacgatcccgctggcaaaacggtctattcattgccttgttcctggtattagcaggagtactgggttatctggcgctggagtttcgtacacagtgggatctcagtcagaataatcgcaacagcttgagtcaggccagcatcgatatattgcaaaagtttgacggcccggtacaaattaccgtttatgcaacacaacaggatttgcaactgggcgatattcgcggaatcatcagcaacttcgtcagcgtgtatcaacgaattaaaccggatctaatcctgaatttcattgatccggtagaacagccacagcaggcgcaaagcgcaggtgtcaggcttaatggcgaaatcgtcatcagtttcaaggaacgcaaagagcgtcttgccaccattaacgaacaggcattttcgaatgcattggttcgattggcgcgcaccgaaaaaaaacagttgctggtattgtctggccatggtgagcgaaaaatggatggtgtcacccagcgtgatatggggaattttaataagaagttgctggaaatcggtttcgaaagcaaaccattcagctttaccgatcaaccagagattccagataccggcatactgattattgcatccccgcagactgaactgctggaaggagaggtgaaaaagatactggattaccttgccaaaggtggaaatttactgtggctggtggatacaggccccctgtatggattgctgccattggctgaaaaactcggcattgtattgacacccggcgtggtggttgatccccaggcagatcggctgagagtaccatcaacgtttgcgctgggaaccctttacggcgcacatgctgtaacagaaaatttcgattacatcacggtatttccttttgctcgccagctcatttccgaggaaaacaccgattggcgcagcgtcactctggcagaagcagccccgcagggctgggtagaaaccagtccgctggaaggtgaaatcagttttgatgaggaaaatgatgttgcaggtccggtggagatcgccgtcgcattgaaccgggtggtagaagaccgcgaacaacgggttatcgtcgttggtagcggatattttctggctaacaattatctcggtaacggcggcaacctggatttgggtatgaatatgatcaactggctcgccggagatgaatcatttatctcgattcaaccacgtgtcaccatcgacagccgattggaactgagtgagctgcaattaaccctgatcgccactggttttctcatcgccctgccattgatatttcttgtaagtggaatcttcatcagctggtaccgcaaacgcagatgatgcgcaagtcagatcatgccagaactgcctgaagtcgaggtcacccggcgtggaatagatgcttacctggctggcagatacattacacaggtaaaaatacggaattacgttttacgctggccagtatcacctgaattgatcacgctgctccccggtcaaaaaattaataccatcaccaggcgagcaaaatatcttctgtttgtttgtagcaaaggcacactcatcatacatctgggcatgtcaggcagtttgcgcgtactacctgtatccacgccgtcattactgcatgatcatttcgaactgtggctggataatgaaaaaatgctgcgttttcgtgatcctcggcggtttggcgcaatattgtggtgggacggggatgttcgccaacatccattattgcaaaagttgggccctgaacccctgagtgatgcttttaatggattgtttctgcatgaaaaaatacaaaggcgcagtgtcagtatcaaagaagcactcatgaatcagcatatcgtggtcggcataggtaatatttatgctaatgaagccttgtttcatgccggtatttctcccctgattgccgcaggcagtctgagtacggcgctttgtgcgagattggttgacgctgtcaagatgaccttgcagcgtgcaattgaagcaggcgggagcagtttgcgcgattttactgattgcgatggtagcccgggttgctttcagcaacaatattgggtgtacgggcgaacagggcagccatgccggaaatgtggcgcacttgtgagtaaaactcgccagggacaacgatccagctttttctgtgcgcagtgccaaaaataaaaaagccagtcaaagattcagctcacgagcttaatcaaacctcatgctgctgcaaccaggtatccagcaatcggcgcagtgattcaatcggacgataacctgtggtgatcaaatggcgatctgttccgctttcggccacaagtgccggaaatccgcttataccccattgtgcagcacgatggaaaccagccaaagtttgttgtttcgcctcttccgattgaaacaccgaagcaaactgcaatgccgatatatctagatcagcagcaagttctgccaggacagaaaattgcgtcacgtctttttgttcgacataaaaagcgtgctgtatcgcagcaaaaagggggaatattttttccgattcgatcagtgacatactgacaacgctccgacaggcaggttcagtatcgtaaatgaatccttccggcagggcattttcaaaggtaaaaggctggccagtcgtggtatgcaccgtatgccaatgctgcagaatttgtgcttttttttctggtaaaagcggcatattcgttcctggccgcagccctccgggtatcaactctaccgtcaaggatgccgaatattcctgcctaatttgctcgataaccggcgcaaacccccagcaccatgaacacatggggtcagcgatataccatagaaccaattttttatacctgttgccaggaaacatcaggcaacggagcggcccgcccgtttacgctcgtgttctagcaggaaacgtttacggatacggatacttttcggagtaatttcaaccaactcatcatccgtaatgaattcaactgctgattccaatgtcaactgaatcgggggtgtcagcacaaccgcctcatcatggccggatgcgcggatattagtcagttgtttacctttgatagggttaacgacgagatcattctcacgggtatgtatgccaatcaccatcccttcataaaccggctcaccggggctgacaaacatgcggccgcgctcctgtagcttccagagcgcgtaagccactacctcaccatattctgccgagattagcacgccatttttacgtgaagcaatatccggccgcatcggtgcatattcatcgaagatatggcttatgatgccagtgccgcgcgtcagtgtcataaattcggattggaatccaatcaggccgcgtgcaggaatacgataatccagcctgacccggccacgcccgtcacttatcatatccagcagatcaccacggcgtgttcccaatgtctccatcaccgctccctggtgggtttcatcgatatcaatcgtcaatatctcgaacggttcgcacttaacgccatcaatttcccggataaccaccttggggcgagacaccgccagctcataaccttcccgacgcatgttttcaagcagaattgtcaaatgcagctcaccacgcccggaaacaagaaatgaatcggtttcgccggtttcttccagcttcaatgcaacattggtcagcaattctttttcaaggcgctcacgcaactggcggctggtaataaatttaccctccttgccggcaaaaggtgaagtattgacctgaaaattcattgaaagcgttggttcatcaacctttggcatcggcaaggcttccgggcgatcagtatccgccagcgtcgtgccaatactgagctcatcaatcccgctgatcaacacaatttcgcccgcagctgcttcactcaactgaacccgatccagtccgctaaaagcagatatctggttgacacgcgcttttttcggtgtttgtccacccgtcattaccatcacttcctgccctgatttcagacgaccccggctgattctgccaataccaagacgcccaacaaaactggaataatcaagcgcactgatttgcagttgcagcggctgatcaggatctcctgtcggtgcgggaacatgcttgagtatcagatcaaacagcggacgcatatcgctgctaggttgtttgggatccgatgtggcataaccgttgagtccggaagcgtagatcaccgggaaatccagttgttcttcggtagcattcaatttatcgaacaaatcgaatgtctggttcaccacccagtccggccgggcaccggggcggtctatcttgttaatcaccacaatcgggcacaaaccggctgccagcgccttgcgagtgacgaaacgggtttgcggcatagggccctcaaccgcatccaccagcaacaacacaccatccaccatcgacagcacacgctcgacctctccgccaaaatcggcgtggcccggggtatccacaatattgatatgtacgccggcatagtcgattgcacaattcttggaaaaaatcgtgattccgcgttcgcgctcaatatcatcagaatccatcacccgttcagcaatggtctggtgagcagcaaaggtgccggcctgatgcagcagcttatccaccatcgtggtcttgccatggtccacatgggcgataatggcgatattacggagcaggcgtgtcataattgaaagttcctcggaaatcggcccgggcaatcccggataaactgttgattataacagtgttcgaactgtcagactgaccggggtattatctatttacaatggaatttgtttcaaaactcgggaaaaggcatgtttactggaatcatcaaagcggttggccgtatcaggcacgtctatcccaaagaagacgctgttcgtatccatattgatcccggcaagctggatctcacagatgtcgccattggggatagtattgccgtcaatggcgcctgtctgacacttactgcatttgaggaagggtgcttcaccgtcgatgtatccggtgaaacattgagttgtacacatggtctggatattcccggcaatccggtcaacctggaaaaagcgttgcgattttccgatcggctggatggtcacttggtcagcgggcatgtggaaggagtcggcgaagttgtacaattcacacaagcaggtgatcgctgcctgctggcaatccaaccgccgccacaattgtttaaatatattatccccaaggggtcaattacggtcgatggcgtcagtcttacggtgaatcaggtggcatctgaacgagttgaaatcaaccttattccccatacattagccaatacaactttcaaacagtttgagcccggcaaaaaagtgaatctcgaaacagatatgatagcgaaatacgtggcacgtttactcgatcaggcacaaggcaagcaatcatgacaatctcatcgattgaagaagttctgacagacttcaaaaatggaaagatggttatcctcattgacgaggaaaatcgtgagaatgagggcgatctggtactggcggctgattttattacgcccgaagcaatcaatttcatggccagatacggcaggggattaatctgcctgacattgacagaagagcgttgccgtcagcttaagctgcccatgatggttgccgacaatcattcgccattgggcaccaatttcactgcctccattgaagcagccagcggtgtaacaaccggaatttccgctgccgatcgcgcccgtactgttcaaacagccgtccaagcggatgctaaaccggaagatctggttcaacccggccatatttttccgctcaaagcgcagaagggtggggtgctggctcgcgccggccataccgaagctggctgtgatctggcgcgactggcgggtttaaccgaggccgcagtgatttgcgagattctgaaagaaaacggtgaaatggcaaggctgccagatctaatcgaattctccgatgagcaccatctcaagattgggacaattgctgatctcattcattatcgccgtctcacagaaagcctggtcacacgaacgactgaacgtcccttacaaactgctcacggagaattcagactgattgcctaccatgataagattgccggcgtcactcatctcgcgctggtaaaagggacatggaataccggtgaggaagtactggtacgagtgcacgaaccgctgacggtgattgatctgctggaaattgatgattacacccactcctggagtattcatgatgcaatggcagccatcacacatgtcggaaagggcgtagttgtactgctacagcgcaaaaatgatgccagcgtgttaactgagcggattctgcaaaccacaccgcatccagcggacaaacccgtatcggatctgcgccatcatggtatcggtgcgcagattcttaaagatctaggagtcagtaaaatgcgcctgctggcaacccctcgcagaatgcctagtatgaccggctttggtctggaagttaccgggtatctggaaccggaagatcgcgatcgcgtgtaaaaacctgttcaaagtctcgatcaagggatgcagtgcaaggcaaggcaaaattgaacgagaaagcggagcatacttgaaatatgtgagcattttgagttcaatttcaacgccgtaatgcgcccttcagtgagatattgaacaggttctaagacacttttgctatcaatttccggccacaaggccaatcaaccaactttaaaacaaagagcagagaggtacgtcttttatgtcctactatgacaatattctcgaaatagattcagatctcaatggaaacgggctgtgcatcggtattgtcatgagccgtttcaatattgatacgagtgaagggttgcttggcgcctgcacaacggaacttgccaaactgggcgtgcaggaagcagatatcgttctggtaactgtacccggtgcgctggagattccgcttgcgctacaaaaactcgccatatctgaccggtacgatgccctgattgctttaggtgcagttattcatggtgaaacctatcattttgacgtagtggccaatgaatcggcacgcgggctgataacagtcggactagaatacgacatccccattgcaaatggcattcttacaacggataacgaagatcaagccactgcccgcatgaccgaaaaaggggctgaaaccgcgcgtgtcgcggtagaaatggccaatctggcattaacacttggcgaaatggatcaatccaccacctcttcatgataccaacagacactgcgccaccatccaaaccagcacaaggacacaaaggctataaaaatcgccggcgtctgtcacgtgaactggccttgcagggaatttaccaatggcgtcttgccggggggaatgctcaggaaattgacctgcaactgcaacaggtcaatttttacagcaaagcggatggttcctacttttccgatttgctgcagggtgtactggaacattcccgtgatctggaagcacaaatccaaatttatcttgatcggcagctggcagaactaagtccggtggaatgttcgattctcttaattggtacctatgaaatggtgcatcatcctgaaataccctgtcgggctatcatcaatgaggcgatagaactggccaagagttatggcgggacagatgggcacaaatacgtcaacggtgtactagacaaactggccgcccagttgcgggctgttgaacttcaatccagccccgtccggaataaggatccacactagacccggtcattacgtcgatagcaacacctctctaaaaaattgtttaaccaaaatagtcgacaggaaaagagggggtaatttattttgccattgcaaacgctgttttcttttccttatctgcgctagccgcaacccagtgtggcgtggtaatctcgtttctctagcaccattgctgctggggagttgcttcccgccatccgtcaacatcacactcatggttgcagtccgcaataatagttatcgatttatctaacttttcataaatggtgtagctatgaactccgagtttgacgtcattaatcgctatttttcccgtcccgtacgcaacgcgctgctggggccgggagatgatgccgcattaattacctgcacaccaggaatggattgggccgtatcggttgatacgctggtctcgggacgacattttttcctcgatattgagccttctacactgggtcacaaggtgcttgctgtcaatctttccgatatggctgccatgggtgctacaccgcgctggataacgctttctctgacattaactgaaacactcgcacaggatgatgcctggctcaaggctttttccagtgggtttttcgcgctggcagatcagtatcagatcgagttaatcggtggagataccaccagcggcccactcaacattggtgtacagatcattggcgaagtcgagcagggcaaagccctccggagaagtgacgccaagccgggagatgatatctgggtatccggttttttgggggacgctgccctggcgctgcaattcctgcaacagcgtataacactgacagagcaagaggcaactccttgtctgaccgcattgcatacccccacaccgcgtgttgttcttggaaaagcgctggtaaatgtagcgcatggtgcaattgatatttccgatggtctgctggctgatctcggccatattctggaacgatccgatgttgccgccacagttgatttcgaccgcattccctgctccccggcattaaaaaacaaactgcaacaggaaaatgccactcggcaattggccattgactgtttattatcaggcggtgatgattacgaactgtgtttcaccgcaccagaaaacaggcatgatgtcattgcacagcttgcgcagcaaacgggcgtgaaactctcccgcatcggcaaaatcgtgccgggaaaaggattggccgtactaaatgccaatggtaactcgctaatttttaataataaaggctatgatcacttccttacccgctgactattcaccacgacgtcaaacgccactaaaaccagatattacctttgtgcatgtccggctagcgcatttcattgcaatgggcgctggtgtcggtctcatccgcttcgctccgggcacttttggcacacttgccgccatccctcttttccagcttttggattcgatcctcgaacccgtttcagtgctgctgatcattgatgttttttttatcctggggatctgggcatgcgcagtcaccggacgagcgctcaattcacccgatcattccggcatggtgtgggatgaaatcgtcgccttcatgctggtgctgtttttcacaccaaccttctgggtctggcagctggccgctttcctgttattccggttcttcgatattgtcaaaccttcccccattggctatctggacagcaaactcaaaggtggattcggcgtcatgctggatgacctgctggcagcgttttataccctgctttgcctcgcaggctggaaatcgatggtgctgttcgaaagctacttttgagcgcttacccaaccattccggatgacgtaacgctgctggaattcgcccgacaaaccggacaaactctcaaaaataacgggttgaaactggtttcagcagaatcctgcaccggcggctggatcgggcagatcgtcaccgccatttccggcagctccgcctggtatgactgcggtttcattagctacagcaatttatccaagcagcagctgttgcgtgtacaaccacaaacgctgacacagtttggtgcggtttccgaacaaatcgcacgggaaatggcgcaaggtgcgctcacgatgagccaggctcaggttgcagtgtccgtaaccggcatcgccggccctaccggcggttccacagaaaaaccggtcggcaccgtttgtttcgcctggatactggagaattcatctacaaccgctgcaaacagcaaaacctgccggttccgcggtgatcgcgaagccatccggcgacaatccgtcgccacggcactgcaaggtatccttgaactactgaaaaactccacatctctatcccttgcctaagcagcagggtatccccggccattgaacctggaacacagattcaatcatctgtgtgtttaatttgtgcctctgttagaatcagtgcgggaagtcggtcagacagtcgctgcctggtaacagggagaggaaagtccgggctccacagagcaggatgccggttaacggccggccgccgtgaggtgaggaacagggccacagagacgagcgtattaagttacggtgaaacgcggcaacctccatccggagcaagatcaaataggcagatgatgacgctgctcgccgaatctgcgggtagatcgcttgagcatacgggtaactgcatgcctagaggaatgactgtccacgacagaacccggcttatcgactggcttcccccataaacaattttaagtagcttaaaaaagaaaaagggcagagtgacctgccctttttacagcttgattagctaactgctaacaattagaaatcgtggcgaacacctactgagtagacattacgatctgaatcagcaattccgacagtcttgtcatctacccaaacgcgctgataaccaccaaacaggctggagcgacggctcaggttgtgaattacaccgacggtaatattttcaacgttacgtttagcagagaaacctttactttttgcccgggtcataccaccttgggcgaccagcatggtgttaccaatggtgtagtccacaccagcaatccacagactaccattaccatttgcattcatagcagaattacattggccacggccaccatcagcactgagagtaggattgagcgagttataatccccaaaagcagaggcatgggtacaactggctgccccaccaaactgattagcatgtattacatgctcatattgaccacgcagacggaaatcctctacggtaaagaccgcaccgccacgccagatttgctcatccttgggtgcacccatcgatttttgcagtttgctaacattatctctggagtaagcaccaaacacatctacaccaaccacatcaaactgtccgctgtacttggcagcaacctggaaatcccattcaccattctcaccaccagcatataccggatcacgtgtcggatcatttttatccgcatcacccggcatcagcaaaccggctacggaaaaaccctctacaaccggcgaatcaaagcgtacagcactgttgacaaaaccatgatcacctgaaccataaccattgtcggatgaggccatcaagccaccactaccattcgcatgcagactagtataggcaaatggatcaatagaatgaccaccagcaaaatctttgagtacggattgaacacgaccaaatttgatttcaccccattgatcgccacctaacccaacccattgctcacgtgcaagatgtttatcctcaccgccacctggattaagtgaatactcaatacggcccaaggcacgcagacccatacccagatcttcagcaatttgcagaccccagcgggattgcagtgcatcatccgctatagcggattgtgcgttaaatccgtcaacatcaacggttgcatattcagcctgcaagcgaccaaaaatggtgacgtgtgtaccatcggcagcggcagtgagcggaactgccatcacgccagcgattgccagtgccatcagttttttattcatttgaaactctccttaaagaaaaatatctggatcaataaagatggaccttgattctctatacatctacattctttactacttccgttcctgcctgatcagagatgttgcatatcgcatacttttccgaacagaagggttgaacggattgtgcccaagcagaatctgttgtgcaacaccaaacccgatttttatacttttttcgctaaattatgttgtgttattgcaacactctcgctctattcataaaaaaatctgtttttttactgtgtataaataaatagggggaggctggatcgccacagtccaacggacccaagaagaagtatttaccggatttcacatacatcaagcgcagataaatcaatgggagcttgctggtatgaagcagaatgatgataaggtgataaacgcagctttatgcgggtttctccacgcaagatacctctagctgccggggcgagctgcaaggtaaatcgttctccgccagcagtgaaataacctaacgccagcaggtgtctgaatacgatgcgccagccttcgatgctaagttcatgaccaatgccgaaggtgctgacacgatcatgtccccattgcctgatccggtcggtctgttttccggtcaggacatcaatcagatattccataccaaaattctggcctgtccggtaaacacaagacagtgctttctgagcagcaagcgtgacatcctgaacaggagtggcagtcaagcaggcatcacaattgccacatgctagttcactgcttgaatcagatggttcgccaaaatagtcaagcaatcgtgttctacggcaagcagttgtttcacacagcgccagcaacgcatccagccgggcggtagcggcctgctggactggaatggatatttgtcctgcattggattcagcctgataacgcaatcggataatatcgcttggcccatacaccatccatgcatcagccggtaggccatcccgcccggcccggccagtttcctgataatagctttcaatacttctgggcaaatccaggtgcgcaacaaaacggatatccggtttatcaatccccagcccgaatgcagaggtggcgatcatgacaatgccgttctcctgcagaaattttttctggtgttgtgtgcgtacaggtgtttccataccggcatggtaggcaagcgccggaatgtgattagcattcagccaggcagctgtttcttcagtttttttgcgggattggcaataaacaatacctgcctcgccgggatgctgattgcggataaagtttaacagctgtcgccggctgttggatcgggcggtaatgcggtagcaaagattgggacgatcaaaactgctgatgaaagcacgtgcctggcctagctcaagacaacgcagaatatcggtgcgggttctggcatcagcgctggcagtcagggcgatacgcggtacgctcggaaatttctccggcagcattgaaagtctgccgtattctggccggaaatcgtgcccccactgggaaacgcaatgcgcttcatcaatagcaaacagggcaatgggaatacgttgcagcagcgcatgaaagcggttggtcagtaatctttccggtgcaacatagaccagatcgtagttgcccgccagcatgtcttgttcgattactgctgcagctttggaagtttgcgtagaattaagatatgttgcccgcacaccgcgttcatgcagtacagagacctgattttccatcagcgcaatcagtggtgagatgacaatggccacgccatcccgcaataatgctggcagctggtagcacaacgatttaccgccaccagtcggcattaagaccaggcaactgtttccgtttgcgatatgggtaatgatttcagcctgctgcccgcgaaattcggtgtaaccaaagatttctctgagcagagtttgtgcacggacagccagggaagtcatttcccgtccatgaagcgctccaggtcgcgccgcacacgcttggtcggccgacctttaccagcgtaacgcggcggcgttggctgcgatttgagctctcctgccagcatctctcgcgcttgtcgactttcttctgtttcttgataaagtaggcgagcttccgtagcagatcgacgctgattggacaatgccagcactttcacccgatgatgatacggcccgatgtgaatatcgagcatatcgtctacgttcaggattctggatggcttcacccgcataccgttaatttgcacctggccacgctcaaccgcatcagcggcttgcgagcgcgtcttgtaaaaacgggcagcaaacaaccatttatcgatgcggagtttctcatccgtggcctgtgcactcttttcagtcatggcatatccggggtgaataggtcaataaaaagcataagcccccttgataagcatactgagcgcaatgcaccaagtcagaatagcgaaaccacgttccagcttggcttcgtcaaaactgtgagcatagtgtttgccgatcagcgtaccggcaactgtacctgcggtaaaaggtaaagcaagcggccagttcataaagcccatggaggttgccgaaataacgcccgtcacggagattagcgctgtaatggaaagcgcggtggcaatcagggttttcatgggtaaatctgagactttcctcagcgcaggaatgatgatgaatccccctcccacaccgagcaaaccggatagaaacccggttgcagcacctgaaaccagcaatcctttggcacagggaatggtccatatcaaacggccgctttccagattgagctgacaaggtggaaaaacagcttcttccggctgtgcagtaagattactcttgcggtacatgtacaaagccgcatatgccagcacagcagaaaacaataccgtcagcaatgcatcagaaaactgctgcgccacccatactccggcaggtgtaatcagcataccagtacccgcaatgagaccggctgcccggtagcgaataattctttgtctgagggatgaataagtggcgactgctgctgatacgcccactgacagcaacgcaaccggcgcggcttccgctacggttacgttcaggccaaaaatcagtaagggaacggcaataatggtgccaccggagccggttagcccaagtacaaaccccgtaaaaatacccggcaaaatacccagccagtgaacttccatacagaatctatttggattcagtggatccagccagccattcacgtccttttagcaggcaatcccagtatacccacgggaaaagattaactttcatccaccagtataattttctggcaataaccgggttgagcggaaaagttggcaacagttttccaccataaccaaattctgccagaacgactttgccattttcgacagtcaacgggcaagcgccgtaaccatcgtaaaccgcgcgaagttcacgtccttcttttgctgccagcagattttcagcaacgatgaccacctgttttctaaccgcggctgctgttttagagttaggagcagaacaggcatcacccagtgagaaaacattggagaagcaagtgcttcgcagtgttttgggatcaacttcacagaatccggcagcatttgccagtggactgttgctcaagaaatccggcgcgacctggggtggcgtgatgtgcagcatatcgaacggcttatcgacacgggtaacttcgcctgcctcattcttgatttcaaaggtagcaattttttccgggccattgaccttgaccagattggaattgaacaccagctcggcatgatatttatgaacatactccatcaaaggcggcacaaactcgggaaccccgaacaaaactgctcctgccagatcgaattcgacatcgattttgtccagaacgccatggcgctgccaataatcacaagataaatacatcgctttctgtggggctccagcacatttgatcggcattggcggttgtgtaaacagcgccttaccacctttaagctgttgtaccagtgaccaggtatatggtgcgagatcgaacaggtaattagaggtgacgccgtttttgccaagtgtttcctgggcaccttctattttttcccaggccaggcgaatacctgggcatacgatcaattgacggtagccaacggaacggccatctgccagatgaaccagatttttttcaggcgcaaattcggatgctgctgccttgatccactctgcgccatgcggcatgacatcagctgtattgcgagcggtctgatcaatagcatacgcgccgccaccgaccaacgtccaggcaggttgataataatgtttctcgcttggttcaataacggcaatgcgtagggatgaacgtcgacgcagcaggctcgcagttactcctagaccagctgatccgccgcctaccaccacaatgtcaaaaacatcatcccagttgcaagctgcgactgttacggtctggcgtttatctgccggttcacaataagtttcggctacatcctccacttttttttgtgtgccagtactggcagatgctgtagaagcgtcggtattgcgagcgtacaatgcctgagcacgattacccgagccgcagaaagccagtaccgggccaggcagtgtttgcattaattggtgaaaagcagaacatttttcatctgaaacctggccaacttcaaccggcatataagcaaactgcaacccagccgccttcgctgcgttctccagtgcagtgcgagctggttgactttctccgccttctccatcgggtcgattacaaataatcgacttgtaacccgcagccgcaataccagcgatatcatccacgctaatctggccagtgactgctatttttttatccagctctttccattttgtttcaggggtgacactcataatgatttctccttacttttgtttttttattactgtcgatttgatagtggcttcgtattggtatgtagtgtaactgctccagagactgctccaaaattgaattccaagagcttaatcctgctcttgcggatgccgtttgtcagcgtgaacattgctggtggaacgacatgattcgtcgcaaccatttgtgtcatctgaaattgggtaattttcatttccgcagtataaatcaaacagtgtgctaatgatttgcactgcttcccggctggcaagactgtaataaatatattttccctggcgttccgtggagacaagcctttcctctcgcaacacagtaagttgctgcgacaaggtaggttgccggatacccagtaattgctccagttcgccgacattcttctttccctgtatcaactgacacaggatcatcagccggtcttcattagctagaatttttagtatggaacaggctttgattgcagcagcctttttttccaccatggccgacagagcctgttgcagatatgaatctatcattctctgccaatatttttttgttgtcgatcatttggttttgaaacagcctgacggtatttttccagtcgatcgaaaatgatcatacccagcaacatagccaccataaatatgatggctccggaatgacccgatgcagccagaaccagacttggccccggacaaagacctgccagtccccatcctgcaccaaacaacagactgcccaggatcaaacggcggtcaatcgtatgggaaatgggcaaatgaagcggtgcggacaatagcgtttggccacgttgttttgctgccctgaaagcaagaaatccgatgctgatcgcgcccagcatgacaagagccagtgaaggatcccaggatccggcaacatccagaaatgctaatacctttgcaggatctgtcatgccagaaaggatcaaccccagaccaaaaataaaaccggaaagtaatgcagctattaagataagcatatattttcctctcaaaattgaatgcagcgctagctcaagctgtggcgaataatgtaaaccacgcccattcccatggccataaacgaaattgttgccaccactgaacgtggtgaaagacgcgatagaccacaaacgccgtgaccgctggtacaaccagaaccataacgagtcccaactccgaccgccaacccagccaacgccagcattgcatgactggtttcgacatgaactggaggcagttcgcccagccagcgccacaaccacggagcgagcaataatccaataacaaacgccgctcgccaggcaagatctcctttacgtaattcgatcaacccgccaacgataccggatatgcctgcaatccggcctgcaacgagcagcagcagcgtagttgccaggccaataatcatgccgcctgtgaatgcgctaaccggggtaaatgattgccagtcaatcataagttttcctccttgacagataaattatcctaacacattatatatttttatgatttaatgttttatatattaaattatttgaatacaaacaatccaaggagatgatgatgcaacccaatatccaagctttctttgatcctgttaccgggacaatcagctatgttgtgtttgacaagccgggagggcgttgcgccattatcgacccggtacttgattacgatcccaaatccgggagaacaaaacatcactccgccgatgtgttgatcaaatttgtgtactcaaagaagttgacgacggattggatacttgaaacccatgcgcacgctgatcatctttcttcagcgcactacctcaagcaggaactaggggggaaaacagccataggcaggcggattcccgacgtgcagcaggtatttaaaaagctgttcaacatgggggcagattttcagccggatggctcgcaatttgatcatctgtttgatgacggtgacagctttgaggtgggcgaactcaagggtaaggtgattttcgtacctggccacacaccggctgaccttgcttatcagttcgacgatgcaatttttatcagtgatacgatgtttatgccagatatagggacggcacgtgccgatttccccggaggcgatgcccggcagctttatcgatctatccgcaggctgctgaataattatccaccggaaacaagattgttcatgtgccatgactatccacccggtgaccgcccggtacagtgggaaagcacagtcgctgaccagtgtgccaacaatattcatgtacacgacggtatcagtgaagacgaatttgtcgcgatacgtaccacacgtgatgccacattagatgtgccggtactgattctgccatccgttcaggtcaatgtgcgtgccggccagatgccacccgctgaagataatggcactgtgtatttgaaaataccgattaatgtattgtaagcaggtttatgtgaacacctggtcaggaaactggccgggaagaatgtacctgcaggagtttttgatcaatcagaagttttctagttaccaatagcgaacgttaccggtatcaacatggataaaatttgattccgggtagtagccaacgcccccaacacgcatcgacatggccgcacgtcgcaacgcattaagtggaacaccaggcaaacgaatatctattgccttaccttgcatatgcaggctttttttagctacaccgtggcttttcgctgcgagggtagcattggtagccggcgatcgatacccggaaattacctgaaattcttttgagctgcctgttttatggtgcagatgctggatcagatcaagcaatcctggatcaatcgggtgacgttcaccggaacgatggtcgcgcaatactctagctatcgcctgcaatgcttccggaatatattttccctgctcccagtaagctgtcctgattctttctccggtatgcagatttaacaaggacaggcgtttttcataaatacggggggaattggcagcattggctgccggcatggcaaatagtgcacatgcgcctaaactggcttgcaacagtcgccgccgactgttgccatgtgcggtaagtgtttccagattgtctgcaatgataagtttggacattgttatcctccatgatcgtgccaaattaaaaagactgtcatagacacttttccggctgttaccagtgggcgtatgccagcgcccgtttgtcacgcccgtagacatcggatgaaaagtaaacctcgccctgctcatcgctccaagcggtcagatacaataaataaacaggtattttttcaggtaaatgcacggtttgtgtcttgccactgctgattttttcagcaatatcggcttgttcaaatgattgccctaagacaaactctgccagttgcaatggcttctccagacggatgcaacccgagctgaaagtacgaatatccttctgaaacagatatttggaaggcgtatcgtgtaaatagatgctgaaaggattgggaaacatgaatttgatagtgcccagtgcatttcttctaccaggatcctggcgcaagatataaggaagagatctgctggtcgaatgccagtcgataaaatcaggattcagctcggattcatatttgtaatcggaaaataccctgattccctcggaagcaaaataatccgggttatgtctctgttttggcagtaaatccttgcgtgcaatgctggcaggcacattccagtacgggttgagaaccaggtgagtaattttgctgttgaaacttggtgttgaacgataatcacgcccgacaacaattttcatatccagcacgcgcacattctcctggactgccaccagattaaatccggcaatattgaccaggatatagcgatcaccgagtttcctgggcagccagcgcaatcgttcaagcgtgatacgcaactgctgaacatgctctcctggcgttatgttcatggctcgccgggtatttttaccaataatgccatctgcatttaatccgtgttgacgctgaaaggccttgatcgctatttccagctgatcatcataaaattcgctattactgacaacaatatcatattccggtttttcaaaaatatgatatgcctcctgaatacgctgacgtacctgtggaatagaagtatgcctggtatgcgggcgaatcaatgaagtttcctccggtatcctggcccatatggtatcggcagcaaccagtgcacgaaatttgttcaacagttgtttgagcgaacggtattgcggaatatcaggtggcaaatctgcaaaggcctgttccagttttcctgaagtgagtgcttgctgcagaaacgttaccggatcaaattgctgttgtggaatgtgccaatccggatcagccagagaagccgtcagccggccactgtgcaaatcatgggcaagcgccagcaatgatcgggttgtatccagttcgagtagtagggaaattggatcagaagtttcgtcacgaagttttcgtaaggattcaatatggtaatcattgctggaaagcccttcttcatcagcttgcctaataagcactaacgcagtgtccagcaaggcagcagaatgaccagccaaagtccagacaggttgataatcacgttgcgcataaaatcgctgcaggtttatctgtaccgcactatcctgattgttctgaatattttttgccaattgttcgcgtatcgattctgcgctgacaatccaattttcagcaatgacgggtaaaatcgtaaatatcagcgcaagaaaggttaaataccgcgctgccgctgaaggattgatccagaactttttggaattttgaataaataacaaaaaaatattcctgtattcccggtttaaaagggccattatcaaacagttttccctctgtacccagagcagtttttaaaagatattttgtaaagatatgctttttatcatacctacccgggttgataaaatgaaaatcaaaaggataaatctgaaagctgttggccggttttctgactactgcaaacagaccaaacaaaatcaacatagctgtaatccaggcctggcaaagctgtacgcaataagacaacccttccggaaaaacttcattatactaacctcctcagcagataaacggggttcacgtaaacttataaaaaacccttttgcttttacaccgcacttaactgtttgtttttcctctctagttttttcaagtttcaccggaatac

SEQ ID NO: 2 - DNA, 65132 bp, Nitrosomonas eutropha
agagcggatcgttgccgggttaaccgccgccagacggcgtggacgaataggcgggcgtccgcaagcgatcaccggcgaaaaactcgacgcgattattgccgtactgaatggcggcatgtccaaggcagcagtttgccggaattttggcgttaaacgcacgaccttaattgatacattgaccagagtcggctggcctgcttcatataaggaccagtaacgctatgggtgacagatgggcattgacgaccgaggaacaagcgctggtattgactaagcgccaagccaatcggttggcatacgccttttttctggtctactttcgtgaatatggcaaatttccacggaatacaactgaagtcgatgaaccgctgatcgttattttgtgtaaacaactcggctggcccgaggtagacacagatagcgtgtttcaaatctcggatcgaaccttagaacgattaagaactgagatacgcgcacgctttggattccgggaggcgacggttgccgacgccgacatgcttgaggaatggctacaagtgaatgttgcaccgaatgccgggggcgaaattgatgccatgctggaacggctacatgcccattgcaaagcactccgcatcgagccgcccacgcaggaacggtccgaacggattgcgaaggccgccttacgtacttatgaagaacggttctgtgccgaaatcttcgcaaaattatccgacacaacacgcgcaaagctcgatagcttgttaaaacccaacgatagcaatataactgaatatgattcaattcatacgtttaatttcgcgccggccatgctgttaaaactttgtagcaatcctggtcgccccagtcttgcaagcatgcaggaagaattggataagctgactttaattcggcaaattgagctaccggaaaatttgttcggcaatgttgccagcagcgatcttgaacgctatcgtcggcgtgtagcggttcaggagccgcatgaattacggcgccttgctgaagccacacgcatgacctggttggccgccttcgtttatcttcgcggccgcggccttatcgatgatttagtcgatacgctgattgagactattcaccagatcggcgcccgtgccgagcgcaaagtcgaaaaggaattgttagatgatcttaagcgtgtatccggtaagcaaaatttgctgtttgagatggcggacgcctcattgtccaatcctgacggcgtagttagagacgtggttttcccggtggtaggtgaacaaaagctacgcgatttagtgaaagaatggaaagccaccggcccggcttatcgactgacattacgaaccgtaatacgcaattcttataaaggacactatcgccgcatggtgccaaaaatgcttcaagcgctggcatttcgctcgaacaacaaacaccatcaaccagtgatggatgctctggatttggttaagcagtatgctgacagcaaagttcatatttatccctcggatgctgatgttccccttaatggtgttgtcagtgatttgtggcgtgatgccatagtggagaaagacgccaaggacagaaacagagtcaaccgcgtcacgtacgaaatcgcagtgttagaggctttgcgcgaacgtctgcgttgcaaagaaatttgggttgtcggtgccaaccgttaccgcaatccggatgaggatttacctcaggattttgagcagaaccgggaggagcattatgcggcgctagatttgccgcaagatgtggatcaatttatagctgatttgcaagcggacatgcgcgaagcactggagacccttaatgccggaataataaagaatccgtatgtcaggctcaattccaaaaatagcggctggattagcttatcgccgctggaggcacttcctgacccgccaacgttaacggtgctcaaaactgagctcaataccatgtggccgatgactaatctacttgatatggtgaaagaggccgatttgcggttgggctttacttatgtattgaaaagtccaacatcctatgaatcgatggatcgggcacttttgcagcggcgcttactgctttgcgtacatggcttaggtactaatgccggactacaacgcatggccagcctgggttcgggaacctcggccaaagacttggcctatgtacgccgccgctatcttaatgtcgacagcatgcgtagcgccatagcaatgataaccaatggcactctgcatgtccgtgatccggccatatggggaagcgataccacggcttgcgcttcggactccaagcatttcggcgcatgggatcaaaacctcaccacgcagtggcatgtacgctatggcggtcgtggcgtgatgatttattggcatgtcgagcgcaattcgctttgcatacactcacaattgaaatcgccatcatcatctgaggtagcgtcgatgattgaaggcgtcatccatcactgcacggaaatggaggtcgatcgccaatacgtcgattcccacggacaaagcaccgttgcttttgcattttgtcggttgctgggattccagctgatgccacggttaaaaaatatctacgcgcaaaaactgtccaggccggaaacaggcatgcccaatgcctatgaaaacctgcaactgattctgaccaaacctattaactgggatgaaattcggcggcagtatgaccaaatcgttaaatacaccacagcgctacgcctagctacggcggagaccgaggccatattaagacggtttaccaaaaaaaatttacagcatccaacgtacaaggcgctggctgaattgggcaaagcggtcaaaactgtttttctttgccgttacttgcactccgaagaattacgccgggaaattaacgccggattgaatgttatcgaacaatggaatggagcaacagattttgtattcttcgcccggcgcggagaaatgtcaagcaaccgcaaagaagatcatgaaatcagcatgttgtcgttacatcttatccaaaattgcatggtatacatcaatacgctgatgattcaaaaaatactggctcaaccgcattggcaaggtcgaatgacgccgcgggactatgctgcgttaacgccattgatttgggagcatgttaatccgtatggacgatttgacttggatatgactgcacgacttcctttgtaggaagttttcgacaaaccatagattcataactcaatgaatattaagtaaaactcagcgaaatggcggctagtgacacaactgttgggtttacccctgattgggcgttgtccgggcaaccatgccgtacatgaaattgcttctgtccccattaacttcaccaatcactggagccagattaaacaaatcagcttccattactcggaaaactggatctgtcttggtacaattttctctgccccctttttgccagcattggtgctgatgccctattacccaagctggaacaatatgctcccactcaatacgtgctgcacggtcagcatttttacgtggtacgtatccacatgactccagatctaccctgccccctgatttgcctgcccattcccatttgcagccacaatacagcgttccatgatcggagaggttctggtcgtgatagatgtgctgacgcgcctggacttttgcttctccgaaatattgtggagctgcgtaggcagaaaaataaaaaaagatacccagaacagtaaagcagacaaacagtaacttcccccaggtattctctgttttcatcatttttttggtgcccgtttcaattatttttctctccctgataacggcagaagcgcatctttattctattttaagtatggggtgattttgcccagctactaccagtggagaaatccagcgataagaaaatctgcgcttggatatttttggtccaatccagtaaccatgccaatgcccgcgccgtaaatgggtgcgaactttttttccagttggttcatcgctattattctccgccaaccttaactgctctcctatcattgtccctacgctccaaaattgtgacttttctgctggaaacaaacgccaaccctttttggttttcacaggaacaggatgcgatggtatcgtgccaggcacacgattattatctacctctggtgaatcggagcagagatacagtagtaccgatatgatcgggtttatttcttctgaaatcgctttcgtaagctctactggcaaatcagcctgtttctttgcttccgagatcattttttccacggattcgtaaattgtccagtttccgaggtgtaatggaattggtattaagccgcttttgcaatccagcaagaatctcagttcagtgcgctttgcttttttgtcccactccaggtgtgcccagaacccaaaaagagattctcccatccattgtgattctggtatttcaatgtagatgctccattcagggagccggtaaaaaacttcagaaggtaagatactcgaaatcggactagcgataagcgcggtaaataaatcctcatttatctgatatatgccttggctgtatcgccatgtgccgatcgcagcaagcttggcagcgttgcttacctgctctataagagcattatgaggatactgttcaaattctatttccagccaatcattcagtgataaaaaacaccagtttggcagctccctctggctgcggaatttatttacgagcgtagtcagatccggatacatgcggctaactacatgtagatgtttaatagcacgatgatgcgtgttattcggtagcattatttattttaggaaaccgggtaagcaaagcattcaattgtgtttgtgttgcctcaagctgtccagccaatcctgctgctcgttctctggcttctgctgcctgtctgattgcgttatcccgctcatcttggattctagccatccgctctgcaagtcggaatgattcagctgctacctgcttcctctgttcttggtgagcgtgttccatgctttcaatttttccgatagcctgctgattctctgtgcgtagccggtcaatatcctggtgcgccctgtccagctctgcacgaagatcagtggcacgacgctcgacttcagtaatcctggcttctgccttatccgatctgcttatagaatcagccagttctaatgtctgcttttcattcaatacttttgctttctcaagttcatcgtttgcacgctctatagcttcagcctgtttatcaaatgcctccgatagttgttctgatagctcgataagatcggttctttcggcttcaaacgttgctcgtgcagcttccaggctgttatttaccagctgtaatgcagttgcccacagactctgccccatttcctgcaataccacctgtaaatcagctggtattggctctctaatggtttgtatctgtttacgttgcagttgccgccattctttcatgacttccgcaacggtgttcatgccagcccggctcagttggcgtacatcctcaatacgtggatattccccatctttgctcgctgcatacagttcgtctgctgccgtaaagatgcgctcttttatttcctgattaattgtcatggttgaaggtttttataataatagtagtaatattactactattattattacttttctacttaaaagaagatttggggcaggaatctgtttgttcacgaatagtgcccaatgcttaggcgatggatcaaagccttagtatcaaacagaaaatacagtttaatctgaatcttacccacagaatttgtggataagtgtccggatggattacaccagaacactggaacagttgcgcgccgcctttgctaaggaaagcatcccctcggaatttttgtcacattattagcctaataaaccctttgtgtgtcttagacagagtgacgggttaagtgacaatttttgacggttataaatttcttattcatactgtcacataatcgaacgtatatgtgacaggtgaaaaatgctgattggctacatgcgagtatcgaaggcagatggatctcaagctacggatttgcagcacgatgcactgatcgctgctggggtcgatccgtcccatctgtatgaagatcaggcttcaggcaaacgtgaggatcgtcctggtctggcaaactgcctgaaagcattaaggagtggcgacacactgcttatctggaaactggataggcttgggcgagatctgcgccatctgatcaataccgtacacgaccttaccacacgcggtattggcctcaaggtgctaagcggacacggtgcagccatcgacaccacgactgctgccggcaaactggtttttgggatatttgcagcgctggccgaattcgagcgggaactgattgcggaacgcaccaaagccggcctggcttcagcccgggcacgcggcagaaaaggcgggcgccctttcaagatgactgctgccaagttgcgtttggcattggctgcaatgggtcagccagaaaccaaggtgagtgatttgtgccaggaacttggtatcacacgacaaacgctgtataggcatctttcaccaaaaggtgagctgcgcgaggatggaaaaagattgctatccgggcaatagatcggtgaaagtgctgtttaaagaaagtaaagaaagagagaaaatagccgttaatgccatttaataaacatgatcgcatggtcgtatctatttattaaattgtctgcttaactattaacttatttaaatacatcaatttaactaaaattaaatagtaccaactccaagattattggacaaaatgtcttatatattgcgttagatgcgtggttagcgcgccgaccacgagcacatctctatctatggcgtattaactaaggagcacggtatggcacgacgagacaggagcgaccagacagttggcgcacatgaaaagaagcatgatctcccccccggaaccatccgcaaccctgagggcttatcccgaactcaggttaagcacgaattaacgcatggatagtgggtgccctgtccatggtggcaagataatatcttttgtaatcattacgttgaatgtatagcctggcctgacttccagtgttggctggatgttcatgtttctttgagccattctcataccgatctgccccatttgttgcccaagagccccagcaactatttgctggctgctatatgaattgttgtttgttgattttggctgggataactgtatgccagcggtgaatacagacaacagaattccgtgtccgaatagccgccagtaatgattattgacctgatcgttaaaaccggcatagccagcaacatcactacctggcattctatccagagaaattgaagatccatccggataaataatccgctcccaaccaactaacgctctttcctgtcccaacgttacattactgtcatagatcccaactaaacgcgcacctgccggaatcaggagagtatttccagttgcactgtcataaacattttctcggacttgagcgatgatttgaccaggcaagtcgctattcaaaccggagatcattactcctggaatgattgtgccagccttaacttctcttgacgctgcaacggcagccctgcgttgatgctgcaaataagttattgcttccggtgtattggataaaaatgcctgtttctcaagctgtcggttatctgaggccatgcttgtattaattattccagaattactgcccagaccccctattcccgcattcaagccatacaatgaatcatctgtttcgttctcatttatgccgttattggctattacctgcttctcagccattgcagcgttatttatagccgtacgtatcggagccagcggatcattattcgctatattcgtagtgtcattccgggttgatctcacagaaaagttctgtgcctggctttctgaactaagtgcagattccagttgtgccagctttcgttcttcgatgcgctgaatagtgcgccgcctattttccgattcttccagctctgattgaagtggagatggcgtgtttgtaccttctgtcggaattcctgtgcttcccatctcaatgggcagaggctcagggggtgaataatcaccaggctttactggagggagagagatctctgtaacaggaggttgtgggccttcagctactttactcatattttgattctgacgatcatagaatgtgtaaacaatacccaatacagatattgaaacaattccaccgacaataaatagtggcaggcgattcattcgtcgcacacccttgccccgtgttggtgttgccagataatcaggagactcaacaggcgttgtatcaggtgatggctgctcaaatgaattattgttcactcagtcctcacagtgaatggatgttcagtaatcaacgacccggccgtatcacgcggataataacgagaggcttcattttgctcgtattgtaagcgcaatacgattccattcctgaaagggaatgccaggtagcgcagagcggtgcctttctcctctgtctgggcagaatcggtcttggcttttatttctgtcaccccgtagccatgtacccgtaatttctctattaatagaggggttaatacatccgcttgcccctgtttttgagacggagcttcaagtatcaatgttgtactggcaggagggagtggtttttcaaggtaagaaatgatgtcatttgttagtatttctgcatcaacctgtgtaatttccttggccacaaatgatgtcgtgccagatgtggcacaagcagttataaccagagatattattaacagcataaagatacgcaaattcatttgctgccctctttacggataatttcgactttggtttgtgacaatccgacaccaacaataagagccgcgcgatccagtaccttgtctactacatagcgatccccaatcagacggtagttaaccagctcttcatcgccagaattaccgagtgacagtaatgcaggagattcgttgaaatgtgttgacggaaactggatataagttttaatgccatccgtataaatacgaacgggcttccatgatggattgtcaccactcaggttatagttaaaatcaagggcagcaagattctggccggtcgcaggcattgtgttcgtttgaacaacctgtgttttacgcagatgataagcagcccactctctttgaatatcatcggggtaatcaaaagatagtattggcatccagtcattttttgtactggctaacttgatcgtataggtgtaatagctcgcgtttgaaactggctctgctcgcatttgacgcattttctggctcacaataactgcaaatgaaaagctgttcatgctcacgctatctgcaaatgagctcgcatttatcagcttcggcttgcatttcatcgtgacgtgctcacgttaagtgaaaatgaactttgtctctacgatcgtattgggcgtcttgtttgggtatacccgaatgggacgccgtgatgagacgtttttcgtgtctcaatagggttgttttgctgtttccggcatgctattgtttaaggctctaaaggctaacgagacaaattctcctctatggcgctctacggatatgctcgtgtctctaccaacgatcaagactttacgctgcaggagcaagcactacgcgctgctggctgtgaggtaatccgagcagagaaagcgagcggaacaagtcggaccgaccggaccgagcttcaggttttgttggatttcctgcggcgcggagatacgcttgtcgtcacacggatcgaccgccttgcgcgcagtatcaaagatcttcaggacatcgtatatacgctgaagaagcaaggtgtcacgctcaaagcgacagaacaacctattgacacacgcagcgcggcagggaaagctttcctggatatgctgggcgtgttcgcggaatttgaaaccaacctccggcgtgagcgtcagcttgaaggtattgctgccgccaaagcgcgcggtgtctaccgtgggcgcaagccatcgattgaccccgccgaagttcaacgccttcgctccgaggagaggctgggcgcgacggagattgcacgacggcttggcatcggccgtgcctcggtttatcgcgctctggccaacgatggacggtcggcgtaaaacgatcccagtcgattcactgctgcaattgcggcagcggcttgatcgcttgccgcgcaaaagcccggaacgtgccactcagattgcagcagtcgccgggttgtacggcatctctgcaacaaccgtctatcgggcgctgcacgtctttcagaagccccgcgccgcgcatcgtgccgaccatggcaagccccgtttattgccgcaacccgaattggaacgctactgcgaactaatcgcggcactgaagctgcgcaccaccaacaagcaagggcggcacctttccactgggcgggcgatcgaactcatggaagactgcggcgtggaaactgcgcaaggtctggttaaagtacccaaggggctgttacgtcgcccgaccatcaatcgctatttgtccgtgttgcggctcgatcgaccacacttgttacgcgagccgactgccgtgcgcttccaggcagagcatagcaacgactgctggcaattcgatatgtcaccgtccgatctcaagcacatcgacaaaccggattggatcgaccccgccaagggtcagccgaccttgatgttgttcagtgtggtggatgaccgtagcggtgttagctttcaggaataccgttgcgtgtacggcgaggatgccgagtccgcactacgctttctgttcaacgccatggccgccaaagctgataccaccttccaatttcaggggcggccaaagatgatctatctggataatgggccggtggccaaaagccgggtgttccagaatgtcatgcaggcgcttgacattgaatggcaaacgcacactccggccggcaaagatgggacacgcacgacagcgcgttcgaagggtaaggtcgagcgcccatttcgcacggtaaaggaggcgcacgaaacactctaccacttccacaaaccggaaacagagaagcaggccaatgagtggctgatgcgctacctgctgcgctacaacaatcaaaaccatcgttccgagaaacattcccgcctggaagattggttgtccaacctgccgccggatggcttgcgcgacatgtgcacctgggagcagttctgccgctttgcgcgtgaaccggagtgccgtaaggtcggcgttgatgcgcgcatcactattggtggcactgcctacgaactggaaccaaacatggcgggtgaaaccgttattttgctgtggggcttgttcgacgatgaaatgtatgtcgagttcgacggcgagaaatttggcccttatcaccctgtatccggcccgatcccgctgcatcggtaccgtgcattcaagcgtggcaaggccgatgaacgcgccgatcgtatccgagcacttgccgaccagatcggattgccaataagtgctttggccggaaacgatgtgcaactcacgccaccgacggttgaaacgccggtgcctcaccaaccatttgatgccaccgcacacgaataccgattttctaccgccattgcagcaaaactgtctatcgccaatgagttagcgaccccgctggcaaagctgccagccgaagatcgctttttcattgaccatgtgctcgccgagacgctgatgcatagagtggtcctctcacggattagagaatatttccgaaacaaaaaatcaggaggggatcatgcgggttgaagtaatgcaatattacgggctgacccagccgttagatcaaggtggttactatgaaactgagcatcataaacagcttatcaaggatatcaagggcgctattcaggaaggtcggttgattgcggtatgtggtgtcgtcggtagcggcaagaccgtcactttgcggcgcttgcagcaaatcctcaaggaagagaaccgaatcaccgttgctaaatccctgtcggtcgagaagcacagcatcaagctggctacgctgatcaccgcacttttttacgatctggcgcaagacaaactggtgcagatacccaaacaaggcgagcgccgcgagcgcgaattgcaggagctggtgaagaagggcaagcgcccggtggcactattcgtcgatgaagcgcacgacctgaacggaaacacacttactggcctcaagcgcttgatggaagtggtggaagatagtggcggcagactgtctgtgatccttgccggccatccgaagttgcgcaatgacctgcgccggccgaccatggaggaaatcggctatcgtactgatatcttcaccttggacggcatcgccggcagtcagcgtgaatatatacagtggttgctcggtaccagcatcaccaaaactgattcagaggctattttgacggcagaagcgattgacttgctggccaccaaactacggactccgctgcaaatccaattgcacctgacactggcgttggaggctggttatcagatcggagaacagccggtcacggcagcactgatggaatccgtgctatcgcgacagctcgatgacttggagcctacactgatgcgccatggctatcgtcttaaggatatggttgagcagttcgatgccaagccggcagaaatcagggcgctatttagaaatcagcttgatccagcccgcacagcggagttgcgcgactgtatattggcagcgggattgccgatatgaaagctgttatttgcggttaatgtgagtatggccagtttcaaacgcaagccattacaggtaggcgtatcagggaaaacagtgcaattgaagagtcagtttgatagtgacgcgcacatggaatgactactttcgttccattgtttcaatccaaggccaacccgcagcagctcgaagccatcctcgccactgacggcccggtgctcatcatcgcgggccccggctccggcaagaccttcacgctggtcgagcgcatcgcctatctcatcacgcaggaaggcgtcgcgccggagtcgctgtttgtcgtcacctttaccgacaaggccgcgcgcgagctgactacgcgcatttccaaccgactgaccaatctgggcatcaagttcaacctgaacgagatgtacctcggcacctttcactccatctgcctgcggctgctggaggatttccgcgagttcacctggctcaagcgcagcttcacgctgttcgaccagttcgaccaacagtactttctgtaccagcacatcaaggatttccgcgaactgcccgacgcccagctcgttatgggcgacgaccagacgggccgctggatgcagtcggaaaacctgctcaagtgggtcaacaaggtcagagaagaggcgctcgacgccaccacgctgacagcggccccagagctggaaatatgcgccctggccacttgctttgccaagtaccaggaacttctgcacgagcacaactcactggacttctccggcatccagtacgaggcgctgcggctgctggagaagcgccccgaggtgctggcgcagctgcgcgaaaggctcacccacctgatggtggacgagtaccaggataccaacaccatccaggagcgcatcctcctgctgctggcgggcgagaacaagaatctgtgcgtggtgggcgacgacgaccaaggcctgtaccgctttcgaggggcgaccattcgtaacatcttggaatttccgtcgctgtttaccgacgaccagtgcaagcaggtcaagctcaccgtcaactaccgctcgcacccggacatcatccgcttctacaacgagtggatgaaggagcaggtatgggacgacggcacgcgcgtcttccgtttcgccaagcagatcgtgccgtgcgaggacgactttcccgagatgcccacggcggtgcggctggccgccagcaatgacaacggagaaaccaccaactggcacgcagaggtgctggcctttctcaacggcctgaaggcgtccggcaagctggcagactggaatcaggtcgccttcctgttccgctcggtcaagaacgacaaggtggtggcgttggcgcgcttcctcgaagcgcagggagtgcccgtgttctcgccccgttcgaacatgttcttcgagcgcgaggagatccgcctgatgatcggcgcgctcatcttcctgttccctcaattccccaaggtgcgggcgtgggccgaaggcgtcacgctgcccatctgggactactacgatcaccagtgcttcaagcccttcaccgacgagctgcgcaagccggaaaacaagcccttgctggattgggcgcgtccgctggccaagcgccacgccgtgctcgcgcagaacaccgactacgccttctccggcctgttctaccaactattccagttcccgctgttctcgcattttctcaccgaagaagctgcgcaaggcgtggacaaggggcgcgcggcgcgcaatctcggcaccttttccaagctgctgaccaagttcgagtacctgcatttcgtcagcgtgttgaacccttcgttcctggagaagaacatccgcgacttgttcaaccagttcctgcgcttccttcaggacggcggcatcggtgagtacgaggacgaagccgagtacgcgcccaagggctgcatatcgttcctgaccatccaccagtcgaaggggttggagtttccagtggtggtgtgcggctcactggaggcagtgccgcgcaagcagtacagcgcgctcgacgtgctgctggaggatggcggctacctctccaaggaacgcttcgagccgctcgaccacatcaagaacttcgacttctggcgactgttctacacggccttttcgcgtgcgcagaacttgttagtgctcgcggcgcaggagaagcaggggcgtggcaagtcgccgtccaaatatttcgagcgcctgttctacgaactgccgagctggcgtgatgttgatctatcagccctgacctacgaggcggtcaagcagatcaatctcaagcgcgaatactcgttcacctcgcacatcgccgtgttcgaaaactgcgccgagcagtaccgcttcttcaaggaactcgaattcgcgcccatccgcgagagcccgatgctgttcggtacgctggttcaccagaccatcgaggatattcacaagacggtgctgcgcggcgaggaaggcagcatcaccctcgacggcatcaaaggctggttctcagccaactacgcgatgctctcaaagaaggaacgcgtttaccttgctcccagctcgcagcaggcggcgttgttgcatgtgctgcgctacttcgagcgcgagaacggcaactggaatcgcatcaaagaagccgaggtggaaatttcgctggtcaaggatcagtacatcctcaagggcagcgttgacctgattcgcggcgaacacgacacggtcgagatcatcgacttcaagtcggagaagaagcccgacatggagagggatcgggatcgtctgcgccagtatcagagccagttggaggtgtacgcccatctggtggaaaaacgcaccggccagaaggtcagtcggatgcacctgtactacaccggcgaggacggcggcaccccctacgtgtcgttcagcaaggacgaccgagccatcggcaagacaatcgcgcgcttcgacgacatcgtggcgcgcatagagcggcaggactatggcatcgcgacacgcccggcaaagctatgcctgagctgcgacatgcgcgcctactgcgacaacaagaattggaaattcaggaagagcaactgatgaacaataacacccccgcgcaggaaagcctgcaactggccacgcccgcaggcggcgccaccaacgtggagaaatacaagtttgagccgatcaagggctacccgatgctgaactggcgtggcaaacgcccgttcacctcgacgcagtattacccggcgcagttgaaggaagtccacggcgaggaagtagatggctggcgcaacaagattttctggggggacaacctgcaggtgatgagtcacttgctgaagcagttcagagggaagatcgacatggtttacattgatccgccttttgattccaaggctgactatcggaagaaaattcatctgaaggggataacggttgcgggcgacatggccgcattcgaggacaagcagtacggcgacctgtggactaatgatgaatatttgcaattcatgtatgagcgactagttttgcttcgagaattgcttaccgaagagggaagcatttgggttcagtgtgattggcatcgcagtcatcatattcgctgcttgcttgaagagattttcggttcttcaaattttctgaatgaggtcgcttggcagagaaccgatcctcataatgatgcaaagagtcggcttgggatcattcacgacaccatattctgggtagccaagaacaaagaaaaagttttctatgattggcaggcagccgcaggcgatctctctgactccgctctcagtgagtatagtttggtgcttctggatgatggatcagttgttgattactcagaagaaacggaaaatctcggcaggcgcttcaaagtagaaaatacaacgtataagggaaaggactccaagcgacagttcgaatggcgcggtgtcaaaccgtcgccgaatcgtgtttgggcatacgcttccccaaaggaaatggatcaagccttggagcggggggagttgtacctgcgcgatccaagaaaaggatctacccgctgcaaagtatttttccttgagaagagtaatggccgattgctacaatcaatctggacagattgcggtcggatgaagggcggctctgactatccaacccgaaagccagagcagctattggaaagaataattaccgccggatgcccagcgggcggcgttgtcctggacactttcgttggctctggcactactgcggtagctgcacagaagctcggtcggaaatttattgttgccgacatcaatttgggggcagtgcagtcatcaaccaagagactcatcaactctgccgtggagattcttcagcaacctcttaatgaggaagaaagggctttctgggggttcgagattcacaacgtcaacaactacgacatctttcgaaaccctgttcaggccaaggaactcctgatcgaagcactggaaatccagaagctggagttcagcaccgtgtttgacggcgagaaggacgggcgcatggtcaagatcatgcccgtcaatcgcatcgcaacgcgcgccgacctgaacgagttgatcgcggggttcgactacaaggcgtgggagcgcaagcagaacgaaagcccaaaccgaccggtcgagaagatcactctcgtctgcatggggcatgagccaactttgcgggcggaactggaatatgcggccaagcccttcaagatcgacgtggaggtggtggacatcctgcgcgacaaggccgatctggagttcaaacgcgactcgcaggccaaggtgtccatcaagaagggagagctggtcatcgagaagttctacccgatgaacctgctgcagaaactatcgctgcagaaggagtctgtcgaggactggaaggagttggtcgagtcggtgctgatcgactggaactacgacggcgcggtgctgcaacccgcagtgttggatatccccagcaagaacgatctggtgaagggcgcgtacaccgtgccgcaggatgcgggcaccatctacgtcaagatcaccgacctgctctcggaatcgtgggaagggagcgtgagctatggcgaataagcgcacgcccaaggcggtcagcgcgtcgctcgacttcgccttcttccgctttctgtggcggttctaccaagacaaccggggagcgatcaggcagaaccaaaaggaactgacccgcaagttcctcgacttcaacaaccccgagaagaatccaaaagcgttcctgcgccaaccgcagttcgaggcgctggaaacctacgtctttctcaaggagtttctgggcaacgccaaggtcgaagagatctttaaagcgtggtacgagcgcagtggaaagttcgagggccgcaagtttagcttcttcctcgacaacaccgtgcaggagatgatcaagttcgacgaaagcgatgagctggacctgaactcctacaaagtgctgttcgagaagatgcgcaagaactcccgcacctacccgaactacatcttcgcgctgacgatgggtaccggcaaaaccatcctgatggcgacctgcgtcttctacgaattcctgctggccaacaaatttccgaaggacgcgcgctactgccacaacgccctggtgttcgcgccggacaagacggtgctgcagtcgctcaaggagatcgaggccttcgacctgacgcgcgtggtgccgccggagtacgtcaacttcctgaccacgcatctgcacttccactacctcgaagaggcaggcacatcgcttgacaccctggatcgctcgcgcttcaacatcattgtctccaacacgcagaagattattctcaagcgccagcacaaggagaaaacctccgttgacaagctgttcggcgcgaccggcgaaaccctcgccgtcaccggcgtctatgccgacgccgccgacctctacaacttcgatcagccggaagaggaaggcgaactcacgaccaaccagcggttcgagaggctgcgccgtttgaagcagttgggcatctacgtggatgaggcacaccacgccttcggcaaggcgctggccaaggacatgggcgtgggggccaaggcaaccgacaccagtctgcgcaccaccatcgacatcctcgccgccagtctgaacgcggcgggcacgcgcgtggtagcttgctacaactacaccggcacgccctacgtggggcgcgaggtgttgccggaggtggtctacgcttatggcctgaaggaagccatcgacaagggttttctcaagaatgtgacgctgcatggctacgctaacacccgcacagacgagtttatcgacatcgccatcgagagcttcctgaatggatcgggcaacctgcgcccggaaggaatgctgcccaagctggcgtttttcgcggccaccgtggaagagctgaccgaagagctgaagcctgccgtagagcgtgcgctgctcaagcacggcatccccacctcacgcatcctggtcaacgtgggcgacagcaagatcaccaccaacgacgacattcgcgagttcaatcggctcgacaccgaaggctcggagaagcagttcatcttgctggtcaacaagggccgcgaaggttggaactgccgctcattgtttggcgtgggcctattccgcgaacccaagtccaaagtgtttgtcctgcaggccacgatgcgctgtctacgcagcattgggcaagcccagcataccggccacgtcttcctctccgaaggcaacctcagcacgctgaacgacgaactgcagcagaacttccgcatcagcaccgacgagctgcaaaagaccggcaaggacaaagaacgagttgagattcgtgtggttgagccaccgatcaagatcaagctggtgcgcgtacgcaagcagtaccagatgcgcgataagcagttggtgatcgggcaagcgttgatgcctgagcgggcagatgcgcagaagtggggcgagctggtagagaagtaccgcctgatcgaaacgcggcaggacggtttgacgcccgctgacgctgcgcgcgcttccggtagtcgcaccttcgacctgaccgctcgccgcgagaagcgcaccttctcgccgatgacgctggtggccgaggtgtcccgctatctgaaccgaaacccgctggagatcgaggaactgctggccgcgacgaaagaaggctccgatgagctggtggctatcactaacgagttcaacgaactgctgtacgacgaaatcattcctcgcctgttccaccagctctacgacctcgacgagtcgcagcaaaccgaggagcacgaggtcgatctgatcaagctgcccacgaacggctactacgaggtatcagcggcgaaggataagatcgtccggatgcacgacgcgcagatcaaggatgacgagcgcgccaagagcttccacctcgacacctactgcttcgactccggctcggagaactggctgttctgggatctgttgcgcgagcagcgtgtgaaaaagatctacttcactggaatgctgactcacggccagtccgatttcttcatccagtacatcgacccggattcacgcaccgtgcgcagctactaccctgattttatcttccagcgcgaagagatggatggcagcctgaagtacgtgatcgtcgaggtgaaagccgacaatcagatcgaagatgccgtggtgcaggccaagaaggactttgcccagcagatcgcagtggccagcgggatggagtaccgcgtcctcaaatcatctgatgccgataaaagaaattatcgtgtgttgatgtaagtttttgatataaatgagtgaataattattttcagcaactcacaatcaacgcaaagttcattttcacttagcgtgagcacgtcacgatggaatgcaagccgaagctgataaatgcgagctcatttacagatagcgtgagcatgaacagcttttcagttgcagttattgtgagcagaaaaacacgtcgattgcgagcatggccagtttcaaacgcaagctattacatataggtgcgtctgtccgtagtaacaatcagatttgttgtcaggttaatatctgtgggtttaataataatgatggttgatgctgtctgccctgaaccttcggtagccggtgtgattttccagcgtactgcgtcgccagcatggacatcattgacgatttcaccttgctgcaaacgtatagagcatacctgtaatggggtgcagacaagagttggaagggttgcaccaaaaagatatttaacgtttccatcctcgccgcgacgcggcttgtcagggtttgttttccattggttagcaagctttgctccgtacacttcctttgaatccagtcgtggtttttgtcctgcaaatattggtaatggctcattctggctttgagatgtttgtgcatatgcgggaatagttaatacaaaagcagccatgcctatgatcaattgttgttttttcatgtgtccctcagtatcagaaattgctattaatacgagccgaccatgagcattgctgcgcataaattccgagtggattaaccataatctgctcttcatttatcggcggtgacagtaccgtggtaactgacgcctgatattgcctggtatcaaccagttttccagatcgttgttttgttacttcagtccattcaatctgccaggtagaatccgtaatcggaaccacagcattcactgcgatttcaactgtttcattggccgctcgctgataagggtttttctcgcggtgatatgtggcaatcgtctgataacatgcgctatccgggtaagtcatcgcataggttgtatcaatcaatgctttttgtgcgctttgatctgtataaacagttcgtgcacctataacccaatttcgtagcgctgcaatcatttgtctgtcattgggtgcactggcaaccgtagtgcgtgctattttcgtgacctctccattgccatcaaattcgacggcatacggcacgatcttgtgttgcgcagagatatacaccaatccactgacagcaatgatcgatacggcgatactgccaagagctgccaggcgccaattatttgcccttgatatataacttccataacgctcgttccattctctgcgagcagccagatagggagtatctgacgattgtgtttttattttcttgtcatcgttgttcatctcaataccttgttttgtacactatagtatacatactagactaaaatgccagtatcatcaatatcgttcgagacaaggagaaaatgttttggtgaatcttacagaactggatgattacaaatctggttttgtctgcttatctgactgattttgttgaggaggagtattgctcgggacagtagtctcgcctgccagtatgatgttggaatcaccggcacccatgttcttatttggtgccatatcctgatttttatcttcatcttccccataatctggaggtggaacgttcagggataaattcatggctggttccataccagggacagatattgcagccataataccggtagatttcaccgcgctatcagcaaattgcgttaaaggagaaaccggacttttgttatcaccctgtgattgaccccctgtagggggtgttcccaatgtcgttggtttgccagtttgtcctcctcctgtacgctgtggaggcagcgtgttattcatgggagatcttgaattgctatcacccgagttgccataagcatttatattttcacgcatattgctaccggtggatgaactgcctcccataagagaggaactaatcatatctgctaatccatcacttcctgacccgttgctcccaatcccggttcctgacttaccaaatatgccgttggttgctgccgccgaaatacctgatgcaacaccggccgaaatagcagcggccatgaaaccaagagcgtgaccgccagtcggagaagatcctgtaatcattcctgctaccagttctggaatggtttttgagaggtaggcgcacgccaatcctaatccaaccatcgtcagcatgtcagcattgtcattgtggaaactggctttccagtcattaaccgaactcataatcaatccgacgatcagtgtcagaataaacagctttgctcctacagcgatggcgtatctggtgatggctaacgcgtactcgcgcgtccactgtgaccccccaaatcccataaataaaacagaagcattaataacgatatatgattcaattaatgtcaacgccatgaatgcagcgataaatccaaaacaaagtactacaattactccggatagcgttacaaacactgctgtcaaaggatttaacgtatgaacatgcaatatggtatcgcccagttcaacagctattccgaacatatcgccaggaaaaatcgtttttccaaaacctgaagcattacctccagcctcacggaaactgttaataattgcttgtccccaactggttgaaaatttgagtaatgcaaagaaaaaaccagttactaaaacaaacctgactaattctccgacgatctctccaaaatctgcctgtttgaaaactaacggtaaaaacgtccagatgagttgaatgacagctaagctccagaaaagggttatggcatagtcccgtaattttccatcccagtatgatgcgctgttttgtattaatcccagcaagtctttaaatgaaccggttgcatcgtgaagatcagcggcaatcgcagtacctggcgcaataaaaaagacagttgcaaccaacccgaaaaggcaaaatatttgcctacgatctagcgtttcaatattccttctcctcggagctatgtatcctgctgctacgttgtcaaaatcctgcgtctttagagttgcgtattctgccatcctgtaaaagtggctttctctcagtagtttcaaggtcaaccttggctgctgagcactctggattcgcaatagttacgctaggcgcagaaataaccattgtgatcgtcgcataatatgttgctataccgccaatcgcagcagacaaaatactgactacccatatattttttagaaaatccatatcaaaatcctgtgtctttagagttgcgtattctgcttcttctcatttcttctgctaacgcatcatccatggcttgtcgctcggtttgagttgccatgtagttagcttgcaatgtaatctgactggaaaacatatctcttagtcgcgtgagttgctgcacatttaaagctgctatttcgttcccggcctgcaatgcttgtagacggccagacgcagagctggatcgtgaaagcatggtatcgagcatatcgttatctgatgaaatactttccacgttgaaaccggctgatttcatggcagctcgtatgttctccataccgtaatctgaccattgccgataacgcccacccatgtctaccgttccatttccgatagtcctgagataattctcatatccactgaattgcctcataaatctttcatcaaaattttgtacatcccgaccaagcattctcgcattctgataaacaccaaccactctttgcagattggaagtaacattctggaacatcctgccaggcaaggatatagcttgctgaagtgaatcctgtaactgccttgccgtatttatttgggtgttaatcagttcaagtttttccagtgcctgtgtccaccagttgctacagttagaacaaaatacggtcagagctggtgcaggccgactatagaaaagagcagcaccaaacaaggttgatgcggccaatacgagcagcccactttttattgttttagtgaccgatatagcgttcataatctattcccttatgttttagaaaagacaacggccagccgttagcgtacctatcaatgaaatatcttatttccgccagtttgtccttatctgatacagccagaaaagcgagtgccagtgggccaagtcccaattcaaacaggcggcgtccaagcggtgatttatagtaatagtcccgtttgtattggccatttttaagtatttctatttcccgcttatttaatccaaacatggtgtacaaatcagctggccctggtgtttctttggtgccgtactgatccgcttctttgttgggtaacagtatttttgttggacattgttctgttagaacgtccagtaatccagatctgaccgcatcagataaggattgtgtagccaggacgactgagcaattttgttttcgcaatgttttgagccattcacgtactttttctcgccatactggatcaccaagcatcgcccaggcttcgtccaaggccaatagaaccggctggccatgcatggttttttcaatccggcgaaacagatacaggagaacgggaagtgcattagcccttcccattgacattaattccttaacctcgaatgtggtgaactgagccagctccatagaatcttcagcaccatcaagcaaatgacccatcggaccttttaaggtgtaatgtgaaagtgcgtcctgtatatcgttatcttgtacctgagcaacaaaatctgtcagtgatcttccgtgcattggcgcggcacgcagcaagccaattgctcgatgaatttctgttttctgctgaggtgtggggggtttaagagcttgtaattcataacaggttgcaatccactcttccgcccacaatgctcctgccggactatcaatatcggccaatggcatgacagctcctatttcttcactgtcgttgccaatatcataatgtattccctgtgcagctttacaaagcgtatacagactgtacccataatcaaatacaagtacgctggcaggtagtttagatccatccatgcctggtttgctttggtagcggctaaattgcgctgctatcaaagcaagtagagtggatttaccagctccagttggaccaaatataagcgtatgtccgacatcgccaacgtgtaaattgagcctgaacggagtagcgcctgttgttactgtctgcatcagcggaggcgatccggccggaaaaaaatcacatggattttgtttaagtcccggccagatacttgcaagaggcaaaagatctgacaaattaagcgtatgtatcagcgggcgacggatattcggataggtttggcccggcaggctgcccagccatgcttctaatgcatttactgtttctattctggccgaaaatccgatgtaatcaatttgcctctttacgtaatctgcctgtttctcaagatgtattcgatcttcatgcatgagtacaataaccggcgtgtagtagccgtaagatacaagcccggaatgggcatcgttgatcgcggattctgtctgtgttgccatatccagtgcatcagtattaatcacgcccttctgtgacttaaatacctgtgaccagaatccccttatcttctgacgccacttgagacgatatcggttaagagaaaatatggcctgatgcttctccagaaatatgaaccgtgatgaccagcggtaagctagaggtaatccatccaggagattcaagattccgggttcgcttgcagaaggaaacccatcaattgcgacgcaggcaatgaatttattgcctaatttcggagtatcacccggccagagttcctggtaaccaagccaggcatccaaatacattgggcaatctggtatccgtaacgctatttcttcaccggttatcgcaaaatgcaagtagttcaccagttcatcgctttggtacgtacttccttccacattgatagttaccgtcctcattcgacgcatgtttatgagatcggcgagcccttgttccaaggtgattagtgttttcttgaagtcatcaatcaaccgttgcgccggagaattatcgttaaggctgtcatcatcgtaaattagctcactgagcctggaattatgacgcaagggtgggaggtactgaaatatggccgtgtactcattctcaaaatacatgctgttctgttcaaacatttcacgtcgttcagcatcaatcaatgctgtaaccgggtcgggaaaatgtgaatttcccggtgacggataattcggtgaaggtagacgtgtattatcaatccacacagcccacccgcttccgaagcggagaagataattgttaacgattgctgtcagatagttgctgtcagaagcagttgatgatgctgcgtcatcaccacggaaataaaaaccggccattaatgaaccgtctttacctaaaactattccctcatcaattaaagctgcgtaattgagtaaatctggcaatccagcagcttcatcacggaaagatttaagagcaagcatttgttcaatctcaatcagtagtttcttgaagacttggaaacacgagaatattttgaaaaaggcccgtaataaacaccataacgaagctgccgtaagtagatcttcgacatctccgggtcggcttttgccatgcgccgcagcccatagatacaaagcgtccaaacgaataacccgattgcagttgccacccaattcatcgcagtaatgacaagagtgcctgctataagcatagaaaagagcattaactcgcgctctccgcccataatctgctgagggcgatgtagagcacgatgaaatgctgttttgcgctttttatctacagattgagccatttttatttttctgaaatagctgaagctggattaccaaaggcagttaagtctgctgccatgatatgcgcgtcagctggaacaacagcgccagagaacagcgtaccggtcagtaatgtgttggcaaatacgatgacgcaaaccaccaggacaacataaataattctccttataaattctgatacttctccaccccatataagggttgctccacaggcaataatgcctaaaagagcaaccccgaaagcaactgggccagaaaaagatcgagaaattttctgtattgggccttcccacggtaacccagctccacctcctgctgttgcatcagctgcatacgctgaatcaataacaccaaagaaaagagcaaaaatcaccacaaccaaccagaacgacgggcttttaaaaagattatggaggtacagaaatagtggagatgttgctactgtcgctgagttcatggagatcccttacattggtttaattaaataattctggccgtcatatccgttcacccggataatttcacgaacaatacgcccagccggatgcatactgtccttggcaacaaaaataatgacattaattgctgccgctatcaggcgttgtttgggcgatgtatttgcttctgctaccagttcctcaatacgtaacagtccctcggttgcgctgtttgcgtgtaccgtcgcaatccctccaggatgtcctgtgttccaggctttgagtaaagccagagctgcgccatcgcgcacctcccctatgagaatacggttagggcgcaatcgcatggttgacttgagtaatctggtcatgtccacatgatccaccgttctcataatcactacattttctgctgtacattgcagctcaccagtatcctctatgattactatccgatcctgattcgcttcaacagccatgtagtcaataatggcattcgtgagggttgttttccctgtgcccgttccgccgaccacaagaatattaagatgatctttaaccgaatctttaatcactttgctttgatgcaaagtcattattccacttgaaacgtagtcctccagggtaaagacctggattgcctttttcctgatagtaaatactggcgctgaaactacaggagggatcaatgcctcgaatcgagatccatcgaaaggtaattcgcattcaagaatcgggttactggcagtaatctgtgttttaagcgtggatgcaaccgtacccatcaggctttcggcctggatcgctgacatctctccaacgacctccattggccttcctaaacgctccacccacaaacggccatctggattaagcataatctcaatcacggtcttatcttccaacagagcacatacaaccgatccaagctcacgccttatcttttctgaaatgcgacgatcgtattctatgtgtaatgcatttgacccgttcatcttgaataatgagttatattaagttacatattgtgcaatatagtgtacactcagtattatattaaataacgtatgaaatgcaagtggaatatgctatttacttatcgtcggaggtaattggtgttaataatttccaaagtggcactttaacggcattggctaatacttccatcttgtccacgctaattgaaacctttccacactccactttactgatatatccacgcatgactcctgtaattcttgtgatatcacattgtgttaattcagccgccctcctcgcatggcgaaagtttcgaccgaaaatgaagcgtgcttcaggtgaaatttcctctgtatctcttgatttattcatcaatcaattttatgtcatttggttatttttttaaaaaaatactactgtggatgcaatggatacagtagtttcagtggacactaaaatggctgtgaatgatactaatgaactggtagcacgtgttatggttgctctagagaaaaattccatgaaaagaaatgaagagaaaacaaaaaaagacctatctgatcagataagcaagatacaacgtaacgcttatctgagtagtaagggtatcaaaccgaatactaaaactcagcttgatctggtctttcccgacacaataggcgcccaaaaggatatgcgacatatcccaaacgattacgcacgttcgtcaatcttcacagctcgcaataagcgtgaacctcgcaaaatgcttatgcacgaaaaactgtttcattacaacgaacacatatctattctctacaccggtattgaactgcgtgccgaggacgatgaaatcgtttggctgcaaatcctcaaatatggcgaaagtgtgcccctaggtgaaccatttgagttcagcattaaagatctggttcgtgatatgggctggccaaaaaatgggcgcaattacgatcgcgcccgcgaatgtatttcacgattgaaagctaacgaagtattagctcttaatacaaaagcttacggtaaaagcgaagcaatatcgctaattcagaactacactgcaattaacgataacgagtgcaagccgacacaatatcgtgtgtggattgatcccaacttaatcgtgctatttgcaggcaacaccttcactaatcacgtatggaaagtgtaccgtgatctttctcccgttgcccgtcgcctagcagactacattggaagtcaccaacacccatatccattaaacgccgaaaaatttcgccaaatgtgcggatcaacggataagaacgcgcgaagctggcgtcaatccgtaaaaaaagcctgtgctgaagtacaagaagccaaaattgctacccttgtcacacttgatagcaacgatcaaatttgttgcgtccgcgagtaagccaacatcgtattgagtacaaaataaatcaggggtgcgcaaaggcgtttgcgcatcttcagagttcaaaaccatgctctcgaccagtcaaagagagacttatccacaggtcaatggcaacctgtgacggatgacctgcaccatgtgacggatgacctacgccatttttacaaagtgcaggtcatccgtcacaaaatgtacggtatttgctacggttataggcttgttaatgaattagaaaacttctcagtgctaagttatccacaattttgaatcactctgcccgttaaaggtgcaaatgcgtgacggatgacctgcatctagtacctgaaacttacctttagcgtgacggatgacctgcaaaagcgtgacggatgacatgcaaaagcgtgacggatgacctgcaagacatttttctaagtaattgatattaaattaaaaaaacagatattttttgcagcactaaccctatctttaaccttttctttaaccaaagagcccaaaaaaatacctaaaaaaaacaaaaatagcaccaaaagaaaaacaaaagcaggaaagcacatgaagggtttaaacagctttattaaaaaccgatcaaacctcattcataatctttggttacattcccacaaaatcacaccatcaactacactcttcacggtctcataatcataggcatttaacagtgaaatcaaaccatcgttgatcaatcttgttgcttcctctgtatcagaagatattagtagattgtaggtatgacagtttttatctttccagacttgcggataggttttaactacatattttcgttctgcaagaatttcagcaacaaaaggagatggatcttcacgactccaatcaacacgtctcagggtatggagactacccaacaacgccaatataggcgtcccctttgtctggttttcaagaaccattgccatccactcatcacgtggactgtttgtttttaaatcagcatctatagcaagcaatttcaggcatttaccacttcttttcatttcggccagatcatgaatcattacccgataggctggatgatcaatcattggcgggatagcaacactggatatatccgcttttccttcaaacacctggtcaagaatcgtttgctggctgctggctatttcgagagcaacaaccagacattttctctgttgtagatattcatctatcacggttttgaaaaactggatagattctggccgtttgtgattttcaccgatgatcgttatggtgccctgctctatttcactcgtaatcagactttgtacttcgcttgctactgctatctgcggcagaagcacggcagataacaaccacccacagaaaatctttttaaggattgtaaagttcatcaagattcctgaatttttcaaactgaaattaatttttgttattatatgttattacattagttataactttgggggtgatatgattgaattgaaagtcagaaaatttggtaattctcttggtgttgttttgccaaaagaagtggttaatcacttacgtaccggggatgggcagcgcttattcttaaccgaggcatctgatggaaggtatcttattacgccatacgatccttcatttggtgaaaaaatggcaaaggtagaagatatatgtaaccgataccgtaatacactgcgtgcattggcgaagtgacagcacctgtctggataactgagcaggatgcacttgccatccatgagcgcttaatttctctgcatggtggtgcatcgggcattcgcgacaggaatcttctaaaatcagcacttgcaagaccactcaatttttttgcctacgatcagcaacctgatattttcctcttggccgctacttacacaggtgggattctgcaaaatcatccttttgtggatgggaacaaacggacaggatttgtaattggcgtgctgttcctcgaactcaacggctacaggtttatcgccagtgaggaagattcaacacaagctgtattgtcccttgctgaaggctctcttgatgagttcgggtttaggttgttcattggagataattcaattgcaccgtaactgagatgaaaaacaacaccagaaacaataaattaaacgaggaattctatcaccggggtttacataaaagagagtcagcgacctgttgcgaaacgcttctcctgtaacagggaagattgatccagagcgacagcttgggtagtaagcttcggtaacccgttcacaatcgcctggcttttcaggctaacggtgataacacgcagaaagagttcaagcgggtatctggcgttattcatcgtttcgatagcccaatcattggcatcgttggtaatcccactggctgtatcaattttgacacactgacgctccatcacccattcaagcgcaggtttaccgttgatcacatagtcataagcttcttccgggatgttttcaatgacaatattcgtgttgtagataactgttgttttgtcatcaatgctcttacctgtttcaggatctctctttttaccgaacttcatttttgtgacatagaaatctttatcctctccaccaagaatcttttgttcggttactctcaaatatttcaaactcccaacaaggcgaacacctgtgtgcatgggaatagtttcataattcagatgtaaatctgccaagtcacgccctgcctgactgaaagctttaaaatcagcagctgtttttacacgtggaatacgtggcaattgtttactgagattatcagcatagcgttcgcggtaatcttcactgtgaagcaaaccataaatatagtagaagatagcttccttgctgatcttgatttgcggataagccgcctggaaatgttctaaagcatcattggtgatagcatcacgctgctggtattgtggttcaccttcttcattgaatggagaagcatctgatgttgttttctcgtatagataaagcgggaagcactgtcctttagaaatcatttcaaggtcaggaataatatttgttattagcgaggaaaattcttttgtcgatcctctaccagtaacagaaatcaccagattttcactgtctttggttgggaagatcttgtgtatttgataaacaccgctattgaaatgcctatcaaaaaacatccagctcttggtgaaaggtcggtataaggcctttcttagaccttctggattataagtgcggcaggtttgacgtgccagatcctgctttaattcaagtgtccaactaatagtcttggtattgaaatcaagaaacctttcaacatcaggccagttttcttttgttataccctggcagaggtttttgtattcttctactgatttattgaagtaggcaaccatcgcttcagtagtgttcttaacgcgattaagtgatgcgttatatacccacgcgtctctaccagttgcaactcctctcgagtagttttcaaaaattaccttttctgttttgtccttcttgtctcccagactaatataggtatcaaaattcggatcacgttgattcaaccagtcaccaaattgatctggtacgatctgttgccagcacttctgtttagtaataccgttgatactctcgaaacctgtaataacttccagcttctgttcacgggtcaggtagtcaccgatatcatgaaagtagatattgcctcgcaccttggcttcgggctttttaaccaggatggaaatggcaatcggagcacggctaccagaaccgaagatttttccaccttctttacgtgatcgttcgccggatgtgcgttgattgccacgtaaatggaaaatatacaaattactgaactcttccaccaggcactggcgcaaaccatcacctacgtttgcctccaagaaaccggcattggtaacaaaaccaatcaccccccgatctttgatacggtcagacgaccaacgaatagcacgaatatagctgtcataaagtgcgtttttatttgtcgcttgcgaacgcacggtataggtactgcgaatgcgttcatcgagctttggatagtccacattggcgttgttatcgttggcagacttttgtcccgccgagtaaggcgggttgccaagaatcacacgaatatccagattttgctgacgttttcgacgattgctgttttttttcagcaattcatcgaactgatcttccttttctgccatctggaaggtgtcggttaagcatattcctttaaacggctggtattcaatatatggtttatcaactatcagatcattgtcttgctcaccgtggatattgcccaccagaataccgtgataggtggcttcaatattgatggcagcaatgtagtaggcgagcagtacaatttcgttggcgtggatctcgtgctgatatttgtagggcaatcgctcttcagggatgatgccgctttgcagcaggcgggtaatgaacgttcccgtccccgtaaacggatccagaatatgaacattatcatcagccatgctggagttgaattctgttttcagcacgtgttcaaccgaatggaggatgaaatccactacctctaccggcgtatagacaattcccagccgttcagtcattctgggaaaagcgttacggaaaaatttatcgtacaactccactacgatgcgctgcttgccttcagcactatttacatccctggcacgcattttgacggattcataaaaatcttccagcgtatcccgctctttgtccaggtggtgttcctgtaactgatttagcacctgctgcatcgcctgcgacatgggattgtgtcgagcaaaactgtattgttcaaacagggcatcaaataccggctgagtgatcagatgctgtgccagcatttcgatgatttcttcatcgctgatgctgttattgagatcatcgcgcagctctttggcaaaggcttgaaaggcagcaatttccgtggtgtgggaggtatcttccagaatggccttgatgcggtcaatgtgggtgttggcaattctggcaatatcattggcccaatcttcccaatgatgccgattgccacattttttgacgattttggcatagagcgcgcgttcaatttcaccaaccttatagctgatttcagattgatgaagaattggagattcagctgtgccgatagcctcacctctacgtgcaactccagcattacgctgtgttttatcctgctttcttgcccttgccctcggtgcaacgttgtcagctactgccaccacttccattttggtgggcatgctgccattgaattccagtttattgatcatggcatcaaagcgatcgtcatgcgctctgagtgcatttaatacttgccagactactctgtaggtttcgttgttgttcagagcttctgccggttctactccagcaggaatgacaactggcaaaattacgtagcccagttgcttcccaggtgccaggcgcatgacacggccaactgattgcacaacatctatttgagaagagcggggtgtcagaaacaacaccgcatccagcgaaggcacatctaccccttcggacaggcagcgcacgttggagagaatgcggcaggtgttgtcatccgtctctgccttcagccattccagatggctttccttttcaccggcgttcatgctgccatctacgtgctgcgcttcacacttcatggacagggcaggatccagcacggcattggtattttgttcctgcaaggctttcttttctgcttcctggtactggctcaccactgcaccaaacatttctgaaatcagcttcgagctgactttgtgtttgttgcctctgtattcctgttcaataatctggcaaaaggccaccgcacttttcatgggccgagcaagtagctcattacctgcaaacagtccttgcttggatagcgctttccagcaacccacgatcttggccgcatcatccacttttaacgaattaccctgattgcttaacaggccctgcaagcggcgattgatgtggctttcttcgatagccagcacaattactttgtaatccaccagcaacttgcgtgagaccgcttcagaaaaggtgatgatgtagagttctttaccgtacagtgcttcgttatccatcgagcataaggtaacgttctcagtctgcttggcggcatcaccgtaaatacgcggagtggctgtcatatacagccgtttattcccctggatgtaacggttgtcatggattctgacgaaaggggattcttcttctccgtcaaacgtggcaccggtggtacggtgcgcttcatcacagataatcagatcaaaggcaggcagggggtgcccttctgcttgttgcgcttcgtgaatgacaccaatggagtgataggtggaaaacaccaccgtcatggcatcatctgaatgcaacttggcaatttgtttgcgcaaagattcagcgtcagtggtggccggatattgcagctcgctgataccggtgacgattcggtcatctgtgcctgtcttaccaacatcactatcggagcagactgcaaagcttttcagcggaatggccgattcctgggtccattcggtcaacgcttgggagagcagcgcaaggctgggcacaagaaacaagactcgttttcccgctccagccattttttcggcaatcttgagagaggtaaaggttttaccggtgccacaagccatgatcatcttgccgcgatcggcttctttgaaaccctcaaccacccgtttcagagctatttcttgatgatctcgaagctgtttcttagatttgactaccagatacccggatttttcatggtatcgcgaccagtcgatagcactgttttctagattctgccgattaattacaaataccggaggattttggggtcgtctcagaaaacggaaaataaagcacgctaagccggtggcagcggtcgcaatggcctaaacttccccgcaccgaccttggcgctgctgcgccataggtaatcgccggtcaggttgatgtgctcccaccccagcggcgacagatattgcaacaatgtgtcgtccagcgccgtgccgttgccacgcaaagcactggtggcacgctccagatataccgtgttccacaacacgatggccgccgtcaccagattgaggccgctggcccggtagcgctgctgctcaaaactgcggtcgcggatttcacccaatcggtagaagaagaccgccctggccagcgcgttgcgcgcctcgcccttattcagccccgcatggacgcggcggcgcagctccacgctttgcagccaatccaaaatgaacagcgtgcgctcgatgcgccccagctcgcgcaacgccacggccaagccgttctggcgcgggtagctgccgagtttgcgcagcatcagcgaagccgttaccgtgccttgcttgatggaggtggccagccgcagaatttcatcccaatgggcgcgtatttgcttgatgttcagcctgtcgctgctaatcatcggcttgagcgcgtcataggcggcatcgcccttggggatgaatagcttggtttcgcccaagtcacggatacgcggcgcgaagcgaaatcccagcaaatgcatcaagccaaacacgtgatcggtgaagcctgccgtgtcggtgtagtgttcctcgatgcgcaagtccgactcgtggtacagcaggccatcaagcacgtaagttgaatcacgaatgcccacgttgaccaccttggcactgaagggcgcgtactggtcggagatatgggtgtagaaagtccgtcctggactgcttccatacttcgggttgatatgaccagtgctttctgctttgctgccggttctgaagttctggccgtccgacgatgacgtggtgccgtcaccccagttgccggcgaagggttgccgaaactgcgcattcaccagctcggccagcgccgtcgaataggtttcatcgcggatgtgccaggcttgcagccaagacagcttggcgtaggtggtgccagggcaggactcggccattttggtcagacccaggttgatcgcgtcggccaggatcgtcgtcaacagcaaggttttgtccttggccgtgtcgctggtcttcaggtgtgtgaagtggcgggtgaagcccgtccattcatcgacctccatcagcaactcggtgattttgaggtgcggcagcagcatagctgtctggtcgatcatggcttgcgcggcgtctggtactgccgcgtccagcggcgtgatcttcaggcctgacgcggtggtgatgatggcatccggtaagtcgttggccgcagccatgcggttgactgtggcgagttgcgcctccaacaattccaaccggtcatgcaggtattggtcgcagtcggtggccactgccagcggcaattcgctggccagcttcaaagtggcgaacttctcgaccggcaccaggtattcgtcgaagtccttgaactggcgagaaccctgcacccagacatcaccggagcgcagcgcgttcttcagctccgacagggcgcataactcgtagtaacgccggtcgatgccgtcgtcggtcagaaccagctttgcccagcgcggcttgatgaatgcggttggcgcatcggcgggcaccttgcgcgcgctgtcgctgttcatgccgcgcagcatgtcgatggcatcgagcacacccttggcggcgggcgcagcccgcaatttgagcacgcccaggaactgcggcgcgtagcggcgtagcgtggcatagctttcaccgatgtggtgcaggaaatcaaagtcggcaggccgcgccaatgtttgcgcttcggtgacgctggcggcgaaggtgtcccagggcataacggcctcgatggcggcgaacggatcgctgccgctttgcttggcctcaatcaacgcttgaccgatgcgcccatacatccgcaccttgtcgttgatcgccttgccggaagcctggaactgctgctgatgcttgttcttggccgcgttgaacagcttgccgatgatgcgatcgtgaaggtcgatgatttcatcggtgacggtggccatgccttcgatggccagcgctaccagcgtggcatagcgtcgttgcacctcgaactttgccagatcagcaggcgtcatctggccaccttcacgagcgattttgagcaggcggttctggtgaacctgccgctcgatgcctgcgggcagatcaagtgcttgccaggatttcaggcgctcaatatgttcgagcatgtggcgagagttcggtttggcaggcgactggcgcagccatgccagccacgtcactttactgccgtccttgcgcttgagaagttcgtccaggcgctgacggtggggtgataacaaagaatcggtcagcgccgcgtaaatgcgtcggttggcacgggtgatggcctcggcgcttgcgcgctcgatggcattcatggcgggcaggataatgctctgccgccgcagattctcgacaagtgcgctcgccagcacgatgcctttgtcggtctgcaaggccagctcggtcaatgtatgcacggcttgccgatagtggctcatggtgaagggcttgaacccaaaaaccgtttgcagctcgaccaagtgctcccgccgtgtctgttcgcgctggccgtactcgctccaactttccactggcatcttgagttgcgcggccaccatgcgcaacaggggcggaaacggaggctcatcgacgcccaaaaaggtgccagggaatcgcaagtagcaaagctgcacagcgaagcccaatcgattcgcggcgccgcgacgctgacggatcaccgacaggtcggtttcgttgaacgtgtagtgccgtatcagttcgtctttggcatctggcagtgccagcaggctttcgcgctcggtggcggacaggattgagcggcgtggcatggtcagtcttcccgcaggtactggtacaaggtttcgcggctgatgccgaagtcacgggccaccaaggttttttggtcgcctgccgcaactcgccgtttcaactcggcaatttgttcgctgttcagcgatttctttcgtccccggtaggcaccgcgctgcttggccagcacgattccctcgcgctgacgttcgcggatcagggcgcgctcgaactcagcgaaggctcccatgaccgacagcatcagattggccatcggtgagtcctcgccggtgaacttcagcccttctttgacgaactccatgcgcacgccccgttgtgtcagcccttggacgatgcggcgcaggtcatcaaggttgcgtgccagcctgtccatgctatgcaccaccacggtgtcgccctcgcggacgaaggccagcagcctttccagctcgggacgctgggtgtccttgccagaagccttgtcggtgaacacccgcgccacctgaacaccctccaattgccgttccgggttctggtcgaagctgctgacgcggacatagccgatgcgttgaccttgcaagatgcctccaaaggcaaaagtgtcaggatgaaatctattacctttgacggaatatgtcaatcaataggaaatttaactctattctgacatcgtttgcacatggcatctgacatcaagttagggtatgcctcaatctgacggctgcgaaccgccagggacaggcgcaatgtcagattctgtcgcggccttggcgcgtgcctggaagcgttcatagcaatccagcccgcagaaatgttcgacgtattccgcgccttccggggtgaaggcggcatcgagcggaatttctttgcagcatacgcagcaggtggtgcaactggcagtgttcggggcgtttgcgttcatggtggtactcctccagattggtagcgaagctcaaagctgcccactctcggctggctgggaagcggtcatgatcttcccttgaaggcccgcagcagccgcgtcacagacaggacaaacaagccggtcagcgtgagggctgcaataccccagtgctccccgatgaacgcgccggccgtcgtgccggctagcacaatggcgagaatcggcaaatggcagggacaggtgagcacggccagcgcgccccacaagtagccggtgatcggtttgtgcgtctcagacggcaagtgctctgggctgttcatggcagactctccgcgtgctgtgccggttcggttggcatggcggccagttgcatttcgaggctggccagggcctcgcgccgacgctcgacgagttgccgcaacacggcaagctgcgcagacgcaccgtcaccgtccgcagcatccagcgcccggcacagccgcgccagtgcgtccaggccgatacccgcttcgaaggcagcccgtacaaagcgcagccgttgcaacgcggtgtcatcgaacaagccgtagccgcccgtggtgcacgcgaccggccgtagcaatccgcgcagcaggtagtcgcgcacgatatgcacgctcaccccggcatcaagggccagccgggacactgtgtaggcgctcattgaacacctccttttcctcatccggcgcagcacgaaagctgcttcacgtccttgctgaaggtctgcgccgcgagcttcagcccttcgaccatggtcaggtaggggaacaattggtcggccagttcctgcacggtcatacggttgcgaatggcgagcaccgccgtctggatcagttcacccgcttccggggccaccgcttgcacgccgatgagccgtccgctaccttcctcgatgaccagcttgatgaagccgcgtgtgtcgaagttggcaagcgcacgcggcacgttgtccaaggtcaaggtgcgactgtcggtctcgatcccgtcgtgatgtgcttccgcctcgctgtagcccacggtggcgacctgcgggtcggtgaacaccacggccggcattgcggtcaggtccagggccgcatcgccgccagtcatgttgatcgcagcacgggtgccggccgctgccgccacatagacgaactgaggctggtcggtgcagtcgccagccgcataaatgtgtggcgtactggtgcgcatgcccttgtcgatgacgatggccccctgcgcattggcagcgactcccgccgcttccaatgccaggctgcgcgtgttcggtgccctgccagtggcgaccagcagctggtcggcgcgtatttcaccgtacccggtggtcagcacgaattcgccgtccacatgcgcgacctggctggcttgcgtgtgttccaataccttgatcccttcggcacggaacgcggctgtaacggcctcgccgatggccgggtcttcgcggaagaacagcgtgctgcgtgccaggatcgtcactttgctgcccagccgggcaaaggcttgcgccagttccagcgccaccacagacgagccgatcacggccaggcgctcgggaatggtgtcgctgaccagggcctcggtggaagtccagtagggtgactctttcaggcccggaatcggcggcacggccgggctggcacccgtggcgaccaggcagcggtcgaacgccaccacacgctcgccgccatcgtttaaacggacggcaaggctctggtcgtccttgaaacgcgcttcaccatgcagcacggtgatggccgggttgctgtccaggatgccttcgtacttggcgtggcgcagctcatcgacgcgcgcctgctgctgggccagtagtttgctgcgatcaatcgcaggcacagtcgccgcgatgccactgtcgaatgggctttcacggcgcaaatgggcgatatgggcagcgcggatcatgatcttggacggcacgcagccgacattgacgcaagtaccgccgatggtgccgcgctcgatcagcgtgacgttcgcaccttgctcgacggccttcagcgccgccgccatcgcggctccgccgctgccaataacggcgacgtgcagtccgtccccatcaccaccagccttgtcgccaccgcccagccatcccagcgccttgccaagcagtctgccccgcgctgaagtggatggggcatcggcgggtgtggccttgtagccgaggccggccacagcggcggtcagcgcctctggcgaggtgccgggatcggtggcgagttgcgcggagcctttcgggtaggacacgagcgccgacagcacgcccggcactttctccagggcgtccttgacatgtgtcgcgcacgagtcgcaggtcattccggtgatattcaaatacattgcatcgttccttttcgtttcggcaactgccaatgcagttagccgtgtttgggtggtagttcgcagcggcggttggccggtgagagcagatcccagatcgacaccccgatcatcaaggccagaccgacatagaggaggttcgccgtccaccaattgccaaaaaacaagagcatggccgccagcacgatggctgggccgaccatcccgagcaggctgcggtaccattgccgatgactcagccagcccagtgcattcgccagcaaagccacgactgcgaacagcggcagcagcttggagataaacaacccttcgtattcctgtagaaagccaaggccgatggccgcgcccaggctggcgatagccgggaaacaggcagcgcatcccatcgcggaaacaacgctgccaagcgcgccagccttgtcggcaatgcgtgtaatcagtcccatgatcgccccaggttcgggttcagtggctcactgcttgacgctggacggatagcccgcgtctccggttgccttggtcagcttctgcacgctggtcttggcatcatcgaacgtgacaaccgcttcgcgtgtctcgaaggtcacgtcaattttgctgacgccttcgaccttggaaatcgccttcttgacggtgatcgggcaggtggagcaggtcatgcccggtacggacagcgtgacggtctgggtggcggcccacacgggggcaacaacggcagcgagggcgagggcggcaaacagttttttcatgatgaactcctgtgattaatagaaaaatggcatgacgtagggaaatccgagcgcgaccaggaccagcgcggccacgatccagaaaatgagcttgtaagtagctcgcacttggggaatcgcgcagacctcacccggtttgcaggcttgcgccgggcggtagatgcgccgccaggcgaaaaacagcgcgaccagcgctgcgccgatgaagatcgggcgatagggttccagcaccgtcaggttgccgatccatgccccgctgaaccccaaggcgatcaaaaccagcggccccaggcagcaggccgacgcaagaatggcggccagcccaccggcgaagagcgcgccgcgcccgttttgtggttcagacatacgcttgtcctttcaaatttggtttggatagcttaagcttacttccgtagttatgtacggagtcaagcgatatgcaaattaattttgagaatctgaccattggcgtttttgccaaggcggccggggtcaatgtggagaccatccggttctaccagcgcaagggcctgctgccggagccagacaagccctatggcagcattcgccgctatggcgaggcggatgtaacacgagtgcggttcgtgaaatcggcccagcggctgggctttagcctggacgaaatcgccgagctactgcggctggaggatggcacccattgcgaggaagccagcggcctggccgagcacaagctcaaggatgtgcgcgagaagatggccgacttggcacgcatggaggccgtgctgtctgaactggtgtgcgcctgccatgcgcggaaagggaacgtttcctgcccgctgattgcgtcactgcaagacggaacgaagctcgctgcatcggcgcgggggagtcacggggtgactacgccttagcgtgctttattttccgaattctgagacgaccccattttggaattccagtgaatcttgtgcattgctcgaccaattatcagtagtggttacgatgacgcgaccactgaaacaagttttaccagacgcagtaaagaaactgtcgatatctgatttcttgatgcaatagtccggcgcatagttcttgcactggatcgcatgaaagcgaccgtctttggtgatcgccaccagatcaatgccagtatcagttcttctttcgatacttgcttgtgcaccgtagcgtgtaacccaatccgcgtagaacaatacttcgatatacagagacttatagaatgcctccgtctggaaatattgaatcatcagtttttcaaagctggtgccctggtcgcgtactgtcggagttacctcacgaatgtgagccaacaccgcttgtaatggagtggtcatatccctgccttattaaatggagactgatggagatggcgtgaaacgtgggccgtttacatgctaaagtccgataaatacagggatataatgaaataaataggggacgttcctgaggccgaggaaaacggtataactggcctatttctgcgatggagagctgctggacgagttgatattctgtttagtaagtagtggattcagcacctatacccggtactgaattcaaggaaagatgtacaccagaaagttatggctgggtgattaacttgtcggctggatattgacgtaaatgcgtcatggcgtcatggtttaatgatgtcaaccagtctttataggatgcttttggtagaatcactaccatgcgcttttcagcaccaggtttgtgaaactggttcatgactggatgatcgtctgcgttaatggtcagcatggtaaaggaataaaatctctctttaccccaggtagaccatagccctgctattcccatcggttctccatcctttctggtgatacgagtgggaatggatttgccactacgccaatccggttcataaatcgcttcagcaggaataatgcagcgctgtttgttgcgccacgcatttctgaagctaggtttctcggcaacggtctctgaccgggcattgaatgttctacggccgaattctgtatctttagcccagtgtggaattaatccaaattggccagttaatgccagaaaatcaggaatagctttgtctctcgattcggattcgcccggatggatgatgaaggtactggtgtacgtcggccagacatcaaagcgaatatcctgaggaagttgcgtaccaaaatagcgcaacaggcgttcaggttctcgtacagattcgtagtgactgcacatggtcatacctttcagtaaaaagaattagaataaggaacagtttgactcgccagaaaatgaacttgcctatgttggtactgaaatatagccaacctgttcctgtacaggttggtgaacctgtttatattccgctttattctggagtacgtgctggcttcccaagcccggcagatgattttttgctcaaacgcattgatctgtctaatgagctgatcaagcatccggaagcaacgttcttgatgcgaataaaaggccactccatgacaatggctggaattgatgacggtgacattgtggtggtagataaagctgtaaaacctgagcatggcaagatcgtgatcgcctgtgtggatggagaatttacctgcaaacgcctatatctcctggatggagaaaccaggttgcaaccagctaatccggactataaagatattattttcaaggacgggcaaatactggaagtctggggagtggtcacttcctgcattaaacaattctgaaacatcatgtttgcgctgatcgacggcaataacttttactgctcgtgtgaacgaatttttcagcctcgtctgcaaaaagtacctttggttgtactgtctaataacgatggatgcgctattgcccgcagtgaagaagccaaggcgctgggtatcaaaatggggcaaccgtggtttcagatcaagcatctggagcaatcagccgggctggtttctctttcacccaattttccactctacggagacatgagcctgcgcatgatgcgcctggcttctgaactgggtgacaaacaggaaatttactcgattgacgagtgttttatcgggttacaggggatctccaatgtgacacacagggcaagtgagattcgcgccaaaattttgcagtggactggaataccaacctgtattggtatcggccacaccaaaacattggccaaactcgccaatcatattgccaaggatgcagacagaaagccaggcagctaccctacccggctggcacaagtttgcaatctggctgaattaaatgaacgtcaacgccagttccttttcgagatgacagatgtgggggaagtatggggcatcggcagacgcatcagtcagcagctcaaggaagcaggtattaaaacagtaaaagatttcgtagaacttgaccctggaaccgttagaaaacgtttcagcgttgtcctggaacgtacctggcgagaattgcgcggacaaagctgcattgaattggaggaagtaccgacaccaaagaaagaaattgcttatacccgcacatttggccagccagtgcacaatcttgcttccttgatagaagccgttacggagttcacttcacgggcagccgagaagctgcgcaagcaacaaagcaagacttcaaccattctggtatttattcataccagcaaacaccgttcaagaccgcaatatgcccgatcaatcaccgtgccgttggttcgtccagtatccgataccaaaaatttgataaatgctgctttacatggcctcaagaagatctataaaccaggattcgatctcaccaaagcgggcattgttttaatggatctgaccaacgctcaaaccagacaggcagagctggattttggtgagacagtacttgatagcgacgagcggttaatgcacgctattgatgagatcaatgaccgcttcggcagaggaacaatcatttatggcagtgctggagtgggcagcgaaaaaaaggtatggacgatgaaccagcagcgacgtaccccttcttatacaacgactcttggagaaattccaaccgccttaacctgaacaaatatttaagaagcaattgtttgtattacaggtgtattgatactgtgcaaccatgcaaccatgcaaccatgcaaccatgcaaccatgcaaccatgttaattgagtgctacaacaactagagctacgacagcaacaactgttgatacgacagccatgatagtagccaaagttgccttcttctctgccttttgtgcatagtagttgctgctggctatattattgcctagtgattgctgtttgagatttttgctcgcttctaatattgattcttcgacagactgacgaacttgattggaaacataatcagaagcttctgtaataattttttcggcgattctttttgattcttcttgctggtgaaggagggctattgttaagtcccgacttgcatcactatatcgttctgttaccaagtcaaggtagcggctcagcacgatctcattaatggtaatggtgaccaaaatgggatcatccttatcaaggagaacgttgtgtttgatggcgatctgctttctgatttcctcaaaatcaatcatagcggagatttcgctttagaggacaattgccagttgatcaaagattgtttttctaacttttgccagtcgtgattttgccattagtccaaattctggcgattgtgctacttcatcaaacgttagttttctatccatcatttgtttaacatcttctccaaacgtgctgcttgtctggcgaggaattcttatgatccctttcacccgttgtttattactttgatagacgttcatttcctcgaaagtttttccatcagcaacaatatccccgaaaaactcatttaaccaaacaactagatcgacagttccgggtatttgatcaaccagagatgcaaagccaaccagcgtgtctttcattgcctgtccgccagttataacggtgtgaatggttacgtttttcccatgttctactatcacgttgatagcatcattttctgcgatgtagtaggacagaggtataaatgatgcagcgccgttatcgactacaaaattagtatcctcagctatcacttgctcaaccagtttgtcaaaatttctttcaatcaaactgcctccttctatcagttccagtcgtttggcgttaaatgccttgtatccggctaatgttgcatttactggatcagtatctatagcgagaacaggttgatttttgtttcggaggtgctgcactaatagagcagatataaatgattttcccacacccccctttccctgcaaggtgagatgcacttgtttcgtctcttttgtcttgtcagatgaggtcgtcccttgagtttgcggcgtttggatcatggtagaaggggattcctttttttctgggatttccgttttcggttgttgttttgttttgctgttcattagagcgttccttaattcttaaatatttacctacataacgattgaactgtgcgtagctaatttcgagtatttctatgtgatcttcatatatcgtgcgttgcgtatatcctgcgtcgagcagttctctaaatttatttaggttggcgaggaaagcgacacgaccttcaccttttctcctttttgatgccattttttctcctttttggtgccccaaaagattctaatctatagccctcctttgttaagcaactatcagcaaatgatagatgctttttgatattaaataagattatttgcaatcttaagatattgtatgagatttaatgcaattcacaaataaaaatctatttcgcattaatttattgcatataataccaaataataagcaggcaagatgtgtaatgtagtcctacatgctacgcattttggctaacattaccttcacttattcgcctttggctcaacgttaatcttgctctgcgaggccgacagtcgctgccgcgccagaaacagaactgaggaggctatgaaagcagcagaggaaaacgatagaaatctaaaaaaaccccacggtggtcgtccacggggggttcacatcaaagtatgggtaacaccagaagaaaaagcggcgattggtgaagctgcatctaattcagggatgaaagaatcggcctatcttcgcgccttgggtcttaatactcctgtcagatctgtgcttgatctggaagcggtgacagatctggtaaaagtgaatggcgatcttggacgggtagccggattgttaaagctatggttagcggaaaaacgcggtcaaggagccttgccgatgactgtggaaaacatgatggatgatttcagggagctgcaaaagatcatgcgcgacctgatgcacaaggcattgcatgatcgcaaaacggattgaatccaggcaaaggacggcatccaatgttgcccgtttgacaagatatatcgttaatgccaagggaggaattgatccgagaaactgggagcgcacagcggattatgtacttgatcttcatgccgatcctaacgagaaaggagaaaaggttagtggtgtacgtgtaaccaattgtcatacggatgatccggcagatgccacctgcctgatcctggcaacacaagcgcgtaatacaagatcaggcaaggaaaaaacctatcatttggttttttcttttccgccaggtgagcatccatcacttaacgtgctgcacgagatagaggatgcactttgcgaatcaattggctatgccgatcatcagcgtgtttctgccgtgcatatcgacactgatcatttgcatgtccatgttgcgatcaacaaggttcatcctatcggtttgcaaaatatagaaccctactatgaccagaaaagattgatgcaggcgtgcgaacaattagagatcaaatatggactggagcgtacaaatcacggaattaaaggcaaagaagtaggaagaggatcaggagtaaccagcaggattaagagcatcgaggatcaaagcgggatagagacgctagctacatacattacaaaaaacgctggcaggaaactatctgaagccaaagactggcaaagcgtacacgcagctttgttcgagtatgggttactgatgaagccacgtggaacggggctgattattggggatgtcaggagtaatttatgggttagagccagtcagtgccagcgtgatttttcaatgaaaaatatgactgacaggtttgggccatacgaagtaccaaaaggacaatggaaacagaaaccggggtatgtatcgcgaccagtgcatcatcatccctccagtgccaatcttttttctcagtaccaacgggagaaacagctttgtttattaaccagaaagaaagaactggagaaaataagaacggatagcgctgcgtatttgttgcagttacgtcattggaaaaaccatcaacaggtaatgttaaaactgggtaataaaggagtgatccggaaaatgatgggagcggatatcaggagacaggctgttttggccagaaagaatcaccaggcatccaatcaacgcaaacgcaagcaagtcttatcaaatgcggttatgccgagctggtctgactggctgatgcaaaaggcgatggccggggatagggatgcactggaagtattacgaagtagagaaaatagagagaggcgattccggggagatttactgagagcggcgggcgattttaatctgacaaaatcgattttactcaaggcattcaatcctgctgtccgaaaggatggcacagtctcttaccgtactgctgatggaggcacggtcatggatagaaaggatcatatccagactggaaaggtatcgacagtcactacattgtttgcgcttactttggctgtagaaaaattcggagggcgcgctttaatagtggaaggtacaaaagatttctgtgaaaaggtatcggagcttgcagctattcatcggctgaatattacttttgttgatccagttatggaacagcatcggcagcagagagttacagcatttgaacgagtggcaacgatcaacaagataccagttaatcaggtggcagttttgaacaaacctgattacccaaaggtgcccgaagacaaagatggggttctaactggaaaccaggatcaggtctcaggagcagtcattgagtggatacaaaaaaggaatgtgttgaaagacaggcagcattctttggagtatcaccggctgtggatggttactgatgcgggcaaagcaatttatcagggacgccgaaaaatgatggatggtagtgaggtgcttttattgaaaaaagggaatgacatgctggtcaagccctgcagctcaagagtggtggcaaaagcaagcagatggaagataggaagatctgtttttatcgacaggcagggaagatttattggtaaatcaaaagagattgagatttgaacaatcaaaatacttcaattatgcgcgcgcgagggtatggggtaatttggctcgccatttacctggtagcgataaatagcctgtgtacgcagtttgtggcctatcggctgggttatcacctggcacttggcacacctgtttatgcaaatatttataacccctttgattggtggaaatggctgttcacgttctatcaaggcgctcccgatacttataactacgcatttatcattttttctgtcggtgtactgattggtatggttgcatttgtcatcgttgtgggtgtcaagtcacgcagctcacgcaagcacaccgatgttcatgggacagcgcactttgccagcatcgaggaaattcaggaaacaggcttaatatccaaaccaggtaaacgtggacagggtgtttactgtggtgcatttgatgatcccaatggggaaaagacctattaccttaggcatgacggaccagaacatatttgtgccattgcaccgacccgatcgggtaaaggcgttgggctggttatcccgaccttattaagctggccgcatagcgttttcgtactggatagaaagggagagaattatgcaatcacagcagggtggaggcgggaagaagcggggaatgtaattttgcgttttgacccggcccaacccggagaaagttgcggttggaatccattaaacgaaatcaggtacaaaacccgttttcaggtaagtgatactcaaaatatcgcttatatggttgtagatagcgatggaaaagggattgaaggtaaccattttcgttctgctgcttacgaattactgactggtttaattctccattccctgtacaagagtgatggtgtcggcagatttcctagtttgtctgattgtgccttgatgctaaccggcgtgggtgattttgcagcacccgatacgcaagataatcttgccgaagatgcggatggcgacccaaaggctttaaacagtttgtttgccgaaatgagggatgtcgattttccggtaaaagatcagattgatagagaggcgaaactggtaatagccggcgtggggcgaagaatgctggatacacccgcgcgagaactcggaagtattatttcaactgccaacacagcgttatctttatatcgtgatccaatcgttggtgaaaatacatcgcgcagcgatttcagtatatccgatctgatggatcacgaccggcccgtatcattgtatttcataactacgccgcgcaatgcggatcgtatgcggccattggccaggctgcttttaacactgattgtcagtagcctggctgaccgcatggaatttgataacgggcgttctaaaacatcacacaagcaccggttgctattaatgctagatgaatttccaacactgggtcgattggagatatttgaaagcgctcttgctttcattgccggttatggaatgaaagcctacatcattacgcaagacgtgcaacaactctataaagcgtataccaattttgaaagtatcatttccaattgtcatgtgcgtgttgcttatgcaccaaataaagtggaaacagcggaatggatgagcaaaatggctggacaggcaaccgtcattaaggaacaagtcaatgaatccgggaagcgcttcgggatggtacttgagcaggtttcccgcagtttccaggaggttcaaagaccgttaatgacaacggatgaaatcatgcagttacctggccccaagaaggatagtaaggataacattgtcgagcctggggaaatgctggtatttgtagcgggctaccctgtaattcgtggacgccagattctgtacttccgtgatcctgttttcagaaaacgttcagaaattgagccgcctaaatacacagatacggtaaagaattctcaacgtattactggtaactttccgccaaagaaagaaggtttcaggctgtcgatatgatccggccaaagctaattggtattgctgcgcttacctttacgtcgtgtctcttctctgtaacggcagtttttcactccttgggttttcggttaaataccactgcttctgcaccggttggtttgtggagagtgcaagaggctgtaacctatcagaagggcgattttgtagaagtatgtccaccggacttatcaatcatcagggttatggtggataagggttatctcgctacaggcaattgtccaacgaatgttattaccttacttaagcccattgcagttggtaagggtgacattgtgacaattcggaaagggttgccagtttcaataaatggcaggttcttacctaatacccggtctatgccaacgattcaggcatggcctgatggtacttatctcaccaaagagaatgaaatctggctgttctctacttacagttcaggcagttttgatagcagatactttggcccggttgatgtatccaatattcgagggaaagctgttccaatattggtaataggcgatccagccgagatgcttttaactcgtgagcaagcatgacaccatcgtgttatgatttcatggcgtcattaagtcattaagtcattaagtcattaagtcattaagtcattaagtcatgattggaattgatttgatattgtcgtgcgcgccagcttttgcaccggaaaccattgaacagattattagagtggaaagcagtggtaatcctttagcaatccacgtcaataaaggtaagctggatcgagagccgatcaacgtagaagaagcagtgaacttagctgaatcgtatattcaaaaaggttattcagttgatcttgggttgatgcaggtgaatagtaaaaatgttgtacggcttgggtacagcatcaaggatatgtttgaaccctgtaaaaacattgcagcgggtgctcgcgttttgtccgagttttacgcgagagcaaagccaaaacatgacaatgagcaagcagccttgtgggctgctttgtctgcctacaacacaggcaatttcatcaacgggtttagcaatggctacgttgccaaatatggcattagtgtccccgtcgagctggaacgagtgccagcgattaacccttacacggcggatactgccgtgatccttaaacctcgaaaggagatagcaatgaatgacagcaaagaaacggtgataccggttatcagccagtcggcagacgatgcggaaatccctggtgtgcaggttgaatacaccgccgatgcagcagaggaaaacggtgcttttgaagaaacggcattaacggaacaagaagcgtgggcagctaacgcagaccttgtggttgaccctgaaagcaccggaattgttgttgccgggcagagcgtcaatcgcggaggaaactaatcatgaaaaaagagtatgcggaggaagtcgccgcaaaaattattgagcagttagagcagggcacggcaccttggcaaaaaccttggaagcctggcgaactgacactaccctataacgcccaaaccggcaaagagtatcgcggcataaatagcatgtggctggcaatacagggccacagtgacccgcgttggatgacctacaaccaagcctcagacgcgggcgcacaggtgcgcaaaggctctaagggcaccaaaatcacgtattggaaattcagagaggaaagacaggccaaggatgaacaaggccacccaatccgtgatgaagaaggcaagccaaaaataatgacggttgagcttgaaagaccgcgactatttcacgctgttgttttcaacgctgaacagattgacggccttccaccattgcagcccaaacaggctgagccagaaccagagcgccacgctcgcgccgaagctgtgcttttaaattctggtgccaacattcagcacatagagggcgaccgtgctttttaccggacaagtacagacagcatcacattgccagcgcgtcaccagttcccaacggctgatgcctactatgcaaccgcattgcatgagctggggcactggacggggcactcaagccgccttgatcgtgacctatcccatccattcggatcggaagggtacgccaaggaagaattgcgcgccgaaattgcctcattgatgcttggggaacgcatggacattggccatgaccccggccagcacgttgcttatgttggatcgtggattaaggcgcttaaagaagaccccaaagagatttttcgagctgcgtccgatgcggaaaaaatcaccggatttgtcatgacctttgagcaggagcaagagcagatgaaggagcaagagcagggcaggggcgatgcacagcaacaggaagacaccgtgctggcgttcatcaccgatggcgacggcatcaatcgtacgttgcagtttgagtccaccagcgagggcagttacatcaccttgaagctgcccgacgatccaaacgagttgcgcgatcaggccaatcgtggcgagctgcgcgccatccagcagtcaagcaacatcgacatggtgccggtcgctgacatagaaatcggcttgcgcttccgcgacctgttgcgcgacaccgcgcagcgcgacgatgacatcggagcggatgccaaggatgcgctggactactacgccaatgcctatgccatgaacaaaacccgtgaggaaatgaagagaaacggcgcgaccgcagaagacatgatcgccgaggaaaacaagcattggttgaaaatcggtttcgacattcgcaccggcaccggcaccggcaccggcggtgaacgggtcttgctgggtgacgccacgccgaccgaaaccgccctgatgctgcgctccctgtcgaacggtgaccggccggaagtcatgcccgagccgaaggccgacgaccctgaagtgaagttgcgagcgatttgggacaaagaaggcgtaccgaaggaaacgcaggacgccttgattgcagaaatcgaagcgaaagcaaagccgggcgcgagagtggggccgttcgtgattcctggcggtgatgccgatgcagcaccggcctcgtctgttcgtcaccatccgccggaaaatcccatgcccgaccgcacttacctggctgttccttacgccgagaaagagcaagccaaagcgtccgcgcaggcggctggcttcaagctgcaatgggacaaggaaaacaaggcatggtttgcgccggccggagccgacttgtcgaaaatggagcaatggaagaccgacagcgcacgggtgcagataccgacgaccaagagcgccgaagaccaattcgcagatgcgttgaagggcgctggcctgatcgtggacgggctgcccgtcatggatggaaagattcatcgggtgccggtggcgggcgaccaagccggcgaattgagcggcgcgtatgccggccacatggaaggccgtatgccgggcggttacatccaaaactataagacaggtgagcgcgtcaactggaaggctgaaggcaacattgagaaggcatcaccagaagaacgggtaaaactggcaacagaagcagctcagcggcagcagcgtagaacaagcgaagcgcaggccaaatacgaagtcacagccaaagccgccgccaccttgtggtcagagtcaccggcagcaacggcccaaaacccgtactgcatggccaagggtattgataaccccggcgcaatgggtttgcgtgttgtgccagatgcagtttcatcgcaggcagcagccttgggcatcaagattgccaagactgcaaaagaagccaaagaattgcgcgaggcagaccccgacgcaagggtttttaaatcaggtgatttgttggtgcccggccatgacgaaaagggcaagttatggacgttacaatcagtcaatccatacttcaagtcgttcatgaaaggtggtcgaaaacatggcctgtttaccgttgccggagccaacccgggtgacaaaacagtagccgagcttttagccagtaaagatacgccgatcgtgttggcagaagggtatgccacagctgataccgtggccaagctatcaagtcagccagtcattgtggcgtttgatagtggcaacctaaatgcagtggccgaaaccatgcggcagctgttctcggaacgaatcatgatcattgcagcagacaacgaccacagggcaccaaaagagttggggccagatagcaaacctcgcgtcaatgtgggtttagaaaaagccaaagaaacagccaaaaagtacggtgctggcgttgctgcccctcagtttaaggaagatgaaaagggcagcgactggaatgacataaaagaaaatcgtgggtttgaagcatccaaaaaaatgcttacagagcagctggctttagcaaaacgagaggcagccattatgtcggagcgattggtaggattggccagaacccgagaaatggaagcacgcaataatccgacaacatcattggatgatgcagtcatagcagcagaacgtggaaaagcagtttctacgatcatttcttctttggataagaagaaaaacagtaaagaagaaatgcaacaatccagtcatccccagcgcgtgaaatccataattcgagatattgatgcaggtttttaatgatgttttatagccaaccataactctggtagagcagatttttttgtgttttgtaatgacaagcgctgatattctcagtaatataattgaaaccatgaaaccatgaaaccatgaaaccatgaaaccatgaaaccatgaaaccatgaaaccatgaaaccatgaaaccatgaaaccatatttattcatgatgacataataacattatgcgaaagattgctttccttgctcaaaaaggagggagtggtaaaacgacacttgcagtacacactgccgtggcagcagccgaagctggagagactgttgttgtcatcgacactgatccacaaaagagtgccacagtttggagtaatgctcgcgcgcaggagacacctgttgttgcgacagccgccgttactgatctaggtcgtgtgattgaagccgccaatcaggagcatatgacgctggcaattgttgacactgctccccatgcagccccagctgcgacgcatatcgttcgtgctgttgacttggtagttatccctgttcgccccacagcctttgacgttgcggctgtcgggagtgcggttgatattgtcaaggcggcaggcgttcgtgcagtgttcgttttgtcagcttgtccgttccgctcacctgaaattgcagaaactcggattgtattggcagagtatggtttgccagtggcaccaaccgaaattattgaccgtcgcgcttttgcgcgtgctatagctacaggccgatctgtcaccgaatttgaaagcgatggaaaggccgcaattgaaatttgcgctttttggacgtggcttaaggaggaattaaaatgagtagtaaaccaacaggacttgcagcctttacaagaaaaggagctgctgatattcaacaaacttcagacaatcaagggggggaatcaatagcaagaccccataaacgcggacgaggaaaaggtgaagtggttgccctgacaattcgtttttcgcgcgcggattgggagcgtgtccatcaacttgcggtatctgagggagttagtatccagcatttagctgttagtggaatatccaagatttttgaggaaaaagggcttgttggattgaagctgtaattgtatagtttcatgcaaccatgcaaccatgcaaccatgcaaccatgcaaccatgcagtttgttttttctatccttaaggttgttagtaacaatgtggcttcttacgaagtttaattggttaccttattttcaccagatgcttggcttaacgatataaatatagatttatcaatttgtttttggttgtaaggtattcgataagccttcccttgaaggtttctgatccagtttccaggttttttctccagtaacgtagcggttatggtgccacatgagcttcgcaatacggttatccagttctctttcccatgtggtcactggaaattgatgatcccatgccatgagaacgcgttgctgggcttttgacatggatagtccatagcggtcgtacatatagaaggttacccgtgcaacaaaaccttttattttgtcccttggttctgtcgttcgctccttaaaatctgtgcgggttgtacactgaccatactgattggggtaaacccaacagttgtgtcactagccgccatttcgctgagttttacttaatattcattgggttatgaatctatagtttgtcgaaaatttcctacaatggaaattgtgcagtcatatcccagttctcttaactggactgtcccgtttcagtagaccacatcagtggttcgtgagatcgcaaaatccagtgataacacctatggcatccgccggataaagtaggcggagttacccagtcaaaaaaccttgaccacgtcataacagagaatgctcataatcgagtgtcaaggtttccattttcgatacctcactgcggtgcttattgtgctctaatagggatttcttttagcgcagagtgatgctggccttgctgttaccaaaggaattgttgtaatgagcaggcagtttcattctagaggatcgaggagggacttccgtgattgagcaacccatgctgattggcgggcagagtgcacaagctagtaacggtgccacatttgaacgcagaaatccgctggatggcagcgtggctacacgcgcaccagcggccaccgctgatgatgccgtacgggccgttgaggcggcccaggccgctttccccgcatgggccgccttgggccctacgcaacggcgtcagatgctgatgaaggcctcccaagccctggccgccaaggctgatgcctttgctgctgcgatggcgacagaaacaggagcttccgacgtctgggccagcttcaacgtcgacctatcagctaatatgctgctggaggcggcttcgctgaccacgcagatcaacggtgaattgatcccttcggacataccgggcaatgtggcgatggccgtgcgacagcctgctggagtggtgctgggcatcgcgccgtggaacgcccccatcattctagccacgcgggccattgccacgccgctggcgtgtggcaatactgtggtactcaagagttcggaactatgtcctgccacgcacggcttgatcatcgaagcactgcaagaaggtggcttacccctgggcgtggtgaactttgtcaccaatgcgccggaggatgctggtattgtggtggaggctatggtggcgcatccggccgtccgccgtgtgaactttactggttcaactcgcgtaggtcgtattatcggccagacctgtgcaaaacaccttaaacccgcgattctagagctgggcggcaaagcacctttcctggtgctggacgatgcggacatcgatgcagcagtggctggctgcacctttggcgcgttttccaactcaggacagatctgcatgtctaccgagcgcattattgttgatgaagccgtcgctgaggagttcttgaccaagctggtggcacgcgctagcacgctaccgctgggcgacccgcgccaaggaccggtggtgctaggatctgtagtggatatgaccaccgtacaccgagttaatgaactcatcgacgatgccgtgactaagggcgcaaagattctgtgcggcggcaaagccagtgacaccctgatgcccgccaccttgctggattgcgtgacacccgagatgcgcatttttcgcgaggagactttcgcccctgtcaaggctatcgtacgcgtgcgtggtgaagagcaagccattgccatggccaacgacaatgagtttggcctggcatcagccatctataccagagatgctgcacgcggctggcgcatggcggcacgcatcgaggcaggtatttgccatatcaacggccccaccgttcacgacgaggcacagatgcctttcggcggcatgaagaactcgggctatggccactttggcggccaggccggtatcgatgcttttaccgataggcgctggatcactgtacagacgcagctgcgtgagtatcctttctgatatttaaggagcaagtaagtcccaccaaaacaaaaatttaaggagcaagtaagtcccaccaaaacaaaaaagaggaaattgcacaagcaaaaatctacccaggatataaatattgagcgtgctatcacaagtggaagggcagtttaaaacggatgtagatataataaaattgtattttgaagcctacacggaagaagatctgggagatgacagtctcattcgtgctgcattgggtgatattgcctgcatctgcggaatgacctggctcactcacttatgaaactggcctggtacgccgatttgcgtgtcattcaacgcctgtgcatggtcaggatcagattcaggaaaataacaagcgttattgattcggctcgcaatccgttccaggtaattcaatcctgacagcaagggtagcaaaggcactggacataaaaaggctataacagttacagctttttttatgtattgctaaccgtatttaacaaaataccagcttagcgtacgattttttccgttttctgggacgaccccagttacatcgttctgcaagattcagttccgaacctaatattacgtttgagcgtacatcgctctctttcttacgcaacggaagatatcttggtttaattgtgccatcagcgttaattccagaggctcgaaacatagtcatcaacccaaatcattcaatgatgaaagaagttacgattgagattacccgtgattttacattcgattccaggcttcgtccttgactgcttttttattctaagaaagctaaaattctccttggttaaaagatgcaaggtttttcgcgcgaactgagaaaatatcaaccgttgttgcccctcagtttaagttctgattttttcaataacctcatttgctgactatttcagatcgcctcttccagataaatcaccacatactccctgttatcagtgacctgcttttcatagtcatttaccttgaaggcggatccttctgggaaggtgtattcaattttattgacttcattagataaagacgtgatataggcgcactgggtccaaacatcactgccaggtaagggcttgatcctgacgataatgccgttagagtagcgccgggcatcttccagagaatctgtaaagctcatgacggatttcaggttgatgactgatcctggttgcatgaagccagccaaggcctgctcaactggcatccccatggggcttccctcggggccattattacccgggtattgcaggaaataagtggccaaggcctctggtcccaggttcgagacatccacctggccactataaagttccggcttggaaagcacactggttctgggcatggactgcatggcggctgtggtcacccgccccagggcatccagatactggattaggggctgcttgatgttgggatattgagcagctatcccttcctggtatggctcagatattggatccatcatcatcgaatgcatgaagactttgtctgctggtgtatagggagcccaggaggttgtcgatattgccttaatgatgtcatcatcggaggcagggctgccaggcaatgcggtgtagcggtagaagtggaagatatccagccgaaagaagtcggccgtcgtccagtcataaatacttaaagccaaggttctagcaaagagactagatccaaaatactgcttggccaacggttccactgctgagaaaggccgttggttaccagtaacgctttggtaagggatgaggcggcgggcttccatctccctgatcagatccacatcgcgtggtgagacatccggtacggacttaagatggcttcctacctggttgccatcgcccgttacctgaaatcgtccgtcggaccggacagtgatgcttggggcgccctcgccatcgtaccagtagatctccccattgaagcgcagctgccagtaatgggggccaccggactgatggctcgtatcggtaatatccagaaatcccaggtggccaactgccattctgacactgctgcctgcaggacctcggcgagccaagattggcagcccatcactcatggtaacctcaataccaggagtttcaacggtaacgttttgtattgaccacataaagatctccttaatttgataaatagacaccaagtgcaaaactggatttaacactttgcgatggaggagcggcttgtccttgccgagaatggctgaaccgatttaaatgatcaactcgtccagcaagtcggcatcatagaattggtcagcgagatcacatcaaactatccagatatttttaatgccagcagcaacccgaatttcagcatggacaagatccacatcttcattaacggcatattggcgccttctcaataggggtagatcaggcagttgtgtcaccagccgccagttggacaatttgaataccggaaaacacatgttatccgacactaaattgcccatctaaaaattaccgtttgaataagccccagaaataagcgaaaaaccctgtcggaatgagataacatacggaaactaattctggtaggtttttcggttatgttgataggctacatgcgtgtttcatcggaatcggatcggcaaagcaccaatttgcagcgcgatgcattgcttgctgtcggggttgatacccggcatttatttgaagaccatgcttccggagcaaaggatgaccgggcaggtttggcaaaggtgcttgaatttgtccaccctggtgatgtgcttgtggtatggaaactggatcggctgggccggtcgttgtcgcatctgctggaaatcgtaaacacccttaagcataaacaagtcgccttccgatctctaaccgaaggcatggataccaccactccatccggtgaacttctgttccacgtattcggtgcacttgcccagtatgaaagagctttgattca

SEQ ID NO: 3 - DNA, 55635 bp, Nitrosomonas eutropha
caaaacgataaaaaacgaaatgaaacatatataagctgaaatcaaaactgaatactaaattaataaaacagaattatcaagatacataaaaccataaaaacataataaaaatgaatcagaacgataaaagcgcatttaatgcgaactttaatggcggctgccttgatattagtctatgatgaaaaaaggcactactggtatgtttacactttggctacgcctcggtaaaataccctgtgccaaaggttccacctttgaaaccggaatgcctggctgggataccaagcacaagcaatatgctgactacgccagtacctgaaatgttcgcggggcgaatacaataatgagacagaagcgcgcatcgaccaagacagccgtagtttcattccgaatcggaaatgaagcctataaccggctaattgaatccagtgaccgggcaggagtatctaccagagaatggctagaagaagccatcttgaacaaccgtacccgaattgtggagcggtcaaagccaaatgccgatttacgtagcctggttacgcaggtcaaccgtatgggcaacaatctgaaccaggttgcccacacgctgaatagcgcccaacttgcgggcaagctggctagggacgaatgcttgcaagccatcgaacggcttgaccatattcgcgccctgttaaacgaaacgattacctatgctcgccagggttaacgccgcagcgggtggcatccgagaatatctggaaacagggcgcaaaaggggccgcgaatacgaccgcgacctgatagatgatcgtatccccttggcgggcgatatagatctgatggacagcacaattaaccagattgaaaccaggcagaaaggcgatagccgttacctgcatatcacccttagctttgccgagcagtacacggaaagcaataccccggcccagggccaggtgaatctgaaaacgatacacgccgtaaccgaacagtaccggcgcgatctcatggctgcgtatgacgccgaggaatatgttttctacgcggaagcgcatattccaaaagtcacgcatgacattcatgcgacaaccggcaaagcctatgaacggctcccgcacgttcatatagttatcccaaagcgaaacatcagcaatgacgcctacctagacccgctaggctacggtgccgcgaacctggcttttcacgacgctatgcaggaaaaaattaacaatgatttttctctgaaaagcccgtatgacgcgctccgtgacgaaccgacacctttccctcttggtcggcataaggccgaccctgaaaaactgtcggccaaggaagtgcgcgcctacattcagcgtgatgccatcgagtccggtgcgcggagccttgaagatatagcccgcattgccgagcaatacggaaccgtgcgagtgcggaacgggcgcgatggcgattacctaaacgttaagcctgcttgggctgacaaagggataaatcttaaggacattacccccgaatctttacaggccgtggccgctggcgtagcctcagctaccatgcgccctccagcagatataactgccacaaaggttgagcaatggacgcagcatcgtgctctggaagtgcgctatatatccagcaaaggccgatgggctgcatataagcaattggatgaacaaggcaagacagactggcttgccgaaaaacggcaacaatcacgcgcagcattgttgcgcactttaaaccgaggactgtatgaacatcgaggacgaactgatagcgaggatggagggcttgggccagttgctggcgaccatgaccgaacagaatctagtcatcacgcaggaattaacccgcatcacgcaggcgctgcaacgcggccaggaagcagccagcagcccggacgtgatcgtagagcagatgaacaaactaatggagccaatcacgcacgaaatcgcggcgattcggcagagcctagaataaccaaggagaatcgacatggcagaatacgactcaaccgttataagccccgtattgcaaaggttggaatcttcccgcctcccgaccgaattcaccatttgtcagacatgtcctcactcggtatggttttcgacgaaggacagactgaaatgctattgcagggtgatgttcctagtaagttgggacagcctgaacccggtgccgatgatggaatgcgacggcccgagcatcggccaggagcaggacgagccgaaggagtagaccttgaaagcacaccaaatagccgcgctttgcaggcaatgcgaaagtgtgaaactacatgccgcgaggcacttgcacagtcagcaagaactcttgaaggcaatcgagcggttacgcttgacgttgaacccgcccagcttgccgttggccgacttcgcagggctttggatcaagaagcgattcgagctggcgaccctcaaaaaaatgttggacgacagataagcgtaatccgggcgcaagtgcgagaagaacgcggcccggtcaacgcgtcacggctaaaagccgagacaaacccggcgctggtgatcgaggccgcagccaggtactacaaaatcgacccggcccaatactcaacaggcgtagggcgcgatggcaccccgcgcatattccacgatggcaagcagtacaacttgggcgacttcttcaccaagcacctgaataaatcgtggctgaacgcccagtctattttgatggagtgccacaaggcatcgttatcagacgccctaccccagccagacttggaaatatgggtagctttcaacgaatggcttagccaatcgtacaagcaccggcaaatcgaacgtgaccacgctagagagcatttccgcgatgaaacgctggctgtgcgcagtctatacaaggaacagaaacaggccgcgcagaagttaaccggcttgatgcgtcaaggcgcaatggccgaggcccgcgcagcgcgtgttatcgcgctggaagaaatcgccctacagcgccaaaccgtatacagcaccctaaaagcaccagggcgcaatgccgaataccgcacgttcctgcacaacctggccgaacatggcgatctggccgcgctgggggaactgcgaaaaatgcagcaggcccagcccgagacaggcgggccggattttgttcaaggccagggcgaagacaagcccgttttcgccctgcccaattatcgcgtagatattggcgggaacgtcatctatcaagaccagggcaagaccatcattaaagacgccaggcgcggggttgaagtgcttaaccccgagcagcgtacctatgatcttgccctaaaagttgctgtgagccgatacggaaaatctctgacattgaacggggatgccacattcaagcagcaaatgatcgaggccgcacggcgcagcggcctggattttgaaatcaaagatgcgagtaaaccgcttgcggcccctattcgcgtcaacgcgccaattcgtaaacgttagaaggaaaacacgatatgtatacaattgctcagatcgaacgagccaatgcagcgatacacaaccaaggtggcgacacgccccaagcactggcccgtatgaaagctatcagtgatatttatttgaacgcgctggccgctggagtggcaagggtcgaacaggaaagcctaaccgagcaagaaattgaagtgatcaatcattttctgaagtaatattttaaagaaaaaaagccctgcaataacgcagggctttttcaactggcgatgttcgccgaacgaacatcgtacagcgcacttagcgcttcaaccatggatattcttcttgcttgggcggatgcatttgttcccatcgcgcttgttccgtcacaaagtctttgttaggtacccacctgccgttctgttccatcgttcctacgtacttggcagcaatgtccacgtccgtgtagttattgccccagtacgtctcacagtgattagggagtgagttcttaattccgtaatacgtttcggtattacaagaactgcttataaagctattatcccaacccttgcataccttgcgtttaagttgaacccgttgggtacgattcaaataatcggcattgcaacggcctgcgccatttacaatatcctcaacaagctgtggcatgtttgcagatacatcctttgcagtaggacacaaattcaaaaacgagcgccttgccttgactgtattactccatttcaagcgcgtaatattgaaataccgactcagcgaagcgctgcactcatcgggacgctgtgacgaggacaggcacaagatcgcctcacatgccaaacgcgtatcacctgtaaaaaattgttctactgtttctgttgttgcggcacccgaagttgaagcagttagtattccaacgctgattattcttataacaattttcttcataaatcactcctagaataacgccgccgaagcggtacaaatacagttacttaatgcaaacaacatgagtttactaaaaattgaattataagtgtacttttttatagacctatgggaagtttttcggataaaattagacctacaggtagcgtttaaaaaggaaaacacggatgaaaacaattgcagtagcaacccaaaagggcgggcagggcaagacaaccatcgcattacacttggcatttgccgcggaagaagcgggtttaaaagtgctatatgtcgatatggacgagcagggtaatggtagtctggttctggcaggagacagcaagatagcccatgagtcaggctattctgctttgacggtcagcacattatttgaccctgccaccgggcagcacctcaaacccctggttaccgaaaaaaatattgatctcatagcgcccgatagtcttttgccccaatacatacaaggcacgttcgaacttggcagccccgcactggctgcaccccgcactgtattggcaagattcgcgaatgattacgacttgtgcataatagacgcaccgcccgccatgggccaggtgcttgccgcgcttctggctgcatctgacgcagttatatcccccatgagcatcgatcttttttctattgatggtgttgctaatttgctagaaacgatcactagaatacgcgacgccgagaatccagctctcatacaacttggcatcgttcccaaccaagtgaacacccgcagcaagtacgaaatgaatacactggaagatttacgtagcgcctatggagcgcttatcacaccctacgcctttagcttacggtatgccgtcaaggctgcgatttctgccagaaaacccgtatggcgggctgtcagcggttccagccatcgcaaagctgcacaggaatggaaagacaattgccgaactgtgcttgaacaattgaatgtattggagagccaacaatgaccagcgataaaaaactgaagacccgaggattatcgacgattcccctggaagcaatacaggctatgagctacaaaccatatctcccaaccaacgcacaacagcaggcgctagcgcgcctaattgaagcagccaaaggcgatacaggacaaagccgctgcattgcagaattcttgctggcatggtggaatgcagatacctatggaggtttcgacctcacaaaactatgggctgtggacttatctatatgccacgatatgcaaactgtctttagcctgattgcagaacaacaccattaccctgatcatttcgagctggccgacgattttaaagaaattatcagacagtggcgacccgagagccttgactgaaaaccgtacatttaaaggatcaacatgagcaatcctatcattaaagctgccgctggcaagtttggtaaaggcattcaatcgctagctgttgaacagtcagtggccaaaactcccgaaatcccattagacctcatcattatcaaaaaacaggtgcgcgatgaatttgaagatgaggaaaacccgctttctgaaatggccgatgacatgaaagaacttggtattttgcaatccatactggtacggccagttcaaggcggcaaatacgaacttatcgctggcgagcgccgtatccgcgccgcgaagatagcggggctaaaaaccattccggccctggttaggactttaaccgatgaacaggttgaacgtgcccagttcattgaaaatatcaaacgcaagaatttaactcttaacgagcaagccaagcgtatccaacgtgacctggacgcttgtggcggcgacgttgaggccgtattgaaaaaatacggcaaacccaaaagtggtcgcgtatggatttacaaaatgcgggggcttctgaacctgtccgaacaggcacaacgccttatctcggagaacatcaccgccgatatggaagtcattaacgatgtacgccagatcgagaaagtaaatccaggcaaggcaaaggaaacggtagatgcactcaaagcagccagtactgcaaaaaaatccacagttacaacggatgcaaacggaaataataatgccgctgcaaaacctaccaaatccggcaatctgcgcgaaatttcgcgcaatgccaaagccgaggtagccccgaccaaacgtcagatagccaagaaagacgacgataaggtcaaagaaaaccaggccacgccgcgtaaccgagacgccggggtacccggccaggtttttaccatttcacccgccgcatcagcctccatcccgctcgacaatgaagcaagggacgatatttcacaggttgacgacgaagcaggccgcgccgctcttgaagaaatgctacacgggtttttcgacaaaggcgcgaacactgtagaatgggttgctgcggtttctgaagggattcggaaaagagattatgacgactcttccatgggtaggctaaaattagccgccctttcagcaggcttcgccaagtcaggggatttcaacttagatgtgttgatagacagagcgaagaatctttaaacacccgaatgcatgaccttaaaaaaacgtttttattattcaaaaaaccggatgcaagcgcccgactttgatcgggcgcttgcttttacacgtacacgcgagaacactcaggcaattgccagagattatctggtggcacgtcactcacttgatacgataactgctacattcgacaccacgaaacaaaacatatttagagctgttgctagactgatcgaagatgcgcaaacagcccaggaaaccatcattaaaatcaggcgtgtattcaacaggctgaacattcccaagaagcaatacaatacagcgcgtgagtttttttttacgtcaaaaagtctggatgaaattgctcaacaagcaaattcaacaattgaagatgttttaaagatcgcacgatgcacgatcaaacattaccagctacatgcgaacaaagacgccattaaagagcgggaggtcgaattcgataaaattcttcggtatagcagagcgggagagaaatccatccaaatctgctacgatcattttgtgattcaagacactttgacagtgattgcgaaaaaacatgaaatcacaaaacaaaatacatacaacatcatcaaacgttttgaagaagctcagatccgctatgaagctgaaaatccactcaaaaacagaagacgcagaataacaaaaccctgaaccgggaaattttcttattcagcttccttcgcactgatcgaaagacaaacctactacagctaacgccagatgttcgcctggcgaacatgataaacgcgcgaggcgcgcccaggtcgtatctctacaaaacaaaatttgtcaggtacatcgcgataaatcgccgtgttgcatgaagtatcagcagtctcattcgagattcttaccgggtacgctctaaatccaaggcaggcgctgctcacctgccatagcggtttccgctgaatttaagtggatcatgtccaagtcgcctttggcgcgttgtgtagctttgctgattccctttcgcctgccctaaacggtagaccagccaagccatcgctccaagggccgggcaagccctgaaatcctcatctgttcgcactcgctgcgctcgcttgcgctgcagcttccggtttctccctttccgcactgtcctgtccggcccacctacgggcaatcacggcgaaaggcactcagcgaagcagatttacacaacaaaaggagaatattgtcatgaatcaccaaacgaaaattcaaaaaaaaaccggcagtgcatctagcaaagcaggggttgaaaagcgggaaaacgagcgtgaagcggctttcaagaacgtttggcgcggtacacacaaggactatagaggctgtttgcccgatggcactttgacggttatgagttgggctaaatacggcggcggccttgtaactgcttcgagtatttgcgttgccgagttggcagagcgtcaggaattcatcaagcgccgcgcacgctgattttgttttgcactggagagccaaacactatgaccggcaccgaataccgccaagcccgcctcgccgagcgctagaacatcgcctgcaacacccgccaaaccgcctaacaacacgaacaggagcacataatatgaacgaatttttccaggcgtccgacgtgatccacacgcacacccgcgcgcagctcatcgaggacggcgacctgattgacgtgagtgagacggcacgcgaggccggctttatggtgcccgtcgccatcacccgcgccgtgtggcgttggcgatgcacatcggcccaggcgatgacttgtccccggttatcaccattatgcaacctgacgaagactaaaccagccaagtgccccgaaggggcaccttatctgccaaaacccaaggagataccactatgacccgctttattccagagaatgccgaagcacgcgaatttcccactgccgcaatcgttgcctattgctaccagagcaagaagggcccggcgttagttgcatacaaaggtcgccaaagtaagccgtgtcgttttattgcatttactgatgacgagcgccgcgatagctatttagccgaactggtgaagactgaaatcgagatcgaagactggaagcgttcccggcgtgaaaaaggccatggcttggacgtgggcgacatcgtttattcatcatggggctacgagcaaaccaacgtcgatttttacgaagttatccgcgtgccgtctggccggtcagcagttgttcgccagatcgaaaaagacacaacgagtgcaccaagccgcatgtctggcctggtaactccgaagccgggcgcattcgtcgccacagcaaaagaatccacccgacgcgctgccgggcttcactgtttgaacggcggaaatctgaccatcggcagtttgcagaaatgggacggaaaaccgaaagccgtttcttggtacgcctaaagtagaatgtatttaaataaaaacatagcgtggttgcacacaaagtgctttataataaagtgtactctcgtgttgactcttgagataatcactttaatctaattaaagtgattatctgccatttcaggatatatccaacattatgagcgaatacgaatacgagcaacaagaagcccaaaccgaggtttacaccaatgcagcagaggttgagattcagaaagaatggcgctgggtgaaccgtttgccgggatatggcggcgagtacacccagcatattaatgaaattgcacaggactaccagcaagccgtgaatcttgaaatagaagcatggcgaatccgcaacggacaagaacctggtgcagataatacgctggatatatccgcacaagaccaggcacaagcgcaatcgttgcgggcgcaagcacatgatttgcgcattgagagcgtgaacaaggctggggctatcgctcaatctataaaatcacgctggaatgaacaacaaatcagcctggcacggacaggcgaaaaacagatccacctgagctgcgacattaatcgcgatattcaacgctaacacaaacgaaaagagaaaatcatgaatcaagcacaaatgcaggaagcaaccgaccggctgcgcaaggaagaaaaaaagggagaaggcagttttgcttctggtctgctgttttgggcttttgttctatcagcgctatacagctatttttttaaatgaaacgattgcttgagaacagtactggaaaaaaggatcagaagtttaccgaacgtgcaaagttgcgcctgcgcttggctgctggtttgattggcgggcaagggcgcatgttaaaactagatcgagcaaatttctatccggaaatgctcgaagtgatcgaaaggcaaactcccgagcagcgcgacagtattaaaacacttgtcgattggctggaagattatgagaatgcggccaaagcagtgggaatcagcacgcaaccactcaaaaaaagcaaaggcggcagcgatagcgcctaaatgctttagaacatacttttcaaggaataaaatatgaatatttatacgaattacatcaagctttgtgtgacattggtaaaccctcttttgcgggtggtcaaaatgacccgtggtctgcccgactggtttgcccttctggtattggtggttccatttttggcgttgggtatggtgtttccaatgactgtctatgtattctgcttgttttttctcacggcgctggccagcatggttgtggatgtttgccgtgtcgcccgattgttataacccgcggattgataagattgtgaactacgatgcttaacagttttatttatcattttaaatgataatgaaagtcgcacgctacacatgcctattaatgcttactgtggcttgctcgaccggcgtagccacagacgagcaaaccacgaaatgcacactgcatttttctaccggccagattcttaccaacgtacccgttgcggagactcaaatggaacaagagcgcggcctatccaaaacacacgatgttagccggggtatgctgtttatctggccgcaagcggctatgcgtgttttttggatgcgtgacacctggatgccactgcaagttggattttttgacagcagcggaaatcttttccagatcgaggacatggaaccaaatacagacactctacacgagtcgaaacaggccgctaatatggcgctagaattggcctcgggccaatatcaagcgatgggatttgtggccggtaaaaccgtcctgttacgcgggcaatgtaactaatcagtgaatggaaaatataatgagtgatccgatcgcgataaacaccctgtacggagtgaaaagcatcaaccttgaaaacctgatgcaagcagcgaaagagcagcctacacaaatcattctggacgaattgcgtaggcgatgccaatcagaggctgacaaactggtcagcctgtatcaattggcctacggcaaagaagctgcgaaaatatgcaataaagacataacgcacagcttcgggaaataaactgtgtctgcattgcctgtactcaacatagtaccacgtcgttctcggattcaagggctacgcgcatcgcgcttgcggccaaggccgtttcacccctgagtcctgcgctgcgccgtgctgtttcgtcttcaaaccggcaatcccgcccggaacttgaaaggagaaatagcatgtcacaacaaatcttatcttttgaagctgctcacgtcgataccaccctatacgttaaagatcttgaagggcggtataccgttgccagcgatgaaatgatttttacagcgactcgcgcggctattgaaagaaaatacccggcaaatactgcgatgaccaaaccggaaattgcagctgactactttaaaaacaaattaaatggctttgagcatgaggtttttagcatcatcttcctgaactctcagtatagattgatcgcgtatcgtgaaatgtttcagggaacattgacgtgtgcctcggtatatccgagggaggtcgtcaaggccgctatcagctacaacgctgctgccgttattttggctcattgtcacccctcaaaagaaacagaacccagccaagccgataaagcaatcacaaagcgcttgaaagaggctttagacttgattgatgtatgtgtacttgatcatattattgttggaggcaacacaaccaaatcaatggccgaaatgggattagtctaaggttttcgccaataaaaaagcatcccacaaaaggggtgtttttttttgcttcacaaactgctgaagtagcaggctttacctgtctcgcgttttaagtcgtgaaagccgttcgcattactccatatcatttgccaattccggtcgatctgcatttggagccgccttttcccgacgcatagctacacggccattttgttcaagggaaagccccgcctgccccgtgtcctcactgcgttgcgggccgcaccagccaggcgggtccgcttggcgcccttgcacaactctgcccgctttgctgttcatgcgtcaaggcggctccaagaagcagattttaaccaggcaaaggaggaaaacatgatcaatacgaccaatcacaaccacaataacagcaaaagcaaggctcaccaagaagcaggggggaacagaaaatgagcatgggggaacaaccaaggcgaatggctggaatattcgcgcagcggcagatttagccgtgtggcaaccgcaccagaagaatcaacatggatttgtaacgattgcggcaatccggacgcagatccccacggaaaatgctgtcttttttgtggctcagtagcagaaattaactaacaaatcaggggaaaggataagagatgaactcatacgaacagaaacaagaagcccgcaaaatccgttttgaaaaactggctgataaagctcaaacggagggggagcgcagctacaaccgcgccagagacatggcccaggcgatccccttcggccagccgatccttgtcggccatcacagcgagacacgcgaccgtaagtatcgtgaccgcatccataccacctatggcaaagcctttgccctgcaagataaggctaggcgttacgagcagaaggccgcgagcgtaggcactgggggtatttccagcgatgatccggacgccatcgagaaattacgcgccgagctggcaaacgtcgagcaggcccaggagcgcatgaaggccgcgaataaggccattcgcacgcataagaccgatgaatcacgcattgccgtactggttgcccaaggcttaaccgaaacccaggcagtagaactcctgaagcctgactttgcgggccgtgtcggcttcccgtcctacaccttgagcaataacaacgcgaacgctcgccgtatcgctggccgtatcgccgagctggaaaagcgccgccagcgtgccgatgtagagcaggagggggatggctacatctaccgcgaggacgccgacgaaaaccgcgtgatgtttgtgtttcctggaaagccagatgaagctacgcgcggcctgttgaaacgtcacgtcttcaagtggtcgccgtctcggggtgcctgggttcgccagttaaataatgccggattatgggccgctcgctccatccgggaagctctggataagggcgctggactttaactaaccaccccgctccgaagcggggatatcattcacacgggcacaaaagatttttgctgaacatttttatcgttttattgacgatataaagctgattaaatttagcataatttattatcataaattactttacatacactcttaagagtatatgaatacttccatggttgagatgtactcaaccccgccccggcggttccgggattccaaaaatggagcaaatcatgaaaaaagttatcgaatggcaagcaggtaacggatcaaaaatatcactggcagttttcgaatacctcaacgcagctattgtcgatgcaagaacatgatgcttatgtacatctccgcgtgccagcggaaacaaaagccagatgggtgcaaaaatcaagagaagcaggcatgaaacttacatgtaatagctcttgtttcgtctcgacccaatttttcaacgatattccaaaaacttttttcatgattttgatcaggcaaactagcgagcaatgtatgttgactgttagctctattccaaatattagtttgcctgatttgcatccaaaccaaatatagtcctgccgttcctatcagagaaatgaccagctgtagtaatggaaccatatctcttgagaattcctgtaaagacatagtaaacaccccccctttcgctaacgcaatatataagacattgtgcacaagagtatcaagcatagttgagattggtgcagccagctacttgtaatagcttgcgtttgaaactggccatgctcgcaatcgacgtgtttttctgctcacaataactgcaactgaaaagctgttcatgctcacgctatctgtaaatgagctcgcatttatcagcttcggcttgcattccatcgtgacgtgctcacgctaagtgaaaatgaactttgcgttgattgtgagttgctgaaaataattattcactcatttatatcaaaaacttacatcaacacacgataatttcttttatcggcatcagatgatttgaggacgcggtactccatcccgctggccactgcgatctgctgggcaaagtccttcttggcctgcaccacggcatcttcgatctgattgtcggctttcacctcgacgatcacgtacttcaggctgccatccatctcttcgcgctggaagataaaatcagggtagtagctgcgcacggtgcgtgaatccgggtcgatgtactggatgaagaaatcggactggccgtgagtcagcattccagtgaagtagatctttttcacacgctgctcgcgcaacagatcccagaacagccagttctccgagccggagtcgaagcagtaggtgtcgaggtggaagctcttggcgcgctcgtcatccttgatctgcgcgtcgtgcatccggacgatcttatccttcgccgctgatacctcgtagtagccgttcgtgggcagcttgatcagatcgacctcgtgctcctcggtttgctgcgactcgtcgaggtcgtagagctggtggaacaggcgaggaatgatttcgtcgtacagcagttcgttgaactcgttagtgatagccaccagctcatcggagccttctttcgtcgcggccagcagttcctcgatctccagcgggtttcggttcagatagcgggacacctcggccaccagcgtcatcggcgagaaggtgcgcttctcgcggcgagcggtcaggtcgaaggtgcgactaccggaagcgcgcgcagcgtcagcgggcgtcaaaccgtcctgccgcgtttcgatcaggcggtacttctctaccagctcgccccacttctgcgcatctgcccgctcaggcatcaacgcttgcccgatcaccaactgcttatcgcgcatctggtactgcttgcgtacgcgcaccagcttgatcttgatcggtggctcaaccacacgaatctcaactcgttctttgtccttgccggtcttttgcagctcgtcggtgctgatgcggaagttctgctgcagttcgtcgttcagcgtgctgaggttgccttcggagaggaagacgtggccggtatgctgggcttgcccaatgctgcgtagacagcgcatcgtggcctgcaggacaaacactttggacttgggttcgcggaataggcccacgccaaacaatgagcggcagttccaaccttcgcggcccttgttgaccagcaagatgaactgcttctccgagccttcggtgtcgagccgattgaactcgcgaatgtcgtcgttggtggtgatcttgctgtcgcccacgttgaccaggatgcgtgaggtggggatgccgtgcttgagcagcgcacgctctacggcaggcttcagctcttcggtcagctcttccacggtggccgcgaaaaacgccagcttgggcagcattccttccgggcgcaggttgcccgatccattcaggaagctctcgatggcgatgtcgataaactcgtctgtgcgggtgttagcgtagccatgcagcgtcacattcttgagaaaacccttgtcgatggcttccttcaggccataagcgtagaccacctccggcaacacctcgcgccccacgtagggcgtgccggtgtagttgtagcaagctaccacgcgcgtgcccgccgcgttcagactggcggcgaggatgtcgatggtggtgcgcagactggtgtcggttgccttggcccccacgcccatgtccttggccagcgccttgccgaaggcgtggtgtgcctcatccacgtagatgcccaactgcttcaaacggcgcagcctctcgaaccgctggttggtcgtgagttcgccttcctcttccggctgatcgaagttgtagaggtcggcggcgtcggcatagacgccggtgacggcgagggtttcgccggtcgcgccgaacagcttgtcaacggaggttttctccttgtgctggcgcttgagaataatcttctgcgtgttggagacaatgatgttgaagcgcgagcgatccagggtgtcaagcgatgtgcctgcctcttcgaggtagtggaagtgcagatgcgtggtcaggaagttgacgtactccggcggcaccacgcgcgtcaggtcgaaggcctcgatctccttgagcgactgcagcaccgtcttgtccggcgcgaacaccagggcgttgtggcagtagcgcgcgtccttcggaaatttgttggccagcaggaattcgtagaagacgcaggtcgccatcaggatggttttgccggtacccatcgtcagcgcgaagatgtagttcgggtaggtgcgggagttcttgcgcatcttctcgaacagcactttgtaggagttcaggtccagctcatcgctttcgtcgaacttgatcatctcctgcacggtgttgtcgaggaagaagctaaacttgcggccctcgaactttccactgcgctcgtaccacgctttaaagatctcttcgaccttggcgttgcccagaaactccttgagaaagacgtaggtttccagcgcctcgaactgcggttggcgcaggaacgcttttggattcttctcggggttgttgaagtcgaggaacttgcgggtcagttccttttggttctgcctgatcgctccccggttgtcttggtagaaccgccacagaaagcggaagaaggcgaagtcgagcgacgcgctgaccgccttgggcgtgcgcttattcgccatagctcacgctcccttcccacgattccgagagcaggtcggtgatcttgacgtagatggtgcccgcatcctgcggcacggtgtacgcgcccttcaccagatcgttcttgctggggatatccaacactgcgggttgcagcaccgcgccgtcgtagttccagtcgatcagcaccgactcgaccaactccttccagtcctcgacagactccttctgcagcgatagtttctgcagcaggttcatcgggtagaacttctcgatgaccagctctcccttcttgatggacaccttggcctgcgagtcgcgtttgaactccagatcggccttgtcgcgcaggatgtccaccacctccacgtcgatcttgaagggcttggccgcatattccagttccgcccgcaaagttggctcatgccccatgcagacgagagtgatcttctcgaccggtcggtttgggctttcgttctgcttgcgctcccacgccttgtagtcgaaccccgcgatcaactcgttcaggtcggcgcgcgttgcgatgcgattgacgggcatgatcttgaccatgcgcccgtccttctcgccgtcaaacacggtgctgaactccagcttctggatttccagtgcttcgatcaggagttccttggcctgaacagggtttcgaaagatgtcgtagttgttgacgttgtgaatctcgaacccccagaaagccctttcttcctcattaagaggttgctgaagaatctccacggcagagttgatgagtctcttggttgatgactgcactgcccccaaattgatgtcggcaacaataaatttccgaccgagcttctgtgcagctaccgcagtagtgccagagccaacgaaagtgtccaggacaacgccgcccgctgggcatccggcggtaattattctttccaatagctgctctggctttcgggttggatagtcagagccgcccttcatccgaccgcaatctgtccagattgattgtagcaatcggccattactcttctcaaggaaaaatactttgcagcgggtagatccttttcttggatcgcgcaggtacaactccccccgctccaaggcttgatccatttcctttggggaagcgtatgcccaaacacgattcggcgacggtttgacaccgcgccattcgaactgtcgcttggagtcctttcccttatacgttgtattttctactttgaagcgcctgccgagattttccgtttcttctgagtaatcaacaactgatccatcatccagaagcaccaaactatactcactgagagcggagtcagagagatcgcctgcggctgcctgccaatcatagaaaactttttctttgttcttggctacccagaatatggtgtcgtgaatgatcccaagccgactctttgcatcattatgaggatcggttctctgccaagcgacctcattcagaaaatttgaagaaccgaaaatctcttcaagcaagcagcgaatatgatgactgcgatgccaatcacactgaacccaaatgcttccctcttcggtaagcaattctcgaagcaaaactagtcgctcatacatgaattgcaaatattcatcattagtccacaggtcgccgtactgcttgtcctcgaatgcggccatgtcgcccgcaaccgttatccccttcagatgaattttcttccgatagtcagccttggaatcaaaaggcggatcaatgtaaaccatgtcgatcttccctctgaactgcttcagcaagtgactcatcacctgcaggttgtccccccagaaaatcttgttgcgccagccatctacttcctcgccgtggacttccttcaactgcgccgggtaatactgcgtcgaggtgaacgggcgtttgccacgccagttcagcatcgggtagcccttgatcggctcaaacttgtatttctccacgttggtggcgccgcctgcgggcgtggccagttgcaggctttcctgcgcgggggtgttattgttcatcagttgctcttcctgaatttccaattcttgttgtcgcagtaggcgcgcatgtcgcagctcaggcatagctttgccgggcgtgtcgcgatgccatagtcctgccgctctatgcgcgccacgatgtcgtcgaagcgcgcgattgtcttgccgatggctcggtcgtccttgctgaacgacacgtagggggtgccgccgtcctcgccggtgtagtacaggtgcatccgactgaccttctggccggtgcgtttttccaccagatgggcgtacacctccaactggctctgatactggcgcagacgatcccgatccctctccatgtcgggcttcttctccgacttgaagtcgatgatctcgaccgtgtcgtgttcgccgcgaatcaggtcaacgctgcccttgaggatgtactgatccttgaccagcgaaatttccacctcggcttctttgatgcgattccagttgccgttctcgcgctcgaagtagcgcagcacatgcaacaacgccgcctgctgcgagctgggagcaaggtaaacgcgttccttctttgagagcatcgcgtagttggctgagaaccagcctttgatgccgtcgagggtgatgctgccttcctcgccgcgcagcaccgtcttgtgaatatcctcgatggtctggtgaaccagcgtaccgaacagcatcgggctctcgcggatgggcgcgaattcgagttccttgaagaagcggtactgctcggcgcagttttcgaacacggcgatgtgcgaggtgaacgagtattcgcgcttgagattgatctgcttgaccgcctcgtaggtcagggctgatagatcaacatcacgccagctcggcagttcgtagaacaggcgctcgaaatatttggacggcgacttgccacgcccctgcttctcctgcgccgcgagcactaacaagttctgcgcacgcgaaaaggccgtgtagaacagtcgccagaagtcgaagttcttgatgtggtcgagcggctcgaagcgttccttggagaggtagccgccatcctccagcagcacgtcgagcgcgctgtactgcttgcgcggcactgcctccagtgagccgcacaccaccactggaaactccaaccccttcgactggtggatggtcaggaacgatatgcagcccttgggcgcgtactcggcttcgtcctcgtactcaccgatgccgccgtcctgaaggaagcgcaggaactggttgaacaagtcgcggatgttcttctccaggaacgaagggttcaacacgctgacgaaatgcaggtactcgaacttggtcagcagcttggaaaaggtgccgagattgcgcgccgcgcgccccttgtccacgccttgcgcagcttcttcggtgagaaaatgcgagaacagcgggaactggaatagttggtagaacaggccggagaaggcgtagtcggtgttctgcgcgagcacggcgtggcgcttggccagcggacgcgcccaatccagcaagggcttgttttccggcttgcgcagctcgtcggtgaagggcttgaagcactggtgatcgtagtagtcccagatgggcagcgtgacgccttcggcccacgcccgcaccttggggaattgagggaacaggaagatgagcgcgccgatcatcaggcggatctcctcgcgctcgaagaacatgttcgaacggggcgagaacacgggcactccctgcgcttcgaggaagcgcgccaacgccaccaccttgtcgttcttgaccgagcggaacaggaaggcgacctgattccagtctgccagcttgccggacgccttcaggccgttgagaaaggccagcacctctgcgtgccagttggtggtttctccgttgtcattgctggcggccagccgcaccgccgtgggcatctcgggaaagtcgtcctcgcacggcacgatctgcttggcgaaacggaagacgcgcgtgccgtcgtcccatacctgctccttcatccactcgttgtagaagcggatgatgtccgggtgcgagcggtagttgacggtgagcttgacctgcttgcactggtcgtcggtaaacagcgacggaaattccaagatgttacgaatggtcgcccctcgaaagcggtacaggccttggtcgtcgtcgcccaccacgcacagattcttgttctcgcccgccagcagcaggaggatgcgctcctggatggtgttggtatcctggtactcgtccaccatcaggtgggtgagcctttcgcgcagctgcgccagcacctcggggcgcttctccagcagccgcagcgcctcgtactggatgccggagaagtccagtgagttgtgctcgtgcagaagttcctggtacttggcaaagcaagtggccagggcgcatatttccagctctggggccgctgtcagcgtggtggcgtcgagcgcctcttctctgaccttgttgacccacttgagcaggttttccgactgcatccagcggcccgtctggtcgtcgcccataacgagctgggcgtcgggcagttcgcggaaatccttgatgtgctggtacagaaagtactgttggtcgaactggtcgaacagcgtgaagctgcgcttgagccaggtgaactcgcggaaatcctccagcagccgcaggcagatggagtgaaaggtgccgaggtacatctcgttcaggttgaacttgatgcccagattggtcagtcggttggaaatgcgcgtagtcagctcgcgcgcggccttgtcggtaaaggtgacgacaaacagcgactccggcgcgacgccttcctgcgtgatgagataggcgatgcgctcgaccagcgtgaaggtcttgccggagccggggcccgcgatgatgagcaccgggccgtcagtggcgaggatggcttcgagctgctgcgggttggccttggattgaaacaatggaacgaaagtagtcattccatgtgcgcgtcactatcaaactgactcttcaattgcactgttttccctgatacgcctacctgtaatggcttgcgtttgaaactggccatactcacattaaccgcaaataacagctttcatatcggcaatcccgctgccaatatacagtcgcgcaactccgctgtgcgggctggatcaagctgatttctaaatagcgccctgatttctgccggcttggcatcgaactgctcaaccatatccttaagacgatagccatggcgcatcagtgtaggctccaagtcatcgagctgtcgcgatagcacggattccatcagtgctgccgtgaccggctgttctccgatctgataaccagcctccaacgccagtgtcaggtgcaattggatttgcagcggagtccgtagtttggtggccagcaagtcaatcgcttctgccgtcaaaatagcctctgaatcagttttggtgatgctggtaccgagcaaccactgtatatattcacgctgactgccggcgatgccgtccaaggtgaagatatcagtacgatagccgatttcctccatggtcggccggcgcaggtcattgcgcaacttcggatggccggcaaggatcacagacagtctgccgccactatcttccaccacttccatcaagcgcttgaggccagtaagtgtgtttccgttcaggtcgtgcgcttcatcgacgaatagtgccaccgggcgcttgcccttcttcaccagctcctgcaattcgcgctcgcggcgctcgccttgtttgggtatctgcaccagtttgtcttgcgccagatcgtaaaaaagtgcggtgatcagcgtagccagcttgatgctgtgcttctcgaccgacagggatttagcaacggtgattcggttctcttccttgaggatttgctgcaagcgccgcaaagtgacggtcttgccgctaccgacgacaccacataccgcaatcaaccgaccttcctgaatagcgcccttgatatccttgataagctgtttatgatgctcagtttcatagtaaccaccttgatctaacggctgggtcagcccgtaatattgcattacttcaacccgcatgatcccctcctgattttttgtttcggaaatattctctaatccgtgagaggaccactctatgcatcagcgtctcggcgagcacatggtcaatgaaaaagcgatcttcggctggcagctttgccagcggggtcgctaactcattggcgatagacagttttgctgcaatggcggtagaaaatcggtattcgtgtgcggtggcatcaaatggttggtgaggcaccggcgtttcaaccgtcggtggcgtgagttgcacatcgtttccggccaaagcacttattggcaatccgatctggtcggcaagtgctcggatacgatcggcgcgttcatcggccttgccacgcttgaatgcacggtaccgatgcagcgggatcgggccggatacagggtgataagggccaaatttctcgccgtcgaactcgacatacatttcatcgtcgaacaagccccacagcaaaataacggtttcacccgccatgtttggttccagttcgtaggcagtgccaccaatagtgatgcgcgcatcaacgccgaccttacggcactccggttcacgcgcaaagcggcagaactgctcccaggtgcacatgtcgcgcaagccatccggcggcaggttggacaaccaatcttccaggcgggaatgtttctcggaacgatggttttgattgttgtagcgcagcaggtagcgcatcagccactcattggcctgcttctctgtttccggtttgtggaagtggtagagtgtttcgtgcgcctcctttaccgtgcgaaatgggcgctcgaccttacccttcgaacgcgctgtcgtgcgtgtcccatctttgccggccggagtgtgcgtttgccattcaatgtcaagcgcctgcatgacattctggaacacccggcttttggccaccggcccattatccagatagatcatctttggccgcccctgaaattggaaggtggtatcagctttggcggccatggcgttgaacagaaagcgtagtgcggactcggcatcctcgccgtacacgcaacggtattcctgaaagctaacaccgctacggtcatccaccacactgaacaacatcaaggtcggctgacccttggcggggtcgatccaatccggtttgtcgatgtgcttgagatcggacggtgacatatcgaattgccagcagtcgttgctatgctctgcctggaagcgcacggcagtcggctcgcgtaacaagtgtggtcgatcgagccgcaacacggacaaatagcgattgatggtcgggcgacgtaacagccccttgggtactttaaccagaccttgcgcagtttccacgccgcagtcttccatgagttcgatcgcccgcccagtggaaaggtgccgcccttgcttgttggtggtgcgcagcttcagtgccgcgattagttcgcagtagcgttccaattcgggttgcggcaataaacggggcttgccatggtcggcacgatgcgcggcgcggggcttctgaaagacgtgcagcgcccgatagacggttgttgcagagatgccgtacaacccggcgactgctgcaatctgagtggcacgttccgggcttttgcgcggcaagcgatcaagccgctgccgcaattgcagcagtgaatcgactgggatcgttttacgccgaccgtccatcgttggccagagcgcgataaaccgaggcacggccgatgccaagccgtcgtgcaatctccgtcgcgcccagcctctcctcggagcgaaggcgttgaacttcggcggggtcaatcgatggcttgcgcccacggtagacaccgcgcgctttggcggcagcaataccttcaagctgacgctcacgccggaggttggtttcaaattccgcgaacacgcccagcatatccaggaaagctttccctgccgcgctgcgtgtgtcaataggttgttctgtcgctttgagcgtgacaccttgcttcttcagcgtatatacgatgtcctgaagatctttgatactgcgcgcaaggcggtcgatccgtgtgacgacaagcgtatctccgcgccgcaggaaatccaacaaaacctgaagctcggtccggtcggtccgacttgttccgctcgctttctctgctcggattacctcacagccagcagcgcgtagtgcttgctcctgcagcgtaaagtcttgatcgttggtagagacacgagcatatccgtagagcgccatagaggagaatttgtctcgttagcctttagagccttaaacaatagcatgccggaaacagcaaaacaaccctattgagacacgaaaaacgtctcatcacggcgtcccattcgggtatacccaaacaagacgcccaatacgatcgtagagacaaagttcattttcacttaacgtgagcacgtcacgatgaaatgcaagccgaagctgataaatgcgagctcatttgcagatagcgtgagcatgaacagcttttcatttgcagttattgtgagccagaaaatgcgtcaaatgcgagcagagccagtttcaaacgcgagctattacacctagtatgagcggttctcctcttgatagtctgtcagcaaccctactgcgataataacaattcccatgacaacgtagaaatttcgggcaataggttcctcagcaaaaccaaggataaaaggaacggcaactaatacaggcccaacaatgcgttcgatccaaccttgcagtataaagggaatgatcttgatggtgctgacaggaaatccggaagccaatgtaaccgcaagatgaacgaaagccaatacataggcaagtatggcaggtacttggcttaggttcagcagtactggcgccagtaaaaatataatcactgtcagaaaatctaaatatccatgggtacggggcgaaattattttcattcgatgactccttgctgagtagttgataacaccggcactttatagggtgttatcaactgagtctgttagctggaaaacatttgttgactcaggagtagttccaagcctagcggggatcgattaatgacagtgctgtatcgttaacacaaatatgttcacgggtatagtcaagcatgccccggtttctgaactggttcatgatagtactaatgacagggcgactcgcgccaaccaagtctgccagttcttgttgagtaagagaaatttccaatgcatacccgtgcatgcaccgtattccaaataatttggcaagttccagaagcattacgataagccgttgttcaaccgattgagtaagaatagcgcgcaacttgcgttctatttgctgtttatgggcatataccgactcaagaatctgccatgataaattagcttgtgaggtaattaattttttaaagtcaatgtattcaagacgataaaaatcgacctttccaagcgcctgtgcgttttcttccattatttggttagtgaagtcacctacctgtaagtaaccgatgatatcgccggtttttaagagagtcagcgttaattcgtttccctgtttggtgagatgggaaagtttgacgatcccattttttatccagaaaaaacttgagcaacgatcaccttgtcgataaagaaaagctttgtcaggaaggctggccagttgaatagaagggtactcttttttccatgtttcccaggtacagctgagaaatgggttcataatttttcatatcctttttcagaagacgactgcaccaattgatgaggtatgaagcctgttgtgcatatggctcttgacagcataatatcagtactcatatgcacgaaactcgtatatgttcaatactcgtatgcaccaaagcacggtaagcatggcgactgatttcgcactgattaccgagcacggcgtgaccactctgccagaacaggcatgagagcatgcgctagatcattgagccgctggcactgtcggaaacagtatggcatgaagcggacgacgcggcagttcaggctatcaatgagtcgatcattgaagcacggcacaaccccgagacggcgcactctctgttcgcgttagcttcctacggtcggcacgatccggcatcactggaacagttacgcaccaccctcgctaaggaaggcattcccccagaatttttgtcacattacgagcccgattgaccctttgcatgccttagacagaatgacgggttaagtgacagtttttgacgatcagtaattcctgattcatactgtcacataatcgaacgtatatgtgacaggtgataaagtgcagattggctacatgcgagtatcaaaggcagacggatctcaggcaactgatttacagcgtgatgctcttatagcggcgggtgtcgatccgtcccatctttatgaagaccaggcctctggcaaacgtgaggatcgtcctggtctggcaaactgtctgaaagcgcttcggcgtggcgacacattgctgatatggaaactggacaggcttggtcgggatctgcgtcatctgatcaataccgtacacgatcttaccgcgcgtggcattggcctgaaggtattaagcgggcaaggtgcggccatcgataccacgacggctgctggaaaactggtttttggcattttcgcggctttggctgaatttgagcgggaactgattgcagaacgcaccaaagcgggcctggcttcagcccgggcacgcggaaggaaaggtggccgtccgttcaagatgactactaccaagctgcgtctggcgatggctgcaatgggtcagccagaaacaaaggtcagcgatctgtgccaggaactcggtattacacgacaaaccctgtaccgacacgtttcccccaagggagagttacgtccggacgggaaaaaattgctggacgggcaatagatcggtgaattagtcgtaaaatcggtgtagacctcttaagatctgatcttaactagattcagtcacttaagaagggtgaaaacaatgtgcagccattatgaatcaatcagagacgcaaaccgcctattgcaatattttggtgtcgaacaaccattggatatttgttttgatgtatggccgacttattgcagcacgttcattatcaagcctgatgaagtggataccggagatgaagcggtagcggcgtggatagcattatctggtcaatttggtttgttgcctcattgggcaaaagatacaacattcgggcgcaggacattcaatgcccgttcagaaaccgtttcagagaaacccagctttaaagaagcttggcgcaatggtcatcgatgcattatccctgtagaagccatttatgagcctgattggcgctcaggtaaagcggtacagactcgaattgcaagaaatgatggtgaaccaatgggaatagctggtttgtggtctacctgggggcaaggatcacaaaaaattgattcatttactatgttgaccatcaatgctgacgatcatgctctgatgaatcaattccataagccaggagaagaaaagcgcatggtagtcatattgccaaaggcatcatacaaagactggctgtcagtgccagttcacgaggctaaagtgtttctgaggcaatatccggctgataggcttggaatttcatcgtagttcaatcaaatgaggtaatttcagctctgattaacaattgatcatgctattttcatctttaataacagcatactaaagaggttattcacagaaccatccaagatttcagtggataaagagatagccgaatccaggtttctgcaaaggcgctatctcctgagagaatggagcccctcacttcaacggcagtttcctgccaggcgatacccggctgcttcagcttctttttgcgaagaaaacggaatctgattatttttggatacccggtcataactcgggcaaccgtctggcaggtgataaacgttacttttcttgttgccaataatctgcctgccggtatttatctttatcgctgattgctgactgccttgtagcccttcacgagagggtttctgatccagtacccatgttttttcccgggaaacgtaagaattatgatgtcccataagcctggcaatacgattatcacgctctcgctcccattctgtgaccggatatttgtgatcccacgccataagaatacgttgctgggttctggacatggatagtccatagcggtcgtacatataaaaggtagttcgtgccacaaatccttttactgcgtctctaggctcggttgtcttgtctttgaaatccgtgcgcgttgtgcactgtccatactggttaggcatcgtttttgaaaccatgccatacagaaagtgactgcgatccccattaacctctcctatcactggagtaagattgtggagatttgcttccattgtccggaagactggatccttatcggtgcaattctttctgcccccctgttgccagcactgacgctgatggcccatcacccaggcgggaacaatatgctcccattcaatacgggaagcccgggaggcatttctgcgcggtgtatacccacaggatgccagatcaaccctaccacctgatttacctgtccatctccatttacagccacaatatagcgtcccctgttccgattgattctgatcgtggtaaacacctcgacgtgcttgtacttttgcctcactaaaagactggggcgctgcatggaccggagaataaaaataaacgccgataatggcaaaactgaccagcagctttatcaccagattgtttctcaaatgaagtgcctcggaagttagtaatttgttgctaaatattttgtatgttgttgggacgaacccaaagaaggaaagaaaaatatcttcgtacattgcagttggcacgctactttcacctggatgagaccgatcttgccttcatcagtaatcgtcgcggcgataaactgtcttggtgtcggaaaacatgtgttttccggtattcaaattgtccaactggcggctggtgacacgactgttgggtctacccctaattaattagcctgatcagcaaataacacttgaaacgcgaagcgcgtcacgttacattatcaattaaacagagagcaaaggatacctgcttgattaggaactttaagcacaagggactagagactttttttaagaccggctcgaccaaaggtatacaggccgaacatgcagcgaaattaggccgcatcctgcgggcgctgaacgtggcacaggctccggctgaattggactttcctggttttcgactgcacccgctcaagggcgatttagccgggtactggtcaattaccgttaacaaaaattggcgggttatttttgttttcgtgggcgtcgatactgacctggttgattatctggattaccacgacaaataggagcgaaggtatggacatgatgaaccatccccaccctggcatgattttgcgcgaagaagtattaaagccgcttaatctgaccgtgggcgaggtagcagattgcttaggcatggcgcgtgcgtcgatttctcgtgtggtcaatgggcgcagcgccatcagctacgaccttgccatcaggctggaagcggcgggcgtcagtacagcccgcttttggacggcattgcagtgcgaatacgaccttgaaaaggcacggaacgcagctcaaggcgcagaactattaaaaattgtgccactgcttacgaagcacgaattaacgcagggatagaaggtgggcctgaatacttgcgatattcaggcccttgtcgcggactcatgaaggaaaacacgaaaggtcacgtgacaatcatgccatcaactctcagagaattttaagcatgattagatattatggcacattcgcgcacttgccagctcgaccattgagattaaataataatcaaaaacaattaaagagatactataataatacactcttatcacactttggtatccgaggtttaattgcggcttgttttatcggcgcaggtaaggcatgattatgagcatagattcaatgagtattgttggtcctatgggtttcaaagaattgttagcggccaacagcgttcaagatacgattatacaagccggtgacaaaggtttggttatcgccctgaaagtgggcggaaaggattttgttttagggcggcggcgcggtggcccgcgctacttttattcagttgatggcgcggcatcagtgctgattcagcacggtatcaccggcttctatgtggacacaataggctggctgccgcgaacactcaccaagaaccaaaaaaggctgtctttaccgggtggcaccagtggagacatttagaaaagcaaaagccccgtggcatcggggcttttgcaaaactcaggaacacatacttgaattgtttggcgacaattagagtatggccgccgtagaatacacgacgtaatttgctaatactattctacggccttgttccttctttgacaagtccattgcgtttttgcgcatggctggaaggagctacatggcggcagatcaacaactttccctattcgatcgggacgaagaagccagggcgtatcatgaccctgaacaggcaggttttttttctatcttggttaacgccaagggcgataagcgccaatcatcccaccggctgatcgatatgcccacggtgttgggtttaatcgacaagaaccgtgacacctggatgacgcaagccgagtttatccggccaaaccgacgtgtggttaaccttgcccgcgtcggcctactttttgccgacttggacacctaccgcaagccgtgggcctctggccgaacgccggagcagttagtagattccgtactgtaccactgcacccaagaaggcatcccccccccctcaatattggttttctcaggccgtggcatacaagccaaatggcttctcgaagggacgttgccacgacaggcattacccaggtggaacgcttgccagcgttaccttatcgaccgattggcataccttggagccgaccgccaagcgaaagatgccagtcgcgtgctgcgtgttgtacagaccgttaacgagaaaagcggggaaatctgccgagttgtccacgttcagaacgagctgaacggccagccggtacgctataactttgagtacatggctgaaatactgctgccggtagctcgctggacgattgaacagcaacgacaagagcgggagaaacgtgccattcggcgacaactcaagctgctgccaggcgacaagacggacaacttacgcggattcagtggaaggcaattagcctggcaccggcttgaggatttgcgcacgttggccgagctgcgcggaggtgtccaggaaggtgagcgtatgcagcacctattttggcgcttgaatttcttgctgctatccggtgcgactaacagcaggctgatgtactacgaagcaaaagctctgactaaagagcttgacccgaactggcaagaaaacagtaaagagctgatgacgttgtattccaaggcaaaagcctacgaggcgggcgagaaagtcagctttggcggccgcgagtacgccccgctgtacacgcccaggaatgacaccctcatcaacttgtttcagatcaccgatgacgagcaggcccagctacgcacgatcatcagccgggacatggcaaaggagcgcgacagagcgcgcaaggaggccgtcaggcgggcagcgggagcagtagaccgggaaacctacgaaagccagtctttgagccgccagaagccatgggaagcccttggtatgagccgtgcaagctggtatcgcgccggtaagcctatgcctgcgaatagtgagacaagtccatccgtattacagaagggcaatggccgctttttggtttgagacaagtccgtccgtattactaatggcgaagcctacgcccggcccgtagggcctgcttttgcgtagccctgcattgtgaaaatgcgagtagccgcaaggggggtgggtaacttgcttgcaagttatccatgccccgcgcagtgccgaaggcacggagtttttcaggatgttcaaagtccctcccctattactaatggcgaagcctggaaggtgtttgtatggccagaacaagaaaattatttccgcctgaattgctggaagagctgcgagtaatgccggtggtggccgcgctcgatgccctggggctgtactggaagcatgaccctgattttgtgccggtgaaggataaatccactgtccggctgaatgtgtccctgggcggtggtggtgtcgagctgttggctaccgggccgaagtggtacgacaccagggcagagaagggcggcggcggtgcggtcgatctggccatgcacctgctgcgcttggacttcgtgacagcggtgaagcggttccagtcaaattaatcaaaatttagccgctaaaaatctggcggctggccatcaccaaatatgaccccacagaaccgctcaagctgcacgtttgaggcggtgctaatacgttctcctaacctttccctttgaaaatgcgtctacgggccttgtaggcggcgtgtggccgttcgtctttgcgtctggttggaacgccggtggtgtcgggccgttttgtaaggttttacgcaaagaagagggaggggccgccgttatcaagtgtgggcgactaataaagtcggtaacaaattgtggtttacaaccgcaatattatgtctttccttaatcccaaggaaaaataatgttggtaacttttgtcagctatttagtaattctttaccaaaattatttaataaagttcgtaactattataaatagttatcatctttatttactggttcccaactttattcgactcagctgttaaacattgtttccgctcgcgctagtacgcgctctttggcgctattgagcatctcagaaacatagaacttctcgacatacttctcaatcacttgttctgccaccatcgtagctgtcgctggattgattgcattctttgctaactgcttcacaaacgacaagtaggtcacatttccagattttactgcacccaccagttgttcaaactcttctattgaaataatcgtgatgttctgtgggggcattctcgataattgttctttgctgggcgacataaatttagaatctagcaatatttgatcaaagaattgctcatctacccattgtttcagttgtaagccattaccaaagagcaattggcgacttgtcacgacaatcaggtaatcgttatctgcagattttgcttcactcagatcaatttcattgcttcgaagcaaagtccccactttccaaccttgaacaattgcctctcgaatacgtttaagttttgatttaacgagttggggatgatcggagagaagtacatcgtctggaaagaggctcattttagattcgataaaaacgttaccaccggcgcttggaattaatgcatccaccgccgacatcgatgaattaccgagtcgtttaaattctttgtcagtgatagggtgagttccagactctttgatgagttcaattacataatcctcgaataccttgctaaagctatccgtgtagtcttggctaaattcagacattcgaatatgtacggactcttccagtccgtgataaaaaatggtcggattccaagcaagcacccttgtttcatctaattttaagagaggatatttagccaaccatgggaattcgaatcgttcgctctccggcctgcaattaaatttatctttttctcttcgagaatgaagctctccttgaagcagaacccgcagctcacttagatccttggaaaacaatttaactagttggtacagcggctttgtcaattcctcgggtagtgctgaataaacgcgcaagtctaagggctgttggggagctgctgtttttaattgcgacattaatagaattgccgctaacataaaatcatcgggtgtcatgcaaaatacgctctcaaatcggcttcgacaggggtttgttgcgtcaagacgtgaaatcaacgcagcccaacgcaaaaatccaaaagtctcgggactttggaatattaattgcgcatgcattgttgccctcactctcagtagcacttcttgctcatttttatatgatcctagcttcgctttccagattgcgttacagcaagcatagaattcttcggtgggacaaggatctcctttatccaaatgaatcatcttgtcttctatcgctaatttgatgacaagtgcgggcaaccacggcattgcttcaagagattcttttttattctggtgctgctgagtcagatgattcactcctatataaataatcgatctcagggagtagcgttgtagccgacgcttgatgactttggccacatccgcgtaactcaatgtagagggatccggggtaaatctaataggcgtattgagagcgatagagcttgaaggtcgaggcatttgaatagtatcgctcctgatttaatatatgacaggtgcacagcggccaagcagagatagttttaacgacctgcattcagcgcgattttaagccaggagtaccgcatctatccgccccctaaaaacgaaaataactgcaaataaacccgcatttatcttcatcgaccagcattcgatctgcgcaaaccaacaataaatgcgactgttcgttaatccatgaagtcgtcggtagcgccatttattggatgtagtttttgaaccgagtttgtggaagcagttcaccacatacttccatgctgagaacaggggcatcaatgggttgtaacaaacggccgtttgttgcactgacaactgcgctctgattttcacttattcctggttataaatctcactgaatgcaggttgatccaattataaatgcaggttgttagagatagtggcaggtgaagcaactgttggtttcacccatattcagggggatattcgtgggccacatgattctaatatgactcgctatcatccttaagcgtccatccatgagactccatacaactgtcgtagaattcctggcgtaataatcctcctgcaattcccgggccaaagtcggattgacgggcatctttttcgcactggtaactatccttgcgaagatccgaggttgatgcttctggttttttccaaacctttgtgcttgaacagccagttataaatacagccaaaacaagtgtgagcaggcgctggttaatagatttattcacatttttaatccaaaaatattggcctataacaggtcttactatatagggttaaaataaagtaggtaacaccggagataatgacggactttatttaaataaatttagtaaaaatttacataatagccgataaaagttaccaactttatttccaagttaccgactttatttcgatcctacatcaagctggcccaggccgtgaccagggccgagcgggcggaaacgaaagccgatgaggttgaatgccgggctggcgatctacgcgccgaacttgaccgcgcccatcaggatgccgaccaggcgcgagtcgcgtaccaggaacagcagaaaacatcagacaagtatcttgcggagctggaaaaggcgcgggatgccgccgccgaggttgtcgcaaaaaatcggcaactggacgcagacctggccggagcagtggcatgtcaggaaggtatagggcgggagttggaagcgggcagggccgagctgttggaagccaagcagcaggcgtcagcgttgcgtgaagaagtggcccggctcaacggagcgacggcgacctataaggaaatgctggagcggttcgaggtggcggcaaaagcagcgaccagggcgagaaagcagccaaagaccgagggctgaaatggtcaacatcccgagcggctgcccctcaaatgttaatagattgcctctatgaagggtgctgtttccggggtcgctttccaggtgttcattgacacttgaggggcgggctatgccccccctcttggcgtccaattcgccccttggggcgtcaaaacaagtccgctttgttctggcatgttatcccacagcaatcgggatatctctgattttcgcagtataggaaggcgttttacgctgctggctcatagaccatgttttcttgccagtacctgtgctgccgtaaatgattgtccctcttccaaactggctattaatctggtcaattgcctgcattaactgatcggctttgtttgacatcgaggagccgaaatccagctcgatctgctgaaccgttgtagtggatagatccataagaatcacaccagcctttataaaatcatacccaggcttgtaaatcgttcttagaccgcgtatagccgccgataacaggctattagtatcagatgcagggcgtaccaatggcacagtgattgaacgagcatattgcgggccggcgcgatgtttgctggtatgtatgaataccagaattgccgaagcaaaactttgttgtctacgcagcttttctgccgcgcgtgaggtgaattctgtaaccgcttcggtaagtgatacgagatctcgtacaggctggccaaaagtacgggtgtaagcaatttctttctttggtgccgggatttcttccagatcgatgcagctttggccgtgtaactcgcgccaggtacgttccagcgttacactgaatcgttttctaactgttccaggatcaagctctacgaaatcttttactgtcttaataccagcgtccttgagctgctggccgatccgcctacctattccccagatttcaccaatatcagtgataccaaaaagatacattctctggcgttcagtgagttcaaccaggttgcaaacctgcgccaaacggggagggtagctgccgggctttcgttctgcatccttggcaatatgattggcaagcttggccagggttttactcgcgcctattccaatgcatgtaggaataccgatccattgcagaatcttggcgcgcgtatctttggcacgttgagtcacatctggaatgccttgcaagccaaggaaacactcgtcaatggaatagatttcctgggaatcgcccagctcggatgccaggctcatcatgcgattgctcatatcgccgtacagtgcgaaattggcggaaagtgaaatcaatccggcagatttctccaggtgtttaacctggaaccatggatgtcccattttaacccccagcgcttttgcttgttcgctgcgggcgattgcacagccatcgttatttgacaatacgataagtggcttattctgtaattgtggttgaaacacacgttcacaactacaataaaaattgttgccatcgatcaaggcaaataacttcatgaactaagtatccttatgcttgaaggcgtggctacggggctttgttaggtgtgaaatttccagccacgagacgtttgcggattatctctgagtctttctgtatcctgcttgctaatttcttatcttctgcagattcccaactgacaacctctagcttggtctcattgccatagcgtctttgtaaagatggagtacatgcctctgcatactggtgtgccagagtagccgattcaatgtgtgccattccggaaaatccgcaaagacgaacgtgagggccaagaaacagctcgtctttctgatcttgtgcaaacagtgaaatcggtgcaacttttggtagttgaggcttgattccataataggtaatctgccgagatgccttaatcatgtcgatcgctgttagttgtaacaaaaaaatggattaaacaaatgattcagaactgtttgatacaggaagtcacaaccccccatacttctaaggtttgaccatctttaaaaaccatatcttcatagtctggattggctgcctgtagcttggttatgccatccatcatatacaagcgcttgcacgtaaattctccatcgatgcaggcaatcacgatttttccgtgctccggattaacggctctatcaacaacgacaatatccccgtcatcgatcccggccattgccattgaatgacctttaatccgcatcaagaaagttgcttccggatgctggatcagctcgtcgctcagatcgatacgcttgagcagaaaatcatctgccgggctgggaaatccagctcggacacccgaataaagcgggataaagataggttggccgatttgaacggacacggggcggttatggtctgggattaacaagattcttgagccacttaaaaaagttcaatgcggtgatcaattattaatcactcctatcacttcctgcaacaccaataggttaagcaggttatccacagatatattcatggtttttgtggatatatacgcagatgcatacatattcattcataagctactgatttttttcaattcctgtctcgcgttttaagtcgtgaaagccgttcgcattactccatatcatttgccaattccggtcgatctgcatttggagccgccttttcccgacgcatagctacacggccattttgttcaagggaaagccccgcctgccccgtgtcctcactgcgttgcgggccgcaccagccaggcgggtccgcttggcgcccttgcacaactctgcccgctttgctgttcatgcgtcaaggcggctccaagaagcagattttaaccaggcaaaggaggaaaacatgatcaatacgaccaatcacaaccacaataacagcaaaagcaaggctcaccaagaagcaggggggaacagaaaatgagcatgggggaacgacagaatattgaacggcagattgcccgtagcgctgttaatgccttaattaaggccggttacagtgtggctgtgttcgacggcgaggaaattgctttggaggcagccagggatataggcgcaatcatggacgctatgttcagcacagacgaggattgcctgtttgccatgataaccatgaaagatggaaaaaagaagcgggtggggtgggtgagttttgtctatggtaatgctggctatgacgtaatcagcgactacacgacaaaccttgaaacagtattggccgatactacggcattgacagaacgccttgaaatgcaacgcggctaaacgaagggaaaacccattgtaaaacggagttttccagaatcgaagaaatataatcgcgttgaatgcgggttagtccagtttgaaggagtaatcacgtatttaggcgataactgtctcaagttttattctgcttgccaagattaggtcagataatatctgtctttaaacagggcggatactcccgccctgtattgaattggggtttttaccttggccaacttttttggccatgtctatcccctatagacgttagcggccgcgctgttgctgttgtggcgcttgcgttttctcgggggctttggccttgtttggccgagtctttgcaggctcttgacctttggccatatcttgcgcaaaggtacgaacgtgtttcaaaaaagtctcacgactttttgaattggtaatgttttgttctgcccatttctctgcttgtgtctgcacggtttcagctcgctgctggttatacgtcacaatatcagctttgcccctatcctggccatattcaaccttaatattggttcgtccggccttgatttcaccattgtcgaactggcgttcaagttcagggccattttcgagtattgaaagatcatgcgccacggcggaatttttaccgacttgctgaaccaggtgagtgtcgctcatcattagaacttttccggcgtattgcgcgttaggctttgccaggtagacaaagcctttacgatcagcgctgctgacaagattgcgggcggtttcccaatcaggcttgggcaaccgctccccgatgtacttaattgtatcttgtgcttctttttccatggttaccaccttatttaaattaacacccttaacgtgggcaggaacgccgccagatggcggttcggctatgccattgcgagcggtgctttgtatctcatgcaatgcatcaatcgtggacaccttcggaacgtctggcagcaagctgttcaatctatttccaccagaaagtgcagccagcatgacggcagcttgcgttgccgctgcttcattctgaagatcgtaaagtgaagcactgcctgtgccggttcgaatatcgtaaccgataagtttccaacgatgactttcggcctggtcggctgcgacttcgccgactaggtcctcataaaggctgttaaagtgggtcagtgcctttttcgcatccgtgcctacattgtctttacgctgcgcggtctgctccagaagatctagaaatcgtaaaccgatttccgcatcttcttctttgacggtcaaatcgtgattggcacgctgcacagcatataattcgccgcgattagcttgatcgcgcagcaaatttggatcgtttggaagctccatatccttgagctcggggagattgccctcactttgttgtatatccatggttattaccttaatttaattaacacccttaacgcgggcaggaacgccgccagaaggcggtacgggtaaggatcacagatacagaggccacaagtgcgctcgcaagatacgccgtaagttcctcatgaaagtacccggtaatccaggttctttgccagcatcgacaagcgcggcaacaccaacagcaagccatgcacagtaagcagcacgcgcccacatcggcatccagagtgccgccatgttgaatgccaatataaggccgaggaagtacgcaagcggaagcaggtcgccccgaggcggaatgatgttcttcataaccaggtcaaattgggtatgccgacttagcggtcaagcacacctgtatcagtagttccgaggctgtcaaacagcgcggcaaattcattaactttggcgagggctaaatcctcacaggctgcatcacgcagcgctgcatcctggggatttgggtcatcctcaaccatgtttactatatccaccagcattgaaacgctatttgtttctgcgggatgcgccaaatcgtccaattgcgaatccacatagtaatcactgcgctgaacctggccgcgatagagacgccaatttgtatttggcaatggcagcggcaaaggcaccttgcgcacttcaccgccaatagaaaccttgtgcatttcaactgccgtgaaccgacgcatgaaataatcatcttcgtaatatcggatcttgttgccgaagatgataggaatgccagagcgatgcaccaattccttttccttgtcgagctgcatcaattcttgtggcaacatcaaggcacgagaaaccagcgtatcggtttctgacttgctgtaacggccaacattcaatggcccaatgttggaatgctgcgttgattgcgcgatcgccgtaatgttccctagcatcttagaatattcttccgcctcttttacttgagatggtgtataaaaaatcttgacgcccatgttatccataatcgagtgggcatcttctttgccgtaggttgattcaagctgtgaattgttttgaataaccagtgctaggcgcatgttgtacccggccataaagccgacacccttggcgagaatttcaatttttctggcagcggtaaattcatccatcataagcaagcattgatactttaaggccgggttttgctcgggcaattctttgacgttttcattgatcaactgcgagaaaaacaggttggtaatgaattgtgcctgcatcacttccccggcagaaatgtgaatataaattgacattttacgtttgcgtatatcacgcaaatcaaagtcgtctgcactggtggctttgtccgtgaccgggctgctgaacacacccagagcagatgtgaacgtagacaggatattttttaatgtgtcgtcagagccattcaagaaccgattaattgcatctttgcactcacgtgatagtggttttgccgtgttttgcctgaccgcaatcacttcacgtagatataaggccgtgtctttgcctttacccgacgcctgacgcagaatttcgcccatggtatgcggtaagcgtggcgtttcgagtaccagcagtgctatggcaacaaaaaggttacgcgcactgtcagaccaaaaaggatcgctgcgttcaggtgtcttaaaaatgattgcggctaaagcccgcagatcattgacacgaaaaagtggattttcagaaacatatgacaggggattccagcggtgtgttgtttccgagaacgggttgaaataaaaaatctcgttgcccaggtgttttcggcgaaatgcagaagtcaggttgtagttttcccccttgatatccaacaccacggtggattcacgaaacgtaagcaaattaggaataacaaaccccacacccttgccggtacgagtaggcgcggctagcagcacaaattcataaccaggcaaatgcatcaaatcttgggcgaaacggcctaaacaaatgcccctttcggcaaatagcccctcattatcaatatcttttcgattggcaaagcggccctttccgtacacatcagggtcatgccgtcgataggccataatcatgccaaatggaatagccaggcataaaaaaaagccgacaaaataactacctataaccttaaccttctggcggtgcgtttcgatagacgcagtggcatcgaaaatcgtgtgaatattggccttcaaaggattttcatggaaagaggcatacagcaccattccagacacccaaaatgcgcaataaaccaacccaccgagcgacagcagaccaatcatcacaccgatccatttttttggggtcatatctgcaaatacggaggtttttttaggcatgatctttcccttgggcaatggcatatttgcgctgcgggttatagtcgatttctacaacacgtcgctggcctgtgtgcctatcaacttcgatttgcaccacgatatcgaccgttaaatgaatcaggcgcttgatgacgttgtaatctagcccagcacccacaggatcggatttcaccatcatcatcatctgctcgtaagccatcgcgggattttcgccgtggcagctcgtgagtgtgccgggatgcccgcttaatgcagcgcgaagaaaatacaaacactctgagccgcgcatctcggccagcaggattctgtctggcttcatccgaagacaactaagcagtgcatctttagccgacaaaaccggtgtgtcagagcccggccgcgttttggcgttgtcatagagcaaatgcactacgttaggttgtgtgaggctcaattcgtgagcatcttcgatagtaatgatgcgttcgccagggtcgattacatcgactagggctttcatcacggttgtttttccggagccagtagccccggacaaaacaatattctggcggtactgaaccgcctttgttagaaactcaatgatcttgcgcgacttcaccaaggccagcagttctttttcatgcggtttaatagtgaatgtggattgggtagtgccctgaaacataccctgttcttccatttcctttaaggaaatacgcgctcttgatggttggcgaagcgtaaacgagacatgcccgcgcagtacgccaggctccatcacaagttgtacccgagaattgtcttttaaagaaccggataagatcggataggcggcattccaaccttgtgccgaattggtataggtcgcaatagcgcccccgagcgacaacaagctgtgctgattgatctgcggcacgttgtagctatcccattggtttgtgtacacccaaaccctgccatcatcattgacggcgatttctgttacacggggatcttcgcgccattgcttgtatggggcaagatacgcctgtattgcggcgtcatcttgcaacggaacatattctgaatctggaaacaggcccgcagtgccaagattggtttccaaagatttcaaaactgttgagttcatattttaatccccgtaaacatcgtcaaaccagaggtctttgctgacataaatcataaggcgagcaccacgattcgcgctgagtgtgggcttgatattgatggtggcattcaacactttttgagaaacatttttgctggatcgagcggttgagttgccataaacggtcccgcccgaaccgcgctggcgtgctatagcaatgtctactgcatcatcaattaaagacaacagcagggccgcgcccaagcgttcagaccaatggttatcgatgaagccaccaacgcccatcgtacccacgccatcggcagcgccgctgtctacatcgatgacaaaaccgtccgtggttttaatgcgttcccataccacagcaatgcgagaatcgccgttctgcaatgtctgcccatattggccgacaacagtagagccacgcgcgacaagtaaccgcgatccatcatcggaatagatatcgtcaggaattacacacccgctttggcctggtatattgctgaagagctgcgtttgcaaaatgcatgggatatacgatccgcgcgtgataacgagcgaacgatcccctaactcagcggcacttgcctgttcggtttttgagggcatctctttccggctcgtcatacgcgcctgatcctgtactgtggcaggccggttattgttttcacccgagagcatcatgggcggtaatacaggcacgttagcgggagcgtgcccaggctggcctgctgtaccaccagccaaatgaataggcggaacactcgtcacagggccgggttgataaaagttctcgggcaattgttttggtgctggtgttgcaggttgttccggtgtcgggctggcaagaaaatcactcaggtcaaagtcacgcccccggcgttgattcgcgtttaggctggcaacggcttgtttggctgattgatctgcttcacgttcagcccgccaatcagacaatttcgtttttccgaaccagataaccaacagtaaagccacgagaaaaacaccgaacatcagtgccagggtaaataccctggagcgcaacaccccgctctttttggtttcgcccttaaattcatgtgactcttgcagtggttcctgattgaaatcttcttctttaatagcttcactcatttatgcccccttgtgttatgagacgatgtttctacggggtatccagatgatttaaagccatcgttgaaaataccgatgatggctttgtccagacgaagattccattgtttagcaattccatgtaccacaatggcaccatctttcgctttgtgaaaattagttagccattcatcacgactgccgggcgatgactcgtagatgacgggaatgtctgtattttcaggaaaataaaaatacgtgaatttgccgtcatcaaagacccgcaaaggccggatatcgacgctggtattcaccagctccatcgaataactcatgttcgcctggcgaacatggtcttgagtagcgtttctttttggttctttgggtgtgccgtaagaaaacatgactttcgaaacacggttagagcgcactgtgcccttataggccggcacaatgtcaagtacataggaatgcttgcttgttgcaacaatgattgtgccgggcttggccgtcttgagtggtgctataaaaacgcggttgccgacctttgcaatatcccagtcgatgatgccaccgcctgcaacgtcctcaacagtttccgatttgccgaattcaataacggtaggactacccacatagcccacaacacgaacgaccatattgtctgtatagcggacagtgcgaacccgagtattatcaggggccgcgctaaaatccaatccatgagcggtgagaggcagagccagggccaatgcaatcatgattcttttcattgttcaccccctatgaattcgttgtcggtttgatagcccaagacagtgaaaccaaacgggttatcaatcgcagcctgttcactaatgaacaaacgtggttcatattcatagcgaagcgtggcaactttatggactgcacgtaacttggattctgtacgtaggtcacgttgctgaaccgacagacgtaccgtggcaaatttctgaccgcccgtttccgtcagcgagatgctgatgattttaggggtgaacaggatattcttgccgaattgccgatcaagggcttgggggccgctaaaaagttcgttgtattgtttccacggcgtatcaccagcaagactcttaacggtgtcatagtcatcttgtattaagtggtagttatagcgttcacgcgcaacaacaaacttattcacccagtgtttatcggctaattcagattccgctacgtagtcctgtacggtttgaccgatagaagttgccccggtcaaattgtcaacgcgcacaacatagggcactaactgtttaagtggcatgagtacagccagggctattgtcagagcagcaaccgcgaccgcgagtacataattaagcgctgcatggcgtttcagagaattacgcaaaatggcgtttaattctgcttcccaagtaacgtcgcgcaagtcgtcgttcggggtgatatcgccgggttttttcgtgttttccttgttcatgttttttccttacaatccgcgttttgtggaataatttcggttgcgatttccggaattatcaagtctgagagaaggattaagagtcgttccgagttgaggagttgatacttttgtttgttggagagacgctgttgatctccgggtttaagcctgcgggcgcggcttttaatggaacagtctcgctcaatgtcggatgtaaaacattgatcggttgcctgacagattccttgcccgttgggtactcaagttttggtgcggaagtgcaaccagcagcaaaaagaaaaaaaagagccacctgcaaaattttcatagcgaaaattccttttaagtatgcgaaacaagaatgaggtactacatggatttattttgtgatcatgcctgttcctcgtttgacagatgcaccagactgaaatccagtgcgagcagcactgagagcagaacgatggctcaaggcagaacgggtaccactgccaatttgtgccatggtattgatacctgccattgcgtatttcatggcagaagaagaacccgctgctttacctaatcctgtttgggatgcacgaccggccatgtaacccgtaccagcgctggcaattttgctggcagcgtgggttgcttttgcagtatttgataatgcagccccggctgggttgattgcccaacgggcagcttgagctaacgacataatatttaatgcaacaccgcccgccagatcagcgccgatctgtgcacctttgaacgtcaggtaaaccaagataccgactgctaaaacagcacctaatgtttggccggtataatcaatactttctggtgactgtgcgataagtgccgccatatacccctgcataatccctagtcccaagccaacgatggcggaaatcaccacagcagtaaaaatgtacttgagtacgccgcttagccaagtattaaaaaattgggccgttccctggaaagccaaacaagcaatgaacagaggcccaagtgcaaagaaaatagccaaagcaaaatctatgacaatcatgttgatggcggcaacaaagatatacagcaccatgaaaccaatcatgaacgtgccgcctgccaaaggaacgataccggttgtatctgagccggttactccaaaatccaagtgttccagcccgtagtcaatgatttccttataaacatcagcggattgattcagaatgatatctaactgcgtataaacattcgcagttgttccactaaacaatccggtcaagccttcgcgcaattcttgcgcgataaccattacattgctggcgtaagccccccccactaaacacacagaaaatataagaaaaacgcggatggagttgaagaacatatccagtaaatgatcttggcctcctgctccgcgaatcaccttatagccctgccacatgattaagatcgtcaggccgaggagcagtaccggagtaacccacgtaatcaacgtatttggtatgccgctccatgacgcgaccatgccgagaacggtatccgcctgagttttaattacaccagccatgattttctaccttattccaagctaccaaatggttggccgttaggctttgccttgttggtatcgtccttatgatctaccttctgatcacggtgactcccgccaacctttccgaaaggacttccagtgttttcacgcactgcgcgcttaccttcttctgctctctctttcacgctctgagtttttttcttgctggtttcgtctttctgatcagggaaattaccgccaacctttccgaaaggacttccagtatttctaaggacttttcttgagtcctcgccatcacaggctgagatcagaaaagctgcaaagatggccccaatcaaaaaatgaaattttttcatctcaaactcccaaaaggacttccagtattttcacgcagtgcgcgcctaccttcttctgctctggcttttataatcaaagctgattgtgattgacgttgcgccagtgctaaattcacgagtgtctgttcgttctgtaacagcgattgctctgccgcgattcggttagaaagatcggttgcggcctttaaatcggtagcgctgtctatctgcgataccaattggtgcaattgcgcagcacgttcttgtgaggatttaagagcgttgttaatgaaaacagcgttttcaggttcggcataagcctgagcctggcattgcagcttcgcatttgaatcttgaaagcgagcgcaatccagtttttttatggtttcatagatgatccgagcatcgttgcttgcgccgccttgtcccaaggtcaaaagccggtggtagctttgtgtaaagtcagggggcagcacatggcgcgaaacattattcatgagctgacccatgccccgagaaccagtaatggagttgtattgcattctaagttgagaatattgttgctccattgccttcaattgttgtgcccactttgctatttctgccaaatgagcagtccatgatttcgatatagctgccgtgtcagttactggtatctgagcgtggacagaagccatactcaaaataccggcgacaaaaatgccagaaataatagatttaatagttttcatgattcaccatccaagaaaggttgtgcccactgcgccgggtcatccccgtacttatgccgtaagcgatcgagtcgttctacttcatcagtagaaccagaaagaatcttgatttcgtttttaaaatcacctaaatcaagacgtgccaacgatacacgatggccctgcttgatcagaaacatgcgggatgaatcctgtaattcccgaacaagtttaaattcggtttcagtgagcttgaaaccgttcacataatcatcatgatctgccgctggattcggcaagaaaatgaatgtggctgtttgttcaatcagcgcccttgcaatgtcactttgcagtgtgtcatgcgggctttgcgtcatgtaaacgccaaggccattttgcttacgaatcgttttctgcttgttcttggcaaagtccttgaaataatcgacagacaacgctttccagtattcatccatgaagaacgcaaacagacggccatcgatttgttcttccacccgatacatgagatacatcatgatcgggccacatatttcttcattatcgagaaaatccgtatagtcgaatccatacgggcgaccttcctcaaattgcaattcgtcgcgctggcaatcaagtgcccagccgagattaccgcgagagatactccattttttcaggcgctgcgctaggccattaggatcgccaacgggcaaaaattgcagcacagcatcgatacagcgctgttgtaccggcattccagcgaccgaccgtactgccgaagcaatcaggttttcttcttccggcgtatgagcgacatctgatctgcgggtgcaatatttaataagtgcaacccaaaacagaatgtttttttctgttgtttccatcttgaaaggtgcaaaccccgttggtttgccgttttcaagcgctaggtacttaccgccaacgcgacgaatagcaatttcagcaccacgatctttatcgaagaaaacgcattgtgtaccgtacttcaaaaggttcagcattaagaacaatgccaagacagttttacccccccccgattgtccgatgatctgacaattgccaagggccttgttaccggttgaatcaacgccgagaggcgtgtcatggaaattgaagtagaacggcgcaccggcaggagtacggaataatgtcaccgcttccccccaggggtttccatttcgtttgccggaatcaaaagtatgaaacgaacatacgccagtgaaattccggctactgatacgcgcttcccttggccgtgatttccaattgcacggtaactgagccgcataagccgaagcagtgaccttttccaggtcaaccccaagaaaattggcgttgtttagaagctgggatgcattacttctgaattctcgtgtttgatcgggtgtctcgcccttaaccaacaacgaataatgatattcgcccagcacaaaattaccgctgattacagaatcaatcgcctcatctatttcaacgatttgactcagtgcgttatcctcggacgatatcatttgattgcgctgttttttcaaagcgctttgtgcatcaagcgtcgtcataggagaaaaagaatgcgtctcgatgtactcgcaatccagcgcgagaagcgtgttcaaaacaccgggtgtcgtgtaatccgcgtaatctttcagttccagaaatgcgccaaattcagatccgaatgtatccctgtattcgatgatttcattgccgaataacagtcgtgaaaccggaaggtacttatacagcggcaagtttttaaccggaattctccaccagaacccattgattagatatgaataaaattcaagctgacagctaaatgttcgccccgcgaacacgtaattgcccagttgttgcgggcgatatttcgtcagggaggacataaccgttttgctgacaatctcgacgcgctcaacagctgctgcgatttcgttcttgatttcatccactgtccgatgcagctttccaaacacgccgcctctgcctagcgggaaaggccgataaaccacagtcagataaaattcactcgacatcatgccctgatcggccaatttctcataataccgtcccattaaatcctggctgaaatcgttgtactccggtacttccagcttatcgctggcgtagcgcctgatacgatgcacccaaaatgcatatttgcctgttgcaaggccacgaataaacagattcagggcttccatgcgcgaatagacttcttcctcagataatccttcaaatgacatgccctcgacacgccaggtacgcacataatcaccgttctttgtacttacaatgccatcatcgataatgcttgaaaatggcacgattcgctctagcgaatcttcctcattggcatatctgcgttgctgcgaaaatatgtcctctttctctttagttgctgtgcttttactcatttcatttccgctttttgtacgtgactggccccatgctatgggtgccccaataatgcttattggtgcgatgcccaatatcacggaaatacatgaaggtctgagccagtttaaagttatcgtccgcgttgacctggcgtagcacgactatgatgaatgccagcaaaacgaatactgcaaccgagacaaaaccggagagcaacacgaacgaccacaacgccacaaggatatgtgttccaacaatcaaaatgaacggcacgatagggatgccaaacatcattggaggtcgcgtagcacccttaaataccctgtctcgactgtccataaccttaaccgattaacataccggcaatacctgccgcaccgccaatcaaaacgcccccccaaaaaacaggcgctacgtctttccattgagcggcttggaacatcatgcgaaaaccaacaaacattaacgcaattgtcagcacgactaccccgatagacaaaagccacatcgaaacgctattgagcatcgttgtgccgcgttcaagctgcgcgaatgcgggtgaacttgccaaagccatactgattgcgaaactcttattacgcactgatttttgaagcaaaaatgccttaaagtttttattcatatttaatcctttggttgattaacatcattgatgaagtggtgttgctaacagaagaattgccagataaaagcatactggctgattgaggcttaacgactttaacgcgcacgccggtttgatccgtgttgacgttagttatcttgcctttttccgaatcggccaacgggatggcaagtgatgcggaatccatgttgaccgggttcctgggtgttgaagaaattactttgttgatatagcgggtcacatcggggtttgttttgccagcattaagtttgccggagtaatagcaactcagagccgcattggttgcgctgtattcttgtgttgcattgaatccagaaccgagcgcccaggactggcaatgttgaaaaatttcgtatgctgccacaacgttgttgcacacatcgaagcctgccttaatatcgctgtcccagcccagacgcacaaaatgggttttatttacctgcccctgtccaatgctgaagtttcgacccaggttagtcaggttatcggctgtcgcaaccgcctcggcaagattctttggttggcgcaccaagcgccctcccacaaccccaatagcaaacggattaaaccctgattcaacttgataaatctgttgcatcacgggttcgcgcagagcggcttggcaatctggaggcaaatcaatcatataaaaagtaacaaaaaaactttaccgttaacattagtattttccatgattgtccgcataaagtcaataaaaaataatactttttaatcaagaaaaaagtatacttattgaaatgtattcactgaggttgaacagactgatttcagtagcctgtatccgtgatacaagcattgcgcaaggcgcaaaaaaggcggcatagagccgccgttctttacaaacaaaagggatgttgccttgcaaggcaaggcggattacttcagtagataggccagtccaaaggccaggctgatcaacaaattgcagccaaccagcgcgcttaataaccacaggtgtttggtgaatggagaaaaacctgacgcgatggcttttgcgtttgattcggcttgtttgcttattttggcttggagtgcttctgactcgatttcaaaatcagattttgctttgttggtatggatggccagagcacgcgccatagactccatatccttgaaagcatcctgagcaatttttgccgcgttttctacgtcgccagtgacgctcttatacaactggggcaagtcttttttcaacttctcggtttcaagcaaaagtttttgtacatcgaggagcaagtcggcatggacttgctccaagattgttgatgcaggtcgctcattcattaaagagtgtcccgaagatttcatcgaaatgtttcttcacgccttttgccatgcgcccgcttgttctcaggccggaaagttcccgtaattttttcttgttttgttcttcagcgggtttggcctgaatttcttttatgcgtgcggtcacatcatccaggttggccacgacttgatccaccgtgcttttagtaagtaattcaaatacctcgttgtaatacacagttgcccagccgattcccatttccgagcagtaaccaacgatggaaggaaataaagattccggcacttcatcacgaggcacataattcagaatgactttgatttttgagccgggtataccgaactcctgcaattgcgttagcaattccaaagtatcgttttgttgcttgccatcaggcacgcagggaactacgaagtaatcaaaatcctcatgggcatcgtcaaggtcttttagtgctgtgaatgcctgctcgacgtttgatgatcctacatctacaacgacattctggtgcaaggcgatttcttcaataaccttcttgaaatgtttgccgctcactttttcgccatcgacatttgttgtgttgatgctttccacctgaatgacttcgcaatttggaagtcgaggggccagcaaatgtttcgttagcgtggacttccctacattgccagagaaattaacgactgctatcttcgtcatcgtgttttcctattccgtgtttatctaattgatcttcataagagggcgttttccatttttttaaaacgtcccttggtgaaggctgttgctccgtctctgttgacggttctgtaacactcggcttcgctttgcgacgtctagtagaaggtttcgttttttctcgttgtgttcgcggggcgaacatttcattttcgcttgtcgctgtctcgccagaagtattagggcaatcgtccgagtctttcagattctcagtgccacttaaaggcggacgagggtcaagcgctctgaattcactttcatgcttacggatttctgcgacgaaatcaacgtttcgacgcagccagcttgtgaatgacgaatacgtgcctttgtatccctgttcagccgcatatttgtgaatctctttaaacggcagccccaaataacgaaggaacactatttgtttcattatccggtgcaacccgcccgacctggttgttttggtggatttataaaaatccaatggactatttaaatcgctcatagagaccaaagacggtttagagcagaa

SEQ ID NO: 4 - protein, 271 aa, Nitrosomonas eutropha
MATTLGTSSASSVSSRGYDMSLWYDSKFYKFGLITMLLVAIFWVWYQRYFAYSHGMDSMEPEFDRVWMGLWRVHMAIMPLFALVTWGWIWKTRDTEEQLNNLDPKLEIKRYFYYMMWLGVYIFGVYWGGSFFTEQDASWHQVIIRDTSFTPSHVVVFYGSFPMYIVCGVATYLYAMTRLPLFHRGISFPLVMAIAGPLMILPNVGLNEWGHAFWFMEELFSAPLHWGFVVLGWAGLFQGGVAAQIITRYSNLTDVVWNNQSKEILNNRVVA

SEQ ID NO: 5 - DNA, 816 bp, Nitrosomonas eutropha
atggcaactacgttaggaacgagcagtgcctcatcagtctcatcaagaggctatgacatgtcactgtggtatgactccaaattttataaatttggtttaataaccatgttgttggtagcgatattctgggtatggtatcaacgttactttgcctattcacacggaatggattcaatggaaccagagtttgaccgtgtatggatgggcctgtggcgtgtgcacatggccattatgccgctgtttgcactggtaacctggggctggatctggaaaacacgtgatacagaagagcaattgaataacctggatccgaaactggaaatcaaacgctacttctactacatgatgtggctgggtgtatacatttttggtgtttactggggtggtagcttctttacggagcaagatgcctcctggcaccaggtgattattcgtgacaccagctttacaccaagtcacgtagtcgtgttttatggatcatttccgatgtacatcgtctgcggagttgcaacctatctgtatgcaatgacccgtctgccgctgtttcatcgtggaatttctttcccactggtgatggcgattgcaggtcctctgatgattctgccaaacgttggtctgaatgaatggggtcatgctttctggttcatggaagagctgttcagcgcaccgctgcattggggttttgtagtgctcggttgggctgggttattccagggtggagttgctgcccaaatcattacccgttattccaacctgactgacgtggtctggaataatcaaagcaaagaaattctgaataaccgggttgtagcttag

SEQ ID NO: 6 - protein, 276 aa, Nitrosomonas eutropha
VSIFRTEEILKAAKMPPEAVHMSRLIDAVYFPILVVLLVGTYHMHFMLLAGDWDFWMDWKDRQWWPVVTPIVGITYCSAIMYYLWVNYRQPFGATLCVVCLLIGEWLTRYWGFYWWSHYPLNFVTPGIMLPGALMLDFTMYLTRNWLVTALVGGGFFGLLFYPGNWAIFGPTHLPIVVEGTLLSMADYMGHLYVRTGTPEYVRHIEQGSLRTFGGHTTVIAAFFAAFVSMLMFAVWWYLGKVYCTAFFYVKGKRGRIVQRNDVTAFGEEGFPEGIK

SEQ ID NO: 7 - DNA, 831 bp, Nitrosomonas eutropha
gtgagtatatttagaacagaagagatcctgaaagcggccaagatgccgccggaagcggtccatatgtcacgcctgattgatgcggtttattttccgattctggttgttctgttggtaggtacctaccatatgcacttcatgttgttggcaggtgactgggatttctggatggactggaaagatcgtcaatggtggcctgtagtaacacctattgtaggcattacctattgctcggcaattatgtattacctgtgggtcaactaccgtcaaccatttggtgcgactctgtgcgtagtgtgtttgctgataggtgagtggctgacacgttactggggtttctactggtggtcacactatccactcaattttgtaaccccaggtatcatgctcccgggtgcattgatgttggatttcacaatgtatctgacacgtaactggttggtgactgcattggttgggggtggattctttggtctgctgttttacccgggtaactgggcaatctttggtccgacccatctgccaatcgttgtagaaggaacactgttgtcgatggctgactatatgggtcacctgtatgttcgtacgggtacacctgagtatgttcgtcatattgaacaaggttcattacgtacctttggtggtcacaccacagttattgcagcattcttcgctgcgtttgtatccatgctgatgtttgcagtctggtggtatcttggaaaagtttactgcacagccttcttctacgttaaaggtaaaagaggacgtatcgtgcagcgcaatgatgttacggcatttggtgaagaagggtttccagaggggatcaaataa

SEQ ID NO: 8 - protein, 421 aa, Nitrosomonas eutropha
MGIKNLYKRGMMGLCGVAVYAMAALTMTVTLDVSTVAAHGERSQEPFLRMRTVQWYDVKWGPEVTKVNENAQITGKFHLAEDWPRAAARPDFAFFNVGSPSSVYVRLSTKINGHPWFISGPLQIGRDYAFEVQLRARIPGRHHMHAMLNVKDAGPIAGPGAWMNITGSWDDFTNPLKLLTGETIDSETFNLSNGIFWHILWMSIGIFWIGIFVARPMFLPRSRVLLAYGDDLLLDPMDKKITWVLAILTLAIVWGGYRYTETKHPYTVPIQAGQSKVAPLPVAPNPVAIKITDANYDVPGRALRVSMEVTNNGDTPVTFGEFTTAGIRFVNSTGRKYLDPQYPRELVAVGLNFDDDGAIQPGETKQLRMEAKDALWEIQRLMALLGDPESRFGGLLMSWDSEGNRHINSIAGPVIPVFTKL

SEQ ID NO: 9 - DNA, 1266 bp, Nitrosomonas eutropha
atgggtatcaagaacctttataaacgtggaatgatgggactttgtggcgttgctgtttatgcaatggcggcactgaccatgacagtgacactagatgtctcaacagtagcagcccatggagaacgatcccaggaaccgtttcttcggatgcgtacagtacagtggtacgatgttaagtggggtccggaagtaaccaaagtcaatgagaatgcccaaattaccggcaaatttcacttggctgaagactggccgcgtgcggcagcaagaccggatttcgcattctttaacgtaggtagcccaagctcggtatacgtgcgtttgagtacgaagattaatggccacccatggtttatttcaggtccgctgcaaattggtcgtgactatgcgttcgaagttcagctgagagcacgtattccaggacgccatcacatgcacgccatgttaaacgttaaagatgcaggtccaattgcaggaccgggtgcatggatgaacattaccggaagctgggatgattttactaatccactcaagctgctgacaggcgaaacaattgactcagaaacattcaacctgtcaaacggtattttctggcatattctctggatgtcaattggtatattttggattggtatctttgtagcgcgtccgatgttcctgccacgtagccgggtattgctcgcttatggtgatgatctgttgctggatccgatggataagaaaatcacctgggtacttgcaatcctgaccttggctatagtatggggtggataccgctatacagaaaccaagcatccatacacagtacctatccaggctggtcaatccaaagttgcaccattaccggtagcaccaaatccggtagcaatcaaaattacagatgctaactatgacgtaccgggacgtgcactgcgtgtatcgatggaagtaaccaacaacggtgatacaccagtcacatttggtgaatttaccacagcaggtattcgtttcgttaacagtaccggccgcaagtacctggatccacagtatcctcgtgaactggttgcagtaggcttgaattttgatgatgatggtgcaattcagccaggcgagaccaagcaattgaggatggaagccaaagatgctctgtgggaaatccaacgtctgatggcgttgctgggtgacccggaaagccgttttggtggactgttaatgtcttgggattcagaaggtaatcgccatatcaacagtattgctggtccggtgattccagtctttaccaagctctaa

SEQ ID NO: 10 - protein, 271 aa, Nitrosomonas eutropha; identical to SEQ ID NO: 4

SEQ ID NO: 11 - DNA, 816 bp, Nitrosomonas eutropha; identical to SEQ ID NO: 5

SEQ ID NO: 12 - protein, 276 aa, Nitrosomonas eutropha; identical to SEQ ID NO: 6

SEQ ID NO: 13 - DNA, 831 bp, Nitrosomonas eutropha; identical to SEQ ID NO: 7

SEQ ID NO: 14 - protein, 421 aa, Nitrosomonas eutropha; identical to SEQ ID NO: 8

SEQ ID NO: 15 - DNA, 1266 bp, Nitrosomonas eutropha; identical to SEQ ID NO: 9

SEQ ID NO: 16 - protein, 274 aa, Nitrosomonas eutropha
MATNILKDKAAQQVADKPTYDKSEWFDAKYYKFGLLPILAVAVMWVYFQRTYAYSHGMDSMEPEFDRIWMGLWRVQMAALPLIALFTWGWLYKTRNTAEQLANLTPKQEIKRYFYFLMWLGVYIFAVYWGSSFFTEQDASWHQVIIRDTSFTPSHIPLFYGSFPVYIIMGVSMIIYANTRLPLYNKGWSFPLIMTVAGPLMSLPNVGLNEWGHAFWFMEELFSAPLHWGFVILAWAALFQGGLAVQIIARFSNLLDVEWNKQDRAILDDVVTAP

SEQ ID NO: 17 - DNA, 825 bp, Nitrosomonas eutropha
atggctacaaatatattaaaagacaaagctgcacagcaggttgctgataaaccaacttatgataaatccgagtggtttgatgctaaatactataaattcgggctgctacctatcttagctgtagctgtgatgtgggtttatttccagcgcacatacgcctattctcacggcatggattcaatggaaccggaatttgaccggatctggatgggcttgtggcgtgttcaaatggccgctctgcctcttatagcactttttacgtggggatggttatataaaacccgcaatactgcagaacagcttgccaatctgactccaaagcaggaaataaagcggtatttctatttcctcatgtggcttggggtctatatatttgcagtttactggggatcaagcttctttaccgagcaggacgcttcatggcaccaggtgattatcagggatacaagttttactcctagccatattcctctgttttatggttcattcccggtatacatcatcatgggagtatcgatgattatttacgccaacacccggttgccgctgtacaacaaagggtggtcattccctctgatcatgaccgtagcaggaccgttgatgagtctgcctaacgttggcctgaacgagtggggacacgccttctggttcatggaagaacttttcagcgcaccgctgcactggggcttcgtgattctggcttgggctgccctgttccagggtgggcttgcagtacagatcatagctcgcttttccaacttgcttgacgtggagtggaataaacaagacagagccatattggacgatgtcgtaactgctccttaa

SEQ ID NO: 18 - protein, 570 aa, Nitrosomonas eutropha
MRLGEYLKGMLLCAGLLLIGPVQADISTVPDETYEALKLDRSKATPKETYDALVKRYKDPAHGAGKGTMGDYWEPIALSIYMDPSTFYKPPVSPKEIAERKDCVECHSDETPVWVRAWKRSTHANLDKIRNLKPEDPLFYKKGKLEEVENNLRSMGKLGEKEALKEVGCIDCHVDINAKKKADHTKDVRMPTADVCGTCHLREFAERESERDTMIWPNGQWPDGRPSHALDYTANIETTVWAAMPQREVAEGCTMCHTNQNKCDNCHTRHEFSAAESRKPEACATCHSGVDHNNYEAYIMSKHGKLAEMNRENWNWNVRLKDAFSKGGQTAPTCAACHMEYEGEYTHNITRKTRWANYPFVPGIAENITSDWSEARLDSWVVTCTQCHSERFARSYLDLMDKGTLEGLAKYQEANAIVHKMYEDGTLTGQKTNRPNPPAPEKPGFGIFTQLFWSKGNNPASLELKVLEMAENNLAKMHVGLAHVNPGGWTYTEGWGPMNRAYVEIQDEYTKMQEMTALQARVNKLEGKKTSLLDLKGAGEKISLGGLGGGMLLAGAIALIGWRKRKQTQA

SEQ ID NO: 19 - DNA, 1713 bp, Nitrosomonas eutropha
atgagattaggggagtatttgaaggggatgctgctgtgtgcgggcctgttgttgattgggccggtacaggcggatatatcgacggtaccggatgagacgtatgaagcattgaagctggatcgcagcaaagccacgccgaaagagacctatgatgcgctggtgaagcgttacaaggatcctgcacatggtgctggcaagggcacgatgggagactactgggaaccgatagcgcttagtatctacatggacccgagcaccttttacaaaccaccggtttccccgaaagaaattgctgagcgcaaagactgcgttgaatgccactctgatgaaacgccggtttgggtaagagcatggaaacgcagcacccacgccaacctggacaaaatacgcaacctcaagccggaagatccgcttttttacaaaaaaggcaagctggaagaagttgagaacaacctgcgctccatgggcaaacttggagagaaggaagcgctcaaggaagtaggctgtattgactgtcacgttgacatcaacgccaaaaagaaagcagatcacaccaaagacgtacgcatgcctacagctgacgtttgcggaacctgtcacctgagagaatttgccgagcgtgaatccgagcgtgacaccatgatctggccgaatggccagtggcctgacggacgtccatcccacgcactggactacacagccaacattgaaaccaccgtttgggcagccatgccgcaacgtgaagtggcagaaggttgcaccatgtgccacaccaaccagaacaaatgcgacaactgccatacccgccatgaattttcggcggcagaatcccgcaaaccggaagcctgtgccacctgtcacagcggcgtggatcataataactatgaagcctacattatgtccaagcacggcaaactggctgaaatgaaccgggagaactggaactggaatgttcgtctgaaagacgccttctccaaaggaggtcagaccgcaccgacctgtgcagcctgccacatggaatacgaaggggaatatacccataacatcacccgtaagacccgctgggcaaactacccgtttgttccggggattgcagaaaacatcaccagcgactggtcagaagctcgtctggattcctgggttgtgacctgtacccaatgtcactcggaacggtttgcccgctcctacctggatctcatggacaaaggtaccctggaagggttggctaaataccaggaagccaatgccattgttcacaaaatgtatgaagacggcaccctgactggtcaaaaaaccaatcgtccgaatccaccggcgccagagaaaccgggttttggtatcttcacccaactgttctggtccaagggtaacaacccggcctcacttgaactgaaagtgctggaaatggcagaaaacaacctggccaaaatgcacgtaggactggcacacgttaatccaggtggctggacatataccgaaggttggggcccgatgaaccgtgcctatgttgaaatccaggatgaatacaccaagatgcaggaaatgacagctctgcaagcgcgtgttaacaaactggaaggtaaaaaaaccagcctgcttgacctcaagggagcgggagaaaagatctcgctgggaggactgggaggtggcatgttgctggcgggagcgattgctctgattggctggcgtaaacgtaagcaaacgcaagcttga

SEQ ID NO: 20 - protein, 570 aa, Nitrosomonas eutropha; identical to SEQ ID NO: 18

SEQ ID NO: 21 - DNA, 1713 bp, Nitrosomonas eutropha; identical to SEQ ID NO: 19

SEQ ID NO: 22 - protein, 570 aa, Nitrosomonas eutropha; identical to SEQ ID NO: 18

SEQ ID NO: 23 - DNA, 1713 bp, Nitrosomonas eutropha
atgagattaggggagtatttgaaggggatgctgctgtgtgcgggcctgttgttgattgggccggtacaggcggatatatcgacggtaccggatgagacgtatgaagcattgaagctggatcgcagcaaagccacgccgaaagagacctatgatgcgctggtgaagcgttacaaggatcctgcgcatggtgctggcaagggcacgatgggagactactgggaaccgatagcgcttagtatctacatggacccgagcaccttttacaaaccaccggtttccccgaaagaaattgctgagcgcaaagactgcgttgaatgccactctgatgaaacgccggtttgggtaagagcatggaaacgcagcacccacgccaacctggacaaaatacgcaacctcaagccggaagatccgcttttttacaaaaaaggcaagctggaagaagttgagaacaacctgcgctccatgggcaaacttggagagaaggaagcgctcaaggaagtaggctgtattgactgtcacgttgacatcaacgccaaaaagaaagcagatcacaccaaagacgtacgcatgcctacagctgacgtttgcggaacctgtcacctgagagaatttgccgagcgtgaatccgagcgtgacaccatgatctggccgaatggccagtggcctgacggacgtccatcccacgcactggactacacagccaacattgaaaccaccgtttgggcagccatgccgcaacgtgaagtggcagaaggttgcaccatgtgccacaccaaccagaacaaatgcgacaactgccatacccgccatgaattttcggcggcagaatcccgcaaaccggaagcctgtgccacctgtcacagcggcgtggatcataataactatgaagcctacattatgtccaagcacggcaaactggctgaaatgaaccgggagaactggaactggaatgttcgtctgaaagacgccttctccaaaggaggtcagaccgcaccgacctgtgcagcctgccacatggaatacgaaggggaatatacccataacatcacccgtaagacccgctgggcaaactacccgtttgttccggggattgcagaaaacatcaccagcgactggtcagaagctcgtctggattcctgggttgtgacctgtacccaatgtcactcggaacggtttgcccgctcctacctggatctcatggacaaaggtaccctggaagggttggctaaataccaggaagccaatgccattgttcacaaaatgtatgaagacggcaccctgactggtcaaaaaaccaatcgtccgaatccaccggcgccagagaaaccgggttttggtatcttcacccaactgttctggtccaagggtaacaacccggcctcacttgaactgaaagtgctggaaatggcagaaaacaacctggccaaaatgcacgtaggactggcacacgttaatccaggtggctggacatataccgaaggttggggcccgatgaaccgtgcctatgttgaaatccaggatgaatacaccaagatgcaggaaatgacagctctgcaagcgcgtgttaacaaactggaaggtaaaaaaaccagcctgcttgacctcaagggagcgggagaaaagatctcgctgggaggactgggaggtggcatgttgctggcgggagcgattgctctgattggctggcgtaaacgtaagcaaacgcaagcttga

SEQ ID NO: 24 - protein, 235 aa, Nitrosomonas eutropha
MKIIIACGLVAAALFTLTSGQSLAADAPFEGRKKCSSCHKPQAQSWKHTAHAKAMESLKPNVKVEAKQKAKLDPTKDYTQDKDCVGCHVDGFGQKGGYTIDSPKPMLTGVGCESCHGPGRKYRGDHRKAGQAFEKSGKKAPRKTLASKGQDFNFEERCSACHLNYEGSPWKGAKPPYTPYTPEVDPKYTFKFDEMVKDVKAMHEHYKLDGVFDGEPKFKFHDEFQANAKTAKKGK

SEQ ID NO: 25 - DNA, 708 bp, Nitrosomonas eutropha
atgaaaataataatagcctgcggactggttgctgcagccctgttcaccctgacaagtgggcagagtctggcagcggatgctccgtttgaaggtcggaaaaagtgcagttcctgtcacaaaccacaagcccagtcgtggaaacatactgcccacgccaaggcgatggaatcgctcaagcccaatgtcaaagtggaagccaaacaaaaagccaaactggatcctaccaaggactacacccaggacaaagactgcgtaggttgccacgtggatggatttggccagaaaggcggctacacgatagactcccccaaacccatgctgactggcgtaggctgtgaatcctgccacgggcctggacgtaaataccggggagatcaccgcaaggccgggcaagcatttgagaaatcgggcaaaaaagcgccgcgcaagaccctggcaagcaaggggcaagactttaattttgaagaacgttgcagcgcctgccatctgaactatgaagggtcaccctggaaaggagcaaaacctccctataccccgtatacaccggaagtggatccgaaatacaccttcaagtttgacgagatggtaaaagacgtcaaagccatgcacgagcattacaaactggatggcgtatttgacggagagcctaaattcaagttccatgacgaattccaggccaacgctaaaactgccaaaaaaggaaaatag

SEQ ID NO: 26 - protein, 235 aa, Nitrosomonas eutropha; identical to SEQ ID NO: 24

SEQ ID NO: 27 - DNA, 708 bp, Nitrosomonas eutropha
atgaaaataataatagcctgcggactggttgctgcagccctgttcaccctgacaagtgggcagagtctggcagcggatgctccgtttgaaggtcggaaaaagtgcagttcctgtcacaaaccacaagcccagtcgtggaaacatactgcccacgccaaggcgatggaatcgctcaagcccaatgtcaaagtggaagccaaacaaaaagccaaactggatcctaccaaggactacacccaggacaaagactgcgtaggttgccacgtggatggatttggccagaaaggcggctacacgatagactcccccaaacccatgctgactggcgtaggctgtgaatcctgccacgggcctggacgtaaataccggggagatcaccgcaaggctgggcaagcatttgagaaatcgggcaaaaaagcgccgcgcaagaccctggcaagcaaggggcaagactttaattttgaagaacgttgcagcgcctgccatctgaactatgaagggtcaccctggaaaggagcaaaacctccctataccccgtatacaccggaagtggatccgaaatacaccttcaagtttgacgagatggtaaaagacgtcaaagccatgcacgagcattacaaactggatggcgtatttgacggagagcctaaattcaagttccatgacgaattccaggccaacgctaaaactgccaaaaaaggaaaatag

SEQ ID NO: 28 - protein, 235 aa, Nitrosomonas eutropha; identical to SEQ ID NO: 24

SEQ ID NO: 29 - DNA, 708 bp, Nitrosomonas eutropha; identical to SEQ ID NO: 27

SEQ ID NO: 30 - protein, 239 aa, Nitrosomonas eutropha
MTRLQKGSIGTLLTGALLGIALVAVVFGGEAALSTEEFCTSCHSMSYPQSELKESTHYGALGVNPTCKDCHIPQGIENFHLAVATHVVDGARELWLEMVNDYSTLEKFNERRLEMAHDARMNLKKWDSITCRTCHVKPAPPGESAQAEHKKMETEGATCIDCHQNLVHEEAPMTDLNASLAAGKLVLKPEEGDGDDDDDVDVDDEEEDEEVEVEVEETETADDSDSASSSNHDDDSDDE

SEQ ID NO: 31 - DNA, 720 bp, Nitrosomonas eutropha
atgactagactgcaaaaaggatcaattggtactttactgacaggagctctgctgggaatagcattggtggctgtggtttttggtggggaagctgcgttatcgaccgaagagttttgtaccagctgtcattccatgtcatacccacagagtgaattaaaagaatccacccactatggtgcattgggggttaatccgacttgtaaagactgtcatattccacaagggatagaaaatttccacctggcagtagcaactcacgtggttgatggtgccagagaactttggttggagatggtcaatgactactccaccctggagaagttcaacgaaagaagattggaaatggcgcatgatgcccggatgaacctcaagaaatgggacagcatcacctgccgtacctgtcatgtaaaaccagctcctccgggagaaagcgcccaggcggaacataagaaaatggaaacggaaggagcaacctgcatagactgtcatcagaatctggtgcatgaagaagcgccgatgacagatttgaatgcaagtcttgctgcaggcaagctggtattaaagccagaagagggtgacggtgacgatgacgatgacgttgacgttgatgacgaggaggaggatgaagaagtcgaggtggaagttgaagaaactgaaacagctgacgacagcgactccgcttcctccagcaaccatgatgacgatagtgatgatgagtaa

SEQ ID NO: 32 - protein, 239 aa, Nitrosomonas eutropha
MTRLQKGSIGTLLTGALLGIALVAVVFGGEAALSTEEFCTSCHSMSYPQSELKESTHYGALGVNPTCKDCHIPQGIENFHLAVATHVVDGARELWLEMVNDYSTLEKFNERRLEMAHDARMNLKKWDSITCRTCHVKPAPPGESAQAEHKKMETEGATCIDCHQNLVHEEAPMTDLNASLAAGKLVLKPEEGDDDDDDDVDVDDEEEDEEVEVEVEETETADDSDSASSSNHDDDSDDE

SEQ ID NO: 33 - DNA, 720 bp, Nitrosomonas eutropha
atgactagactgcaaaaaggatcaattggcactttactgacaggagctctgctgggaatagcattggtggctgtggtttttggtggggaagctgcgttatcgaccgaagagttttgtaccagctgtcattccatgtcatacccacagagtgaattaaaagaatccacccactatggtgcattgggggttaatccgacttgtaaagactgtcatattccacaagggatagaaaatttccacctggcagtagcaactcacgtggttgatggtgccagagaactttggttggagatggtcaatgactactccaccctggagaagttcaacgaaagaagattggaaatggcgcatgatgcccggatgaacctcaagaaatgggacagcatcacctgccgtacctgtcatgtaaaaccagctcctccgggagaaagcgcccaggcggaacataagaaaatggaaacggaaggagcaacctgcatagactgtcatcagaatctggtgcatgaagaagcgccgatgacagatttgaatgcaagtcttgctgcaggcaagctggtattaaagccagaagagggtgacgatgacgatgacgatgacgttgacgttgatgacgaggaggaggatgaagaagtcgaggtggaagttgaagaaactgaaacagctgacgacagcgactccgcttcctccagcaaccatgatgacgatagtgatgatgagtaa

SEQ ID NO: 34 - protein, 271 aa, Nitrosomonas eutropha; identical to SEQ ID NO: 4

SEQ ID NO: 35 - DNA, 816 bp, Nitrosomonas eutropha
atggcaactacgttaggaacgagcagtgcctcatcagtctcatcaagaggctatgacatgtcactgtggtatgactccaaattttataaatttggtttaataaccatgttgttggtagcgatattctgggtatggtatcaacgttactttgcctattcacacggaatggattcaatggaaccagagtttgaccgtgtatggatgggcctgtggcgtgtgcacatggccattatgccgctgtttgcactggtaacctggggctggatctggaaaacacgtgatacagaagagcaattgaataacctggatccgaaactggaaatcaaacgctacttctactacatgatgtggctgggtgtatacatttttggtgtttactggggtggtagcttctttacggagcaagatgcctcctggcaccaggtgattattcgtgacaccagctttacaccaagtcacgtagtcgtgttttatggatcatttccgatgtacatcgtctgcggagttgcaacctatctgtatgcaatgacccgtctgccgctgtttcatcgtggaatttctttcccgctggtgatggcgattgcaggtcctctgatgattctgccaaacgttggtctgaatgaatggggtcatgctttctggttcatggaagagctgttcagcgcaccgctgcattggggttttgtagtgctcggttgggctggattattccagggtggagttgctgcccaaatcattacccgttattccaacctgactgacgtggtctggaataatcaaagcaaagaaattctgaataaccgggttgtagcttag

SEQ ID NO: 36 - protein, 276 aa, Nitrosomonas eutropha
MSIFRTEEILKAAKMPPEAVHMSRLIDAVYFPILVVLLVGTYHMHFMLLAGDWDFWMDWKDRQWWPVVTPIVGITYCSAIMYYLWVNYRQPFGATLCVVCLLIGEWLTRYWGFYWWSHYPLNFVTPGIMLPGALMLDFTMYLTRNWLVTALVGGGFFGLMFYPGNWPIFGPTHLPIVVEGTLLSMADYMGHLYVRTGTPEYVRHIEQGSLRTFGGHTTVIAAFFAAFVSMLMFAVWWYLGKVYCTAFFYVKGKRGRIVQRNDVTAFGEEGFPEGIK

SEQ ID NO: 37 - DNA, 831 bp, Nitrosomonas eutropha
gtgagtatatttagaacagaagagatcctgaaagcggccaagatgccgccggaagcggtccatatgtcacgcctgattgatgcggtttattttccgattctggttgttctgttggtaggtacctaccatatgcatttcatgttgttggcaggtgactgggatttctggatggactggaaagatcgtcaatggtggcctgtagtaacacctattgtgggcattacctattgctcggcaattatgtattacctgtgggtcaactaccgtcaaccatttggtgcgactctgtgcgtagtgtgtttgctgataggtgagtggctgacacgttactggggtttctactggtggtcacactatccactcaattttgtaaccccaggtatcatgctcccgggtgcattgatgttggatttcacaatgtatctgacacgtaactggttggtgactgcattggttggaggtggattctttggcctgatgttttacccgggtaactggccaatctttggcccgacccatctgccaatcgttgtagaaggaacactgttgtcgatggctgactacatgggtcatctgtatgttcgtacgggtacacctgagtatgttcgtcatattgaacaaggttcattacgtacctttggtggtcacaccacagttattgcagcattcttcgctgcgtttgtatccatgctgatgtttgcagtctggtggtatcttggaaaagtttactgcacagccttcttctacgttaaaggtaaaagaggacgtatcgtacagcgcaatgatgttacggcatttggtgaagaagggtttccagaggggatcaaataa

SEQ ID NO: 38 - protein, 421 aa, Nitrosomonas eutropha
MGIKNLYKRGMMGLCGVAVYAMAALTMTVTLDISTVAAHGERSQEPFLRMRTVQWYDVKWGPEVTKVNENAQITGKFHLAEDWPRAAARPDFAFFNVGSPSSVYVRLSTKINGHPWFISGPLQIGRDYAFEVQLRARIPGRHHMHAMLNVKDAGPIAGPGAWMNVTGSWDDFTNPLKLLTGETIDSETFNLSNGIFWHILWMSIGIFWIGIFVARPMFLPRSRVLLAYGDDLLLDPMDKKITWVLAILTLAIVWGGYRYTETKHPYTVPIQAGQSKVAPLPVAPNPVAIKITDANYDVPGRALRVSMEVTNNGDTPVTFGEFTTAGIRFVNSTGRKYLDPQYPRELVAVGLNFDDDGAIQPGETKQLRMEAKDALWEIQRLMALLGDPESRFGGLLMSWDSEGNRHINSIAGPVIPVFTKL

SEQ ID NO: 39 - DNA, 1266 bp, Nitrosomonas eutropha
atgggtatcaagaacctttataaacgtggaatgatgggactttgtggcgttgctgtttatgcaatggcggcactgaccatgacagtgacactagatatctcaacagtagcagcccatggagaacgatcccaggaaccgtttcttcggatgcgtacagtacagtggtacgatgttaaatggggtccggaagtaaccaaagtcaatgagaatgcccaaattaccggcaaatttcatttggctgaagactggccgcgtgcggcagcaagaccggatttcgcattctttaacgtaggtagcccaagttcggtatacgtgcgtttgagtacgaagattaatggccacccatggtttatttcaggtccgctgcaaattggtcgtgactatgcgttcgaagttcagctgagagcacgtattccaggacgccatcacatgcacgccatgttaaacgttaaagatgcaggtccaattgcaggaccgggtgcatggatgaacgttaccggaagctgggatgattttactaatccactcaagctgctgacaggcgaaacaattgactcggaaacattcaacctgtcaaacggtattttctggcatattctctggatgtcaattggtatattctggattggtatctttgtagcgcgtccgatgttcctgccacgtagccgggtattgctcgcttatggtgatgatctgttgctggatccgatggataagaaaatcacctgggtacttgcaatcctgaccttggcgatagtatggggtggataccgctatacagaaaccaagcatccatacacagtacctatccaggctggtcaatccaaagttgcaccattaccggtagcaccaaatccggtagcaatcaaaattacagatgctaactatgacgtaccgggacgtgcactgcgtgtatcaatggaagtaaccaacaacggtgatacaccagttacatttggtgaatttaccacagcaggtattcgtttcgttaacagtaccggccgcaagtacctggatccacagtatcctcgtgaactggttgcagtaggcttgaattttgatgatgatggtgcaattcagccaggcgagaccaagcaattgaggatggaagccaaagatgctctgtgggaaatccaacgtctgatggcgttgctgggtgacccggaaagccgttttggcggactgttaatgtcttgggattcagaaggtaatcgccatatcaacagtattgctggtccggtgattccagtctttaccaagctctaa

SEQ ID NO: 40 - protein, 271 aa, Nitrosomonas eutropha; identical to SEQ ID NO: 4

SEQ ID NO: 41 - DNA, 816 bp, Nitrosomonas eutropha; identical to SEQ ID NO: 35

SEQ ID NO: 42 - protein, 276 aa, Nitrosomonas eutropha; identical to SEQ ID NO: 36

SEQ ID NO: 43 - DNA, 831 bp, Nitrosomonas eutropha; identical to SEQ ID NO: 37

SEQ ID NO: 44 - protein, 421 aa, Nitrosomonas eutropha; identical to SEQ ID NO: 38

SEQ ID NO: 45 - DNA, 1266 bp, Nitrosomonas eutropha
atgggtatcaagaacctttataaacgtggaatgatgggactttgtggcgttgctgtttatgcaatggcggcactgaccatgacagtgacactagatatctcaacagtagcagcccatggagaacgatcccaggaaccgtttcttcggatgcgtacagtacagtggtacgatgttaaatggggtccggaagtaaccaaagtcaatgagaatgcccaaattaccggcaaatttcatttggctgaagactggccgcgtgcggcagcaagaccggatttcgcattctttaacgtaggtagcccaagttcggtatacgtgcgtttgagtacgaagattaatggccacccatggtttatttcaggtccgctgcaaattggtcgtgactatgcgttcgaagttcagctgagagcacgtattccaggacgccatcacatgcacgccatgttaaacgttaaagatgcaggtccaattgcaggaccgggtgcatggatgaacgttaccggaagctgggatgattttactaatccactcaagctgctgacaggcgaaacaattgactcggaaacattcaacctgtcaaacggtattttctggcatattctctggatgtcaattggtatattctggattggtatctttgtagcgcgtccgatgttcctgccacgtagccgggtattgctcgcttatggtgatgatctgttgctggatccgatggataagaaaatcacctgggtacttgcaatcctgaccttggcgatagtatggggtggataccgctatacagaaaccaagcatccatacacagtacctatccaggctggtcaatccaaagttgcaccattaccggtagcaccaaatccggtagcaatcaaaattacagatgctaactatgacgtaccgggacgtgcactgcgtgtatcaatggaagtaaccaacaacggtgatacaccagttacatttggtgaatttaccacagcaggtattcgtttcgttaacagtaccggccgtaagtacctggatccacagtatcctcgtgaactggttgcagtaggcttgaattttgatgatgatggtgcaattcagccaggcgagaccaagcaattgaggatggaagccaaagatgctctgtgggaaatccaacgtctgatggcgttgctgggtgacccggaaagccgttttggcggactgttaatgtcttgggattcagaaggtaatcgccatatcaacagtattgctggtccggtgattccagtctttaccaagctctaa

SEQ ID NO: 46 - protein, 274 aa, Nitrosomonas eutropha
MATNILKDKAAQQVADKPTYDKSEWFDAKYYKFGLLPILAVAVMWVYFQRTYAYSHGMDSMEPEFDRIWMGLWRVQMAVLPLIALFTWGWLYKTRNTAEQLANLTPKQEIKRYFYFLMWLGVYIFAVYWGSSFFTEQDASWHQVIIRDTSFTPSHIPLFYGSFPVYIIMGVSMIIYANTRLPLYNKGWSFPLIMTVAGPLMSLPNVGLNEWGHAFWFMEELFSAPLHWGFVILAWAALFQGGLAVQIIARFSNLLDVEWNKQDRAILDDVITAP

SEQ ID NO: 47 - DNA, 825 bp, Nitrosomonas eutropha
atggctacaaatatattaaaagacaaagctgcacagcaggttgctgataaaccaacttatgataaatccgagtggtttgatgctaaatactataaattcgggctgctacctatcttagctgtagctgtgatgtgggtttatttccagcgcacatacgcctattctcacggcatggattcaatggaaccggaatttgaccggatctggatgggcttgtggcgtgttcaaatggctgttctgcctctcatagcactttttacttggggatggttatataaaacccgcaatactgcggaacagctcgccaatctgactccaaagcaggaaataaagcggtatttctatttcctcatgtggcttggggtctatatatttgcagtttactggggatcaagcttctttaccgagcaggacgcttcatggcaccaggtgattatcagggatacaagttttactcctagccatattcctctgttttatggttcattcccggtatacatcatcatgggagtatcaatgattatttacgccaacacccggttgccgctgtacaacaaagggtggtcattccctctgatcatgaccgtagcaggaccgttgatgagtctgcctaacgttggcctgaacgagtggggacacgccttctggttcatggaagaacttttcagcgcaccgctgcactggggcttcgtgattctggcttgggctgccctgttccagggtgggcttgcagtacagatcatagctcgcttttccaacttgcttgacgtggagtggaataagcaagacagagccatattggacgatgtcataactgctccttaa

SEQ ID NO: 48 - protein, 570 aa, Nitrosomonas eutropha
MRLGEYLKGMLLCAGLLLIGPVQADISTVPDETYEALKLDRSKATPKETYDALVKRYKDPAHGAGKGTMGDYWEPIALSIYMDPNTFYKPPVSPKEIAERKDCVECHSDETPVWVRAWKRSTHANLDKIRNLKPEDPLFYKKGKLEEVENNLRSMGKLGEKEVLKEVGCIDCHVDINAKKKADHTKDVRMPTADVCGTCHLREFAERESERDTMIWPNGQWPDGRPSHALDYTANIETTVWAAMPQREVAEGCTMCHTNQNKCDNCHTRHEFSAAESRKPEACATCHSGVDHNNYEAYIMSKHGKLAEMNRGNWNWNVRLKDAFSKGGQTAPTCAACHMEYEGEYTHNITRKTRWANYPFVPGIAENITSDWSEARLDSWVVTCTQCHSERFARSYLDLMDKGTLEGLAKYQEANAIVHKMYEDGTLTGQKTNRPNPPAPEKPGFGIFTQLFWSKGNNPASLELKVLEMAENNLAKMHVGLAHVNPGGWTYTEGWGPMNRAYVEIQDEYTKMQEMTALQARVNKLEGKKTSLLDLKGAGEKISLGGLGGGMLLAGAIALIGWRKRKQTQA

SEQ ID NO: 49 - DNA, 1713 bp, Nitrosomonas eutropha
atgagattaggggagtatttgaaggggatgctgctgtgtgcgggcctgttgttgattgggccggtacaggcggatatatcgacggtgccggatgagacgtatgaagcattgaagctggatcgcagcaaagccacgccgaaagagacctatgatgcgctggtgaagcgttacaaggatcctgcacatggtgctggcaagggcacgatgggagactactgggaaccgatagcgcttagtatctacatggacccgaacaccttttacaaaccaccggtttccccgaaagaaattgctgagcgcaaagactgcgttgaatgccactctgatgaaacgccggtttgggtaagagcatggaaacgcagtacccatgccaacctggacaaaatacgcaacctcaagccggaagatccgcttttttacaaaaaaggcaagctggaagaagttgagaacaacctgcgctccatgggcaaactaggagagaaggaagtgctcaaggaagtaggctgtattgactgtcacgttgacatcaacgccaaaaagaaggcagatcacaccaaagacgtacgcatgcctacagctgacgtttgcggaacctgtcacctgagagaatttgccgagcgtgaatccgagcgtgacaccatgatctggccgaatggccagtggcctgacggacgtccatcccacgccctggactacacagccaacattgaaaccaccgtttgggcagccatgccgcaacgtgaagtggcagaaggttgcaccatgtgccacaccaaccagaacaaatgcgacaactgtcatacccgccatgaattttcggcggcagaatcccgcaaaccggaagcctgtgccacctgtcacagcggcgtggatcataataactatgaagcctacattatgtccaagcatggcaaactggctgaaatgaaccggggaaactggaactggaatgttcgtctgaaagacgccttctccaaaggaggtcagaccgcaccgacctgtgcagcctgccacatggaatacgaaggggaatatacccataacatcacccgtaagacccgctgggcaaactacccgtttgttccggggattgcagaaaacatcaccagcgactggtcagaagctcgtctggattcctgggttgtgacctgtacccaatgtcactcggaacggtttgcccgctcctacctggatctcatggacaaaggtaccctggaagggctggctaaataccaggaagccaatgccattgttcacaaaatgtatgaagacggcaccctgactggtcaaaaaaccaatcgtccgaatccaccggcgccagagaaaccgggttttggtatcttcacccaactgttctggtccaagggtaacaacccggcctcacttgaactgaaagtgctggaaatggcagaaaacaatctggccaaaatgcacgtaggactggcacacgttaatccaggtggctggacttataccgaaggttggggtccgatgaaccgtgcctatgttgaaatccaggatgaatacaccaagatgcaggaaatgacagctctgcaagcgcgtgttaacaaactggaaggtaaaaaaaccagcctgcttgacctcaagggagcgggagaaaagatctcgctgggaggactgggaggtggaatgttgctggcgggagcgattgctctgattggctggcgtaaacgtaagcaaacgcaagcttga

SEQ ID NO: 50 - protein, 570 aa, Nitrosomonas eutropha
MRLGEYLKGMLLCAGLLLIGPVQADISTVPDETYEALKLDRSKATPKETYDALVKRYKDPAHGAGKGTMGDYWEPIALSIYMDPNTFYKPPVSPKEIAERKDCVECHSDETPVWVRAWKRSTHANLDKIRNLKPEDPLFYKKGKLEEVENNLRSMGKLGEKEALKEVGCIDCHVDINAKKKADHTKDVRMPTADVCGTCHLREFAERESERDTMIWPNGQWPDGRPSHALDYTANIETTVWAAMPQREVAEGCTMCHTNQNKCDNCHTRHEFSAAESRKPEACATCHSGVDHNNYEAYIMSKHGKLAEMNRGNWNWNVRLKDAFSKGGQTAPTCAACHMEYEGEYTHNITRKTRWANYPFVPGIAENITSDWSEARLDSWVVTCTQCHSERFARSYLDLMDKGTLEGLAKYQEANAIVHKMYEDGTLTGQKTNRPNPPAPEKPGFGIFTQLFWSKGNNPASLELKVLEMAENNLAKMHVGLAHVNPGGWTYTEGWGPMNRAYVEIQDEYTKMQEMTALQARVNKLEGKKTSLLDLKGAGEKISLGGLGGGMLLAGAIALIGWRKRKQTQA

SEQ ID NO: 51 - DNA, 1713 bp, Nitrosomonas eutropha
atgagattaggggagtatttgaaggggatgctgctgtgtgcgggcctgttgttgattgggccggtacaggcggatatatcgacggtgccggatgagacgtatgaagcattgaagctggatcgcagcaaagccacgccgaaagagacctatgatgcgctggtgaagcgttacaaggatcctgcacatggtgctggcaagggcacgatgggagactactgggaaccgatagcgcttagtatctacatggacccgaacaccttttacaaaccaccggtttccccgaaagaaattgctgagcgcaaagactgcgttgaatgccactctgatgaaacgccggtttgggtaagagcatggaaacgcagcacccacgccaacctggacaaaatacgcaacctcaagccggaagatccgcttttttacaaaaaaggcaagctggaagaagttgagaacaacctgcgctccatgggcaaactaggagagaaggaagcgctcaaggaagtaggctgtattgactgtcacgttgacatcaacgccaaaaagaaggcagatcacaccaaagacgtacgcatgcctacagctgacgtttgcggaacctgtcacctgagagaatttgccgagcgtgaatccgagcgtgacaccatgatctggccgaatggccagtggcctgacggacgtccatcccacgcactggactacacagccaacattgaaaccaccgtttgggcagccatgccgcaacgtgaagtggcagaaggttgcaccatgtgccacaccaaccagaacaaatgcgacaactgccatacccgccatgaattttcggcggcagaatcccgcaaaccggaagcctgtgccacctgtcacagcggcgtggatcataataactatgaagcctacattatgtccaagcatggcaaactggctgaaatgaaccggggaaactggaactggaatgttcgtctgaaagacgccttctccaaaggaggtcagaccgcaccgacctgtgcagcctgccacatggaatacgaaggggaatatacccataacatcacccgtaagacccgctgggcaaactacccgtttgttccggggattgcagaaaacatcaccagcgactggtcagaagctcgtctggattcctgggttgtgacctgtacccaatgtcactcggaacggtttgcccgctcctacctggatctcatggacaaaggtaccctggaagggctggctaaataccaggaagccaatgccattgttcacaaaatgtatgaagacggcaccctgactggtcaaaaaaccaatcgtccgaatccaccggcgccagagaaaccaggttttggtatcttcacccaactgttctggtccaagggtaacaacccggcctcacttgaactgaaagtgctggaaatggcagaaaacaatctggccaaaatgcacgtaggactggcacacgttaatccaggtggctggacatataccgaaggttggggcccgatgaaccgtgcctatgttgaaatccaggatgaatacaccaagatgcaggaaatgacagctctgcaagcgcgtgttaacaaactggaaggtaaaaaaaccagcctgcttgacctcaagggagcgggagaaaagatctcgctgggaggactgggaggtggaatgttgctggcgggagcgattgctctgattggctggcgtaaacgtaagcaaacgcaagcttga

SEQ ID NO: 52 - protein, 570 aa, Nitrosomonas eutropha; identical to SEQ ID NO: 50

SEQ ID NO: 53 - DNA, 1713 bp, Nitrosomonas eutropha
atgagattaggggagtatttgaaggggatgctgctgtgtgcgggcctgttgttgattgggccggtacaggcggatatatcgacggtgccggatgagacgtatgaagcattgaagctggatcgcagcaaagccacgccgaaagagacctatgatgcgctggtgaagcgttacaaggatcctgcacatggtgctggcaagggcacgatgggagactactgggaaccgatagcgcttagtatctacatggacccgaacaccttttacaaaccaccggtttccccgaaagaaattgctgagcgcaaagactgcgttgaatgccactctgatgaaacgccggtttgggtaagagcatggaaacgcagcacccacgccaacctggacaaaatacgcaacctcaagccggaagatccgcttttttacaaaaaaggcaagctggaagaagttgagaacaacctgcgctccatgggcaaacttggagagaaggaagcgctcaaggaagtaggctgtattgactgtcacgttgacatcaacgccaaaaagaaagcagatcacaccaaagacgtacgcatgcctacagctgacgtttgcggaacctgtcacctgagagaatttgccgagcgtgaatccgagcgtgacaccatgatctggccgaatggccagtggcctgacggacgtccatcccacgccctggactacacagccaacattgaaaccaccgtttgggcagccatgccgcaacgtgaagtggcagaaggttgcaccatgtgccacaccaaccagaacaaatgcgacaactgtcatacccgccatgaattttcggcggcagaatcccgcaaaccggaagcctgtgccacctgtcacagcggcgtggatcataataactatgaagcctacattatgtccaagcatggcaaactggctgaaatgaaccggggaaactggaactggaatgttcgtctgaaagacgccttctccaaaggaggtcagaccgcaccgacctgtgcagcctgccacatggaatacgaaggggaatatacccataacatcacccgtaagacccgctgggcaaactacccgtttgttccggggattgcagaaaacatcaccagcgactggtcagaagctcgtctggattcctgggttgtgacctgtacccaatgtcactcggaacggtttgcccgctcctacctggatctcatggacaaaggtaccctggaagggctggctaaataccaggaagccaatgccattgttcacaaaatgtatgaagacggcaccctgactggtcaaaaaaccaatcgtccgaatccaccggcgccagagaaaccgggttttggtatcttcacccaactgttctggtccaagggtaacaacccggcctcacttgaactgaaagtgctggaaatggcagaaaacaatctggccaaaatgcacgtaggactggcacacgttaatccaggtggctggacttataccgaaggttggggtccgatgaaccgtgcctatgttgaaatccaggatgaatacaccaagatgcaggaaatgacagctctgcaagcgcgtgttaacaaactggaaggtaaaaaaaccagcctgcttgacctcaagggagcgggagaaaagatctcgctgggaggactgggaggtggaatgttgctggcgggagcgattgctctgattggctggcgtaaacgtaagcaaacgcaagcttga

SEQ ID NO: 54 - protein, 235 aa, Nitrosomonas eutropha
MKIIIACGLVAAALFTLTSGQSLAADAPFEGRKKCSSCHKPQAQSWKHTAHAKAMESLKPNVKVEAKQKAKLDPAKDYTQDKDCVGCHVDGFGQKGGYTIDSPKPMLTGVGCESCHGPGRKYRGDHRKAGQAFEKSGKKAPRKTLASKGQDFNFEERCSACHLNYEGSPWKGAKPPYTPYTPEVDAKYTFKFDEMVKDVKAMHEHYKLDGVFDGEPKFKFHDEFQANAKTAKKGK

SEQ ID NO: 55 - DNA, 708 bp, Nitrosomonas eutropha
atgaaaataataatagcctgcggactggttgctgcagccctgttcaccctgacaagtgggcagagtctggcagcggatgctccgtttgaaggtcggaaaaagtgcagttcctgtcacaaaccacaagcccagtcgtggaaacatactgctcacgccaaggcgatggaatcgctcaagcccaatgtcaaagtggaagccaaacaaaaagccaaactggatcctgccaaggactacacccaggacaaagactgcgtaggttgtcatgtggatggatttggccagaaaggcggctacacgatagactcccccaaacccatgctgacaggcgtaggctgtgaatcctgccacgggcctggacgtaaataccggggagatcaccgcaaggccgggcaagcatttgagaaatcgggcaaaaaagcgccgcgcaagaccctggcaagcaagggacaagactttaattttgaagagcgttgcagcgcctgtcatctgaactatgaaggatcaccctggaaaggagcaaaacctccctataccccgtacacaccggaagtggatgcgaaatataccttcaagtttgacgagatggtaaaagacgttaaagccatgcacgagcattacaaactggatggcgtatttgacggagagcctaaattcaagttccatgacgaattccaggccaatgctaaaactgccaaaaaaggaaaatag

SEQ ID NO: 56 - protein, 235 aa, Nitrosomonas eutropha
MKIIIACGLVAAALFTLTSGQSLAADAPFEGRKKCSSCHKPQAQSWKHTAHAKAMESLKPNVKVEAKQKAKLDPAKDYTQDKDCVGCHVDGFGQKGGYTIDSPKPMLTGVGCESCHGPGRKYRGDHRKAGQAFEKSGKKAPRKTLASKGQDFNFEERCSACHLNYEGSPWKGAKPPYTPYTPEVDPKYTFKFDEMVKDVKAMHEHYKLDGVFDGEPKFKFHDEFQANAKTAKKGK

SEQ ID NO: 57 - DNA, 708 bp, Nitrosomonas eutropha
atgaaaataataatagcctgcggactggttgctgcagccctgttcaccctgacaagtggacagagtctggcagcggatgctccgtttgaaggtcggaaaaagtgcagttcctgtcacaaaccacaagcccagtcgtggaaacatactgcccacgccaaggcgatggaatcgctcaagcccaatgtcaaagtggaagccaaacaaaaagccaaactggatcctgccaaggactacacccaggacaaagactgcgtaggttgccacgtggatggatttggccagaaaggtggctacacgatagactcccccaaacccatgctgacaggcgtaggctgtgaatcctgccacgggcctggacgtaaataccggggagatcaccgcaaggccgggcaagcatttgagaaatcgggcaaaaaagcgccgcgcaagaccctggcaagcaaggggcaagactttaattttgaagaacgttgcagcgcctgccatctgaactatgaagggtcaccctggaaaggagcaaaacctccctataccccgtacacaccggaagtggatccgaaatataccttcaagtttgacgagatggtaaaagacgttaaagccatgcacgagcattacaaactggatggcgtatttgacggagagcctaaattcaagttccatgacgaattccaggccaatgctaaaactgccaaaaaaggaaaatag

SEQ ID NO: 58 - protein, 235 aa, Nitrosomonas eutropha; identical to SEQ ID NO: 56

SEQ ID NO: 59 - DNA, 708 bp, Nitrosomonas eutropha
atgaaaataataatagcctgcggactggttgctgcagccctgttcaccctgacaagtggacagagtctggcagcggatgctccgtttgaaggtcggaaaaagtgcagttcctgtcacaaaccacaagcccagtcgtggaaacatactgcccacgccaaggcgatggaatcgctcaagcccaatgtcaaagtggaagccaaacaaaaagccaaactggatcctgccaaggactacacccaggacaaagactgcgtaggttgccacgtggatggatttggccagaaaggtggctacacgatagactcccccaaacccatgctgacaggcgtaggctgtgaatcctgccacgggcctggacgtaaataccggggagatcaccgcaaggccgggcaagcatttgagaaatcgggcaaaaaagcgccgcgcaagaccctggcaagcaaggggcaagactttaattttgaagaacgttgcagcgcctgccatctgaactatgaagggtcaccctggaaaggagcaaaacctccctataccccgtatacaccggaagtggatccgaaatacaccttcaagtttgacgagatggtaaaagacgtcaaagccatgcacgagcattacaaactggatggcgtatttgacggagagcctaaattcaagttccatgacgaattccaggccaacgctaaaactgccaaaaaaggaaaatag

SEQ ID NO: 60 - protein, 234 aa, Nitrosomonas eutropha
MTRLQKGSIGTLLTGALLGIALVAVVFGGEAALSTEEFCTSCHSMSYPQSELKESTHYGALGINPTCKDCHIPQGIENFHLAVATHVVDGARELWLEMVNDYSTLEKFNERRLEMAHDARMNLKKWDSITCRTCHVKPAPPGESAQAEHKKMETEGATCIDCHQNLVHEEAPMTDLNASLAAGKLVLKSEEGDDDVDDVDDEDEEVEVEVEETETADDSDSASSSNHDDDSDDE

SEQ ID NO: 61 - DNA, 705 bp, Nitrosomonas eutropha
atgactagactgcaaaaaggatcaattggtactttactgacaggagctctgctgggaatagcattggtggctgtggtttttggtggggaagctgcgttatcgaccgaagagttttgtaccagctgtcattccatgtcatacccacagagtgaattaaaagaatccacccactatggtgcattggggattaatccgacttgtaaagactgccatattccacaagggatagaaaatttccacctggcagtagcaactcacgtggttgatggtgccagagaactttggttggagatggtcaatgactactccaccctggagaagttcaacgaaagaagattggaaatggcacatgatgcccggatgaacctcaagaaatgggacagcattacctgccgtacctgtcatgtaaaaccagctcctccgggagaaagcgctcaggcggaacataagaaaatggaaacggaaggagcaacctgcatagactgtcatcagaatctggtgcatgaagaagcgccgatgacagatttgaatgcaagtcttgctgcaggcaagctggtattaaagtcggaagagggtgacgatgacgttgatgacgttgatgacgaggatgaagaagtcgaggtggaagttgaagaaactgaaacagctgacgacagcgactccgcttcctccagcaaccatgatgacgatagtgatgatgagtaa

SEQ ID NO: 62 - protein, 237 aa, Nitrosomonas eutropha
MTRLQKGSIGTLLTGALLGIALVAVVFGGEAALSTEEFCTSCHSMSYPQSELKESTHYGALGINPTCKDCHIPQGIENFHLAVATHVVDGARELWLEMVNDYSTLEKFNERRLEMAHDARMNLKKWDSITCRTCHVKPAPPGESAQAEHKKMETEGATCIDCHQNLVHEEAPMTDLNASLAAGKLVLKSEEGDDDVDDVDDVDDEDEEVEVEVEETETADDSDSASSSNHDDDSDDE

SEQ ID NO: 63 - DNA, 714 bp, Nitrosomonas eutropha
atgactagactgcaaaaaggatcaattggtactttactgacaggagctctgctgggaatagcattggtggctgtggtttttggtggggaagctgcgttatcgaccgaagagttttgtaccagctgtcattccatgtcatacccacagagtgaattaaaagaatccacccactatggtgcattggggattaatccgacttgtaaagactgccatattccacaagggatagaaaatttccacctggcagtagcaactcacgtggttgatggtgccagagaactttggttggagatggtcaatgactactccaccctggagaagttcaacgaaagaagattggaaatggcacatgatgcccggatgaacctcaagaaatgggacagcattacctgccgtacctgtcatgtaaaaccagctcctccgggagaaagcgctcaggcggaacataagaaaatggaaacggaaggagcaacctgcatagactgtcatcagaatctggtgcatgaagaagcgccgatgacagatttgaatgcaagtcttgctgcaggcaagctggtattaaagtcggaagagggtgacgatgacgttgatgacgttgatgacgttgatgacgaggatgaagaagtcgaggtggaagttgaagaaactgaaacagctgacgacagcgactccgcttcctccagcaaccatgatgacgatagtgatgatgagtaa

SEQ ID NO: 64 - DNA, 20 bp, Artificial Sequence
  Description of Artificial Sequence: Synthetic primer
aatctgtctccacaggcagc

SEQ ID NO: 65 - DNA, 20 bp, Artificial Sequence
  Description of Artificial Sequence: Synthetic primer
tatacccaccacccacgcta

SEQ ID NO: 66 - DNA, 1425 bp, Nitrosomonas eutropha
ttggttggtttgaaacaggtaagggagaaggaggaaaatcgccagaatatcgtcgccaaaggttatcggatcaccatagcttatccactcaaaggggagattatcatgagcaaggttcgtcgattaaaaaagagtttatatacggttactgcactaactctcggtttcggaccatttgtgacagcgagtggacaatcattcgaagaaacacccgtacaaacacccggacgagcttttgcagtggacaatttaaagggtatctgtgtacaaaacacaagtgaagacccctcattagcaatagcttgcaccttcgcactgggcgggataaatgatattaccgcgcagaatctgtctccacaggcagcgattcaggccgagtcgatcgcgattacttctccctatcagtttattcgcagcacgaatgaaagcatacagcggctaacaggtcgctctgctgagaaacgtcagcaacaatcctcttttttactacaaagctcagcgtcggtagcaggcacgccatcatttggcacttctggttttatagggcctgtaggggtttcgctgagcggtggcgggagctttggtgaacgcaataccgctgaagggcagaccggttttcaattgaatacccggcaaaccagcctgatgatcgattattcatttaatcaaaaattgattggcggcttttcctttaattatctggggacagatcgtaatttgagattggcgagtggggacttgaattccgatagctatcggtttgcaccctttgtgcttttcagaccaactaccaatagctacttaactctgatgggagggtatgctttggttaattatcgttccacgcgcagcgtttcgagtcaaaatgacatcacgtttgataacgccacagccaactatgatgctaatcagttttttgctagcgtgggtggtgggtatacctttactttaatggatggatggaatctgcgaggatatggtcgcggggactttagtgatattagtatccagagctttcaggaaaaaggtggcgttgctcatagtgggaacgatagtttatctcttgctatgtctgtgaataaacaaaccatacgctcggttaccagtacattaggcgttgaacttagtcatgcaattagcaccagaacttttattcccgtcattatcccgagactgcgtgcagaatgggtgcatgaatttgaaaacaatgccagaactatcacggccggtttcactggccagaactatagtcccacttctgcatcaatggcagttgcaagctcagtgcgtaattgggcaaacctgggggttggagtgcaaatgctgtttgcccgctcgattatcgggtacattaattacgacagattaattatcaagcacgcggagaacaatatcatttctggtgggattcgtatgaatttctaa

The invention claimed is:

1. A method of treating psoriasis in a subject, comprising: administering, as a spray, aerosol or mist, a preparation comprising live ammonia oxidizing bacteria, to the skin of the subject, in an amount effective to treat psoriasis.

2. The method of claim 1, wherein a peptide associated with psoriasis is altered.

3. The method of claim 1, wherein administering the preparation reduces inflammation.

4. The method of claim 1, wherein administering the preparation reduces or improves an inflammatory lesion count.

5. The method of claim 4, wherein the inflammatory lesion count relates to papules, pustules, or cyst/nodules.

6. The method of claim 1, wherein administering the preparation treats an inflammatory connective tissue disease or symptom thereof.

7. The method of claim 1, wherein administering the preparation reduces or improves one or more of erythema, edema, scaling, stinging, burning, and itching.

8. The method of claim 1, wherein administering the preparation reduces or improves one or more of oily appearance, pore appearance, radiance, blotchiness, skin tone evenness, visual smoothness, and tactile smoothness.

9. The method of claim 1, further comprising determining whether the subject is in need of treating psoriasis or reducing the severity or frequency of at least one symptom of psoriasis.

10. The method of claim 9, wherein the buffer solution is an aqueous buffer solution consisting essentially of disodium phosphate and magnesium chloride.

11. The method of claim 1, wherein the preparation of ammonia oxidizing bacteria comprises a suspension of the ammonia oxidizing bacteria in a buffer solution.

12. The method of claim 1, wherein the preparation is applied to any one or more of a face, neck, scalp, head, shoulder, arm, leg, underarm, torso, feet, knee, ankle, and buttocks of the subject.

13. The method of claim 12, wherein the preparation is applied to the arm or the leg of the subject.

14. The method of claim 1, wherein the preparation further comprises an excipient.

15. The method of claim 1, wherein the ammonia oxidizing bacteria is selected from the group consisting of *Nitrosomonas, Nitrosococcus, Nitrosospira, Nitrosocystis, Nitrosolobus, Nitrosovibrio*, and combinations thereof.

16. The method of claim 15, wherein the ammonia oxidizing bacteria is *Nitrosomonas eutropha* (*N. eutropha*).

17. The method of claim 16, wherein the ammonia oxidizing bacteria is *N. eutropha* D23, having ATCC accession number PTA-121157.

18. The method of claim 1, wherein the preparation is applied for about 7 to about 28 days.

19. The method of claim 1, wherein a psoriasis treatment selected from the group of:
a corticosteroid, a retinoid, coal tar, Vitamin D or an analogue thereof, a moisturizer, an emollient, dithranol, fluocinonide, and combinations thereof
is further administered to the subject.

20. The method of claim 1, wherein the preparation comprises viable ammonia oxidizing bacteria capable of converting ammonia or ammonium to nitrite at a rate of at least about 50 micromoles nitrite per minute.

* * * * *